United States Patent 11,549,145 (METHODS AND COMPOSITIONS FOR INHIBITING AND TREATING NEUROLOGICAL CONDITIONS) - sequence listing, part 17

SEQ ID NO: 128 - DNA, 147016 bp, Homo sapiens
aaacgggacctgtttaaaaataattcctgaaacctttcattattttttcactccccctttctcattacctgttgacttccctttaattatacaaaaagaaaaaattcagatacttaccaatccctccacctccccagcaggcaaaaatacttgttgcattccaaacttctgctaccacccacccttatacaaggtccctctggctcacatacagtgctgtggaaaaactggaacagaagtgcgtgagaataaaaagggcccagaaacactggcctgagttacttaccagctgctccctagtgagaacaagacagaataatacatttatgctgtgagaaagttaattttcatttggataaaggtcaatcttcctatcatgtggggtgttaggtactagaaaaagctatctctaaggacaataaagacaataataatttaaagtcaccatccaacaacagaatagctaacaatatgcttttaaaggttttcagccttcttccctgaggtatggagataagatctggagatcttatctctgcaatcatctttaatatcattcattcaactgtaattcccaagcttttgctatggtgccagatactacacactatagggctctgtaagactgagcaatatgtgcccttgaggcaatgtcactgaaaaagtagaagggcacaactataatcctctacaaatcctataaaggaatgtttaaaagttctatgaaagaagtggctaatatgattttactttatttggaggagggggaggtgtgtgtgcagagatttcagctgcatagagtaggcaactagaaaaagtgctacgtggcatggaggaaagaggcctaagggtgatgaagaaatggtaaggactgaggagagatgggaaaagtgggataacatcagaagggagaaaaaggacttgagaaagttgtgggcagagtacagaaacagagaagagatcatactagaaagctgactaagaataaagaggtaggtcagagagacccagtgaagggctttccatgttatagacaggtttggagtttattccaagattttagattaagtgaatgatcagatctgtccttttaaaagatacctaaaaataatctggaggatgaaataaggcagggaacatggagatcagaaggctcttgcataaactagtacctaagattagcacccagtctcagccaatactgaggaattttgggccaggatacactaggatctggagttcacttgaactccaaggaggagaggaagagaaagaaactaacaactcttgggttctagtgaagacaatatgggaattactttttgtggggaagtctctagatgaaaagtaatcaatgagcagtatttagaataaagtcttagacctcagaagacatttgggggaacagagatctgagaagcagagaagcacatcagtgtccccttaagcaatgggagaatgaaaagaaaaaagtctgggacacaactcatgaaaatatccatatcttaggatgcaggcaaagtagcaccagtggaagcttaagagtgatcaatgaagaatcaagaacattggctaaccgttcactgacactagaggcagcctggtctagtgggcaaaaataaaaagacctttacctttaaacttgtacttcaggcccaacactgattactatttgtcctcaatctctctctcaactgggtttctcatgtttaaaatcggggcaatggcctacgcccaggcacccttgcaaagttttggtgaagatgggtgactaaaacagatgcaaacgtacttggaaaaaatgttgacaatccattccccgactgactctgagaatgacctgtgttaagtccactagctctcgaactttagtgtgcacaaaaaaacatgctggacacttgtttctagagtcttgggggtcctattctagaataaaaacatctgaatttttaagttccaggtgactttcatgcagtggtccatggtccagatttaatgggatattgaatgggtccaatctcttaaaagattagaaagcaggctgagaagaatgctgtgtcaatgttgggttgaacaccaggcagtggcaaagcacaggaagtattacaatgaaagacaatttgagcaacagccttgtttctaaggatcataaatcctgggacatggaaatatccttattatgtattaaatctttatcatgatattcactttaatttcacctgttacagctaaaataaaattttagtagtaaagaactctcataaaaagacatttaaattaccgtaattttggagactacagaggaggcataagatccacttcaaaagagtaagacaggccaggtgccgaggcagcaggatagcttgagcccaggagttcaagaccagcctgggcaacacagggagacctcatatctacaaaaagtttaaaaattagccaggtggtggtgcatgcctgtggtcccagctacttgggaagcggaggcgagaggactgcttgagcccaggaggttgaggctacagtgaactgtgactgtgccactgcactccagcctgggcaacaaagcaagaccctgtttcaaaaacagagagagaaagagctaactttgagccctgccccccaactattccacaaagaactgtttggtatctactattatccacacctgttacatctaatcccagggtagactgatttgcacatggaggcctaacctcaaagacttgcattaacacttgttatctagagaatattctaccatttaatattcttggctttgaataacctaaagctcatttgctggaggttccaaaatactctgaagcctggttacagtgactgaaatcaggggttggaaatgtgtccttctctacaaagtccagaattcaggttcctagcagctacaactcagggttaggttagcattttggctgtgtacaacagcagttcttggacagtactgcaagctaacaaggtttctcactctcacaatttatttgggcaaattgccaatcaagattgatccagttttgctttttttggagggtaaaggacaatttgatgttcctaaaatcacgtgctgagctgtattttcaattagactcggcgggggtggggggaatcaaggtccaggattgcactttgtatgttaatacagaatgttgtagatgatactaaacacactgactgtagctaccagtcttctctgtgataggagactaagaatccagtaatttaaaataataaaatacttccttcccaaaagattatttgaaattgcatgtccaacccaaagcgacaatgctacagtttaaaaaaaaaataccttgtaatctatcatataggaaaacactacagcttaaaggaattggagctagcacacttgagctgatgctgctggtcatatatcaagtgcacctttatgtaaataacttaaagccttgaggaaataagcagtaatgagacagactacaattgaaaataatagcatgagagaattcaggttgttttggcttctttccccatttttctcttccccttcttaaaaaaaggaaccaatttcatcaaataaagaaaacagcccagttcctctgcttatgataaaaattagacaacaaaaatacttacacgggactggaattcaaagagcaatgatccaccatcatttctggaaggaaatccaacttaaacgcagccatcacctcactctccccttcagaagccaatgatattaacttgctgcacttgtctgatccacaaatacacacagctttagcttcctgggccccacaaaaaacacaaagtggaaacaggagctcagggaaaccagcaataagtgccacagaaagaggcaggactggggaaggggtagggaaagggagtattggattaaaatggggatgtgaccatgtgaagggaggctcagcccagcacacaatgaaagtgctgatgcgccaggcttgttttgtgcaattttccctggcgaagcagtactaagtgcactgtcagataaatagtgtcagatccatgaagatagcagtggctaacagagcagaagaaacacaaacttgtttcacatcctccaaactcctccctgcaaaccagtttttaaggtcccccaaagcctgaaactacctgaagcaagaaaaggctcaccgaagaaatgggttgttagccttgcttttaaacttacgtttccatgtgccaaagacagcaatgagcacagtgcttaggtccaaactaacctcagaacagtcacataaagaggaatgataagaccatcagaagcaggccagaggcaaactggttgaataaactggccaccagaaacttaccactcacatacaactgcctacagttgatcagccttgcttttttttttttcttgatattttcaaaagagcatcaatttctcaactgaccttgctttcttgatgtgctatctaatggttagagcaaggtgtgctatctaatggttcctcatctgggtgaaagacttcaaaaatcctttgttcagtaacactcattagatggcacagggaaattttctttactaactctgaagcttcatctgccagaaaataaaaatggaatagtaatattctgcttcttactagcatactaggaaataatgtattttcagttctctgttgtcctttctaaagaaacaaagaacaaaagccactttagtgataataatgaaaaagaactagggcctaccagggacaacactcaaacatgtaagggaaaaaccaagaaatgaagtctcttcattctctttttcctcctttaaactgttgataaaaccaagactagtgagtgcacacataaaaattctattatgggtgagcagtagagatggatatacttagcagtcaaggcagatgtgtgctcccgttctcaatttagctccacatccccccaaacaacaaatggcggcatttcaatatttaggcagtgactctaaaatgttatctctgaaggctcccaaatttcacaggctttctttccatttttatcattagagttgccttacctcaaagatttcacttcacccaagctcagttcacaacacagggaactttgaaaaaaagaagttatgttcagcctgcaaagaagtaaaacgaatgaactactaaacacacagagttaacgttaaaaaaaaaaaagaaaggcaacacacaatggcataggcctagaagttctaatctgtgtaacaatggctaacatctgtctgcacctgacccaggaaggtgaaaactgtctcttctgtccatgtccagacgtcatcatccaaaatctagaactgtactgtaacagcagcttactgctttttctatttttgccagagactcgctcatctgatttactactatagaggcagaagtggcaggagctctcttccaccctattaaagcggcaaaaacaaactgcaagtgagaggagactgtgcaactgacacacagtacacagtttaccaagcccatgcctgtcaggcagaagatggtaaccctagctggggctggttagattactggctatgtttgtcctagtttctcctacgtacattggaactgatggcatgcctcttcctatagaaagctgcctagaccaaagaataactgagtcgacaaccaaattagatcttttagtgcaagaattcctctaaaaagacattccaggctttaaaaaggctgagcaacaacagctcatggtggctcacgcctgtaatcaatcccaacacttttgggaggccaaggcgggcggatcacctgaggtcagaagttgaaggccagcctggctaagatagtgaaaccccatctctactaaaaaatatcaaaaaaaaaaattagctgggcgaggtggcacacgcctgtaaccccagctactcgggaggctaaggcaggagaatagcttgaacccaggaggcagaggctgtggtgagctgagatcacgccactgcactccagcctgggcgacagtaagactccgtctcccccaccaaaaaaaaatcctttaaaaaggattcaataaatttcaaggaacttacctaaatttcaaggttattgtgtttttaatatttcctaaaaacatatgaaatctaattgtatctctagttcaaatcagaatcacatctataacaaaagactacttaaatggagacattactgagttgccaggcactgtccaatgtatgaaaagatgtgctctccttaaaatagtttccaccaagccaagggctgggaaatatgatttagagtaatgtcttaaaatcattttttcccagtcatagaacttttgttcaaaagaagtctccagaggcccaatttataaagcagttgaaaatagaaagcagggcccataaattctctgtgcttatactgctattaaagtccattttatgatttataaagcaacaccgctttaaaaacctacaagatggaaatgttattacatgaaagagggcacttcttctcaggcaggtcaccagagttatctcagtataattaaattcaacatactttgggaaaagagagcacagaaattaatcacaagtcaattttagaaagaggttatgaagttaagtgataaaagcaattatgggaatacaaaaatgcaaatattaagggaaatttaaaagtagaattaaaagaaagttattcacaaaaaactgcccgtgtgtgcgtgtgtgtgtatgtgtgtgtgtgtgtttaatgtcttaattagtccggacacggtggctcaagcctgtaatcccagcactttgggaggccgatgcaggtggatcatgaggtcaggagatcgagaccatcctggctaacacggtgaaaccctgtctctactaaaaatacaaaaaattagctgggcgtggtggcacatgcctgtaatcccagctactcgggaggctgaggcaggagaatcacttgaacccgggaggcggaggttgcagtgagctgagattgcgccactgcactccagcctggacgacagagtgagactctgtctcaaaaaaaaatcagatagacattccaggcttttcccacaaaggaagcattagaaatacagaggtgacaggaggggttataaccaagggtctgctgcaaaagaaggccttaactttccctcagcctcttttcatcacctgttcctttcactctgaatgtactttcatggtttcctcttctctccctggttgtccgtctgtctcagtattctctgccttgaatattctctactttttaaaagagcaacaattcaaagcctgattaagtgaaggtaggagtagtcagcctgctgtaacattaagaacccaaatcattaaaagtgatcaatataggtaagaaaaacactcaaaagaacagcattcattgcatttaggatataggaatagtataaacttaacaggaagatgtaaaactggattagaaaagagaaaggctagcaatcacagtatgttttgccaaaaggatgaaaaagcaaacaaaagcacagttaagcaaaaaagcctagttggcatatgcaaatgtctaccttgatagatataaccagggagttctacaacaggtgaacagattttacacttccaccccaataaatctaagtatgtttgaaagggcaataaagtaaagtctagttatataagcacagaggagattagaagctactactgaaaagggaatcaatgtcattaaaaatcaccatcaatctatatgagggaattcaaattgcaaaaatctagggaatggttataacctcagattgctgctaagtggactgggtattttacccccaagtttcataagagagaaaaaaagtaagcaattgatacttgaaaataaccaactacagtaacttaaatttttgcacagtacctttttggacctaaatttcatttctaaaatcgagtatttctaatataactactgggtctcctgagctcccagccaagtaccttgcttgcataggtaaaatatggtgacacaaactggtaattatctctgtggcatttcactttgtggaagatttctgttattgttacaaaatgtgacggttaagaataatttacggggcaagaacacaggcttcacgcctatattcccaacactttgggaggccaaggtgggcagactgttcaagcccaggagtttgagactagtctgaccaacaaagagagacctatctctacaaaaaaatacaaaacattagctgagtgtggtgatgcatactgtagtctcagctactcaggaggctgaggcaggaggagtgactgggcccaggaggtcaaggctgcagtgaaccaagattgagccactgcactctagcctgggcaacagaataagaccctgtctcaaaacaaacaaacaaaaaacaaaacaacaaaataagttttccataagaatctagacaatgtaaaaatttctgaatggtgggggaggggggttaaagaagaaatagaaatattgtaaaaagaatttttctggctgggcacagtgggaaacgcctgtaatcccagcactttgggaggccaaggcaggagcatcatttgagctcaggcaagactagcctgggcaacatggcgccatctctacaaaaaaatacaaaaaatagtgaggcatgatggtgcccacctgtagtcccagctacttgtgaggctgaagtgggaggatcacctgaccccaggaaggtcaacgctgcagtgatacttgatcgcaccactacactccagcatgggcaacagcgtgagaccctgccttacaaaacaaaataaataaaacataaaaaacctccatttcaggctgggcgcggtggctcaccgcctctaatcccagcactttggaaggccgaggtgagcagatcacctaaggtcaggagttctagaccagtttgatcaacatggtgaaaccccatctctactaaaaatacaaaaattagccggatgtggtggcaggtgcctgtagtcccagctacttgggaggctgagacaggagaatcgcttgaacccaggaggcggaggttgcagtaagccgacaccatgccattgcactccagcctgggcgatagagtgagactctgtcaccaaaaaaaaaaaaaaaaaaatttccatttcaaatctaaaatcactgtaccaaaaaagcactacatttaataatttgttgtgtacaagttgccttgcctgtaaaattaccacatacagtatactgaaaggatatgacaaaaacatcaccattttgaaaacgaaaaagttttccatttcctcccctatccttaatcacagaaagactctgtactcagctctgtactactgctgtgtactcagcaatagtatagcctcagagccttccttggagtatctgtcagtaacactgacccaacagtcctgtcaaattgtgaccacccttccaatcaagtcatactttcagatcccacactagttctggaacttaagtgcatttcttagttggtaacaatatactgtaagtttacactttatttaagctccagtgctgatttaaaaatcagtatgttaggccaggcacggtggctcatgcctggaatcccaacactttaggagcccaagatgggcagatcacgaggtcagatcgagaccaccctggttaacacggtgaaatcccctctctactaaaaaaaatacaaaaaatacaaaaaaattagccggccatggtggcaggcagctgtagtcccagctactcaggagactgaggcaggagaatggcgtgaacctgggaggcagagcttgcagtgagccgagatcgtgccactgtactccagcctggctgacagagtgagactctgtctccaaaaaaaaaaaaaaatcagtatgttagccgggcacagtggctcctatctgtaatcccagtactttgggaggccgaggctggcagatcacctgaggtcaggagttcgagacctgtctctactaaaaatacaaaaatacaaaaattagccaggcacagtagcaggcacctgtaatcccagctactcaggaggctgaggcacgagaattgcctgaacccaggaggcagaggctgcagtgagctgagatcgtgccactgcactccagcctgggtgacaagagtgaaactctgtctccaaaaaaaaaaaaaaaaagtatgttgaacaaattctggttcaaggaaggtattagtacgtgcatggaatctactaagttccgtcctcatctctgttccagtggtgtccaatctttaggcttccttgtgccacactggaagaggaattgtcttaggccacaaataaaatatactaatgatagccgatgagttaaaaaaaaaaaatttgcaggctgggcgcggtggctcacacctgtaatcccagcactttgggaggccgaggtgggaggatcacaaggtcaagagatagagaccatcctggctaacacgatgaaaccccgtctctactaaaaatacaaaacattagccaggcgtggtggcacaggcctgttaatcccagctactcgggaggctgagccaggagaattgcttgaacccgggaggcggaggggttgcagtgagccaagatcgcgccactgctctccagcctgggtgacagagcgagactccggctcaaaaaaaagaaaaaaaaaatctcatgttttaagaaagttgataaatttgtgttaggctatatccaaagctgtcctgggctacatgcagcccacaggctgcgggttggacaagtctggtgtagagtattcctcccggctccctccaacatacacacgctcaccgcaacagctgtaagaactaggaagcagctagttttagtgggagataagcctgccttggaaaatagctaaggagaaagagttggaaaagagggcaagaaaatatttctagcttcccagggacacacattttgcaaatgttatcccataatgtacaaaagaagccatcacctttctgaaagcaactttttcatatctgcatagcaggcctcatgcaagaaggttaaaaagatagccacggagcacacccattcagtagttagcccatacctgtagctttacacttccctctctggactatgtcttcactctaaaaaaccaaggaaagaaaaataagtgggccatgcctagacgtctctcatgactccagatatatcacctctttccaaagaaaagcccctctgtcaccatggcagaagataaaaatacagaagtactcctcctgcgccctttttactcaatgccttaaagataagttgcatttaatatctcaaggctaattttaaaacaccatcaacttaaacgatgggggaagtaaaatactaaaaggtttaaaagagtcttgccctaaaatgtcgtaacaaatagcaaaacaatgactaaaatttatgaggttgaatttcagtacatctaggtcaccaaaacaatcatttttaacatctgcttttggattggagactaagaaaagctaatggctgtataattcttttagcaattaaggatcgtgttattcatgtggagagaccacactatttccccaaagcaaccttcctgaatacataggtgccgggcatgaaactctacaaaagcaaccacgttcctgccactgtaaatgcatcttggtggccctagggtggcggtgaaccactgaaacaaaaaaaaaaatcagaagatggggaagttaattgatggtaaaagcaaacagaggaaccacaaaaccaatttgttttatttttaagcatatcgaacaatcttgcaagtaaagactgattctataaaactgcccaaattcctacaaacttccaaatacaactcctgccagctgtatttctgtctggctttcactacagacaataaactattcaaattcaccaaggacaatgtctaaactggaaagtacaagaattctgaaagacaaagccagacccagaactaactagtaagacactgcctatcctccctgaagacagagagatttcttaactggcataaaataggtgctcaagtattaacttttcatgcagatttaattagtttccaattttgctaataaagtagtgatagttccagtaattttaagggcaaagtttaaactaattaaaaaaaaaaacagaacttcctaaaagcatttacttgcacctgcctctaccatcaaaagttaccaagaagaaaggaacttccatttactaagttcacaaacttcattcaatcctttatcattatgaccatttaaggtgaggactaccctaaggattcagatgctaaggaagataacctgcccgtggcttcttggtaggtctgtctctctagagaaatgtgaccataatttaggagatatcaacttttactgagatagtgtgtcctgagaaggctctgtaatgattatcacagatggtagacagcaagttaaatttctacctgttaagagttcttctggaagatgtaaaagtcaaagaaaaggccagggaaccacatttccctccaaattttatgtggaacacagtttgaaaaacagtgttattatgtgattggtttttcataggcatcacttccaccctctgagacgagactcagactgcaagctagtcagggaatctccaagataaagagagcaaaagggagatctggagttgttaagaaagaccaatacacaaaagggtaagggacaggtatcttaagtcctggagaacatagcagccctcagggggctaggaacattttaactgccaggccaagagaaagaaaaaaaaatgaatttctttaaaaaaaaaaaaaaaaacccaaaagaacaaaaaaacaaaaaacctccacataaacagggtatcatcctactcctaagccaccaagactttttaaaggaaacctcaaacacacacacacacacacacacataaataaacaacactgtaatcttccacacaggattctgtcacctggagaagggcaaatgaatagtccaatacacaaaaaaggctgttttgagacggagtttcgctcttgttgcccagggtggagtgcaatgacgcgatctcggcttactgcaacctccgcctcccaggtttaagcaatcctttgcctcagcctcctgagtagctgggattacaggcatgcgccaccatgcccagctaattttgtgtttttagtagagatggggtttcaccatgttggtcaggctagtctcgaactcctgacctcaggggatccgcccacctccgcctcccaatgtgctgggattatagggggtgagccaccgtgcccggcctcaaaaaagttatatttttttaaagctttgtcttcccagttttgcttttcctatgttattttattgcctattctgtgagaaaactgaaacgctttggtgagagagaagagctgaatggaaactaaaagctttgactgttttacatctttcctttcatttctgtggggaaccaaagggcacatgctctgtgagaaagcctgaactgtttgtactgtatttccttggaactccacggatgtctgtttctattaacattatctctacctttctctatcacaatgcaagaaccaggaagtacacaggtggttctaaagaggagtaaaaaagctaagaggggggctgggtgtgacggtatacacctgtagtcctagcaacttggaaggataaggcaggagcactgtttgagcccggaagtttgaggctgtagtgagctatgctggcaccactgcactccagcttaggccacacagtgagaccttgtctccccaccccactccaaaataaggctaaagggaaaaaggagcaaaaaaaatgtagggaacagccaggagtggttcatgcctgtaatcccagcactttgggaggccgaggcaggtggatcacttaaggccaggagttccagaccagcctggccaatgtgaggaaacaccgtctctactaaaaatacaaacattaggccagatgcagtggctcacgcctgtaatcctagcactttgggaggctgaggtgggcgggtcacttgaggtcaggaattcaagaccagtctggccaacacggtgaaaccctatctctactaaaaacacaaaaattagctgggtgtggtgtctcaaaaaaaaaaaaaaaatggccggacatggtggcgtgcacctgtaatcccagctacttgcgaggctaaggcataagaatcacttgaactcgggaagcggaggttgcagtgagccgagatcccgccactgcattccagcctgggcaacagggtgagatactgtctcaaaaaagaaaaaaaaaagtaaggaagtagggagagtggtgagagcaagatgaagggcaagctagctgagagttccaatattatctacctgcgataaatgtttaaagacatttaaaatacaacctcataagaagttttttaacttcactgacagaaaaggctctcagatcctctaaaagcctttcttagaataggcaaggtaataagctctttattcttagtgttttctactggcctatacagcttgtatgctgagtaaatgacaaaatattgtctttcccaggatgactggcactgactcagtcaccatcagcagctcttacatagcacgtgctagatcacaaagtccagagacaagggcctgtggcacgatgatgttcaataacatacatcagtcctaaacccatgaacttggcctcattagtaagactcactgttttttgtttttgagggtctcgctctgttgcccaggctggaatgcagcggtgtcatctcggctcactgcaacctccgcctcctgggctcaagcaatcctcccaccacggcttcccaagtagcttgaactacaggtgtgcaccaccacgcccggctaatttttgtattttttgtagagaaggggttttgccatgttgcccaggctggtcttgaactcctgggctcaagcgatccaccccctcttggcctcacaaagtgctgggattacaggtgcaagcccccgcatctggccaactcactcttaactaacaactgttagtaagcaaccttaaaattccttgaaaaacttccttgatataagacagggagctaataaagaatttagccaggaagaaaaagaatttagctgggtacagtggctcatacctataatcccaacactctgggaagctcaagtgagaggactgcatgagcccacaagtttgagaccagcctgggcaacatcatgaaaccctgttgctacccaaaaagaaaaaaaaaaattagatgggtgtggtgacatgtgtctgtagtcccagctacttggaaggctgaggtgggaggattgcttgagcccagaggtcgaggctgcagtgagctgtgatggcaccactgcactccagcctaggcaacagagcaagatcgtctcaaaaaccaaaacaaaaaaataatctaactactatccagattagaggtttttaaacgatcttaaaagcagaactgtttttctcctaaacatgaaagtcaggctgttcaggtcaaagatagaggagggagaggcaggccccaactgtcagtctctcttggccctcaggataacctcttgggaaatatgagaactagatgaaataattcaaacaatagataattcatcaatattatatctggctttgacataaatggttttttgaacaataaatttttctatctttagaatcaatgtatttaacataccatcagtgctaataaatgtgcatcttcaaattgatggaatatggcatttaaagtttgtaaacccttatcacctaaaagtaaagagaaatgtctagacatttgtaaagtggcaataagtacgagctaacattttttgagcatttaccatacactatgacctgttttgggtgctttacatttaatcctcatacgtacgctatctccattttgcagatgagaaaagatacagagatgaaatgactccctcaagatcacagagatccgggctaagaaggctgcttcaggttaaaaattgtctccaaggaagctcatgcacataacccacagaaagtctgtttaaatgctaagggccataaagttgagtctgactttttttttgagacagagtctctctctcttttccaggctgaagtgaagtggcatgatctcgactcactgcaacctctgcctcccgggttcaagtgcttcttgtgcctcagcctcccaagcagctaggactacaggcacaagccatcatgcccagctaatgttttgtattttcagcagaaacagggtttccccatgttgccaaagctggtcttgaactcctgagtttaggcaatccaccctccttggcctcccagagtaagctaggattacaggagtgagccactgtgcccggttttttgttttgttttgttttgagatggagtcccgctctgtttcccaggctggagtgcggtggcatgatctctgcttactgcaacctccgcctcccaggttcaaacgattctcctgcctcaacctcctgagtagctgggactacaggcactggccaccaagcctggctaatttttttgtatttttagtagagacaggttttcactgtattagccaggatagtcctgatctcctgacctcatgatccacctgccttggcctcccaaagtgctggaattacaggcatgagccaccgtgcccagaattttttttttttttttttttttagagatgagggatcactctgcccagctaattttttttgtatttttagtagagacagagtctggccatgttagccagggtggtctcgaactcctgacctcaaatgatctgcctgcctcagcctcccgaaatgttgggattacagatgtgagcctccgcaccctgcccaaacttttaactggaaaagagaaaaaagacaaataatagaaataacttgggaaaagtatattctctttaaagtattactttttggtcagcttgcaatgccctttacttctttcttcctgttacatgcctagctcaataagtaagttaggccccctgctttggaaaactccatgttcacctactctcatgctccagagagccaagtaaacagataaaaggatcaagcgggaagcagacctctcaggagctggaggcctgtaagcccaacaatgctttaggctaaacagactaaactttatgctaaaccgtgtgaaaatggacaagtgagatttcctgaaaacaaaatccacagctttcatcagattctataaggggttcacaaccattcttagaatggtcccctcttggacttccaatccctagaggatgggactagattaatctagactaacactaggtcatctaaaactataattgtattttctctaaacaagtttttaaacagctatctagtttagtccacatcacatacaattcacctcatttaaaatgttgttagtgattttaatctcatttcaaaatgttgttagtgaactatgtttcaactttctcatttatattcatatccacagaacacctgaataaaagtaacacatatcagaccttcaattgttgaacttaattccccagtttatctggtgtaatttgtaaagtttctatgaactttcctgaattgagacatacttgcacttcctagttttttgggggttttcccccctgaaattgcaggtactgtaaaagcaacatgtgggcagcaccccctctttttttttttttgagacagagtctcgctctgtcacccaggctggagtgcagtggcgtgatctcagctcactgcaagctccgcctctcgggtgcatgccattctcctgcctcagccttccgagtagctgggactacaggcacccgccaccacgcctaattttttgtatttttagtagagatggggtttcaccatgttagccaggatggtctcgatctcctgacctcgtgatccgcccacctcggcctcccaaagtgctaggattacaggcgtgagccactgcgcccggccaccctctttttttttttttaaacaaaatatttcataagtattccttcctgttttaatttttccatttccccaactttaattaattatacttacaaccatattttggtttatcttctaccaggatttcttccatgcatacaataaaatgtacaaacactcaaatacacaaaattttccttttttttttccccccagatggagtcttgttctgttgtccaggctggagtgcagtggcatgatctcagctcactgcagcctctgcctcccgggttcaagcaattctcctgcctcagcctcccaagtagctgggactacaggcgtgcaccaccacacccagctaatttttgtattttttagtacagacagggtttcgacatgttggccaggctggaactcctgacctcaagtgatgggctcaccttggcctcccaaagtactgggattacaggcatgagccaccatgtctggcctcaaatacacagaattttcaaattcaatattatactaagtataatactgcacaacctacttttttgcacctaacaatgataaacattttctcgtaagcagccattattaaaggatcagagccacaaatggcctaaagcttgactctgccaatagcatccttgcatattcacaaccaataaatagaactacctccctaatctagctcacctcccatttagttatatgatctttccatgagtatataagcacctaaaccagaggtcgtctcacctgagagacaccctattttagaggcactcagatgaggcaaacagagcatgcaaaaaacatttttaaaaatctctttttggccaggcatgatggctcatgcctgtaatcccagcactttgggaggccaaggcaggaacatctctagcacccaggagtttgagaccagcctcggcaacatagcaagaccctatctctacaaaaaaaaaaaaaaaaaaaatcagacaggcatggcagtgcacgcctgtagccctaatttggatgctgaggtaggaagattgcttgagtccagaaatttgaggctgcagtgagccatgatcgtgccactgcactccagtctggctgacagagcaagaccttgtttcaaaaaataaaataatttaaaaaatctcttttcctatttcctccccaaatgcccacacactgggtgtaactctcaaatcccccgtatttcctctctgctccccaaacagcttcctactgtggtgagagctgggaggtgggaggaggaatctaattctttctatagttcctgtttctttaccatggcagtactgtcaacaatggacaacaaattgctggatgcagcagtagcaatttacatatggtagctaagctaatgcacagctttctctgggcagaattactaacgcttctacctatcattgcagtttgaacccaatgttccaggcacaccagtgttaagtatttgcctggtggcttctaccttcaaaggcacagggaatgatacacagaagtaatacacagaagtgagggaggtggagggagtgggagctctgaacccaccgagggagggtgctcgctccaaggactgtgacaccagacaaagtacctaattcaaacccaaaggctcagtcattcaacctttccataatattcatgatcacttgctcaaatctggcatgttctaagaccacagttccttcttagtttcactgccctgccatgaggccaaatctgtcttatctagtgagtcactactgctcctctttccaactgcattttgatttcagcccacttgtgcagctcatcagggctgcaccatatgttagtaccatgtaggcagaatgtgactaatttttttctcaagccctgtcagagcgacttttaaaatcaccttataatcttgatgtctcttgcggagtcattataacacataacctttggaaaggactataattatttttctgagtgctcaaaggagattcttcagcattttcattcccatttttcagatgaaggaactaaagggaagataagggattaagagacctgggttccacaaccaaccactgggacttggactttcttgagtcacagtgctgtatttggtaaaataaggcagcttgtaaaatgccttttattgggaaactcaaaatattactttgcctctctttattatttacttatttatttttttttagatagagtcttgctctgtcacccaggctagagggtagtggtgcaatcttggctccctgcaacctctgcctcccgggttcaacatggtgaaaccctatctctactaaaaatacaaaaattagctgggcatggtggcaggcgcctgtaatcccagctacttgggaggctacggcaggaagaattgcttgaacccaggaggtgaactgaaatcatgtcactgcactccagcctgggtgacagagcaagactctgtctcaaaataaaaaataaaaataaaaagagagagagaaaaggactgaatggcccatggaccacaaatgttttttgaattggtcaagatcataataagtgagtgaaagtaatgctctaatacactgaaagtaaaatagagatgacttgcagatttagctagtatcaccaaattcccccgaatttagtttaaaaggaaggcgagcagctgcttccacctcctctaggcaacctgcctcttctccaacaataatagcaataatggttgctacagctgataattaagctcatctcaagagggtttcttaaatcttccgggtattgcagatcctatgtttattctagcaactctttagggtaattgcttgactgacattgcaattattaggcctccccatctccattaataatattctctttttttttttttgtttgagacagagtctcgctctgtcgcctaggctggagtgcagtggcatgatcttggctcactgcaatctctgcctcccagttgtaagcaattttcctgcctcagcctccccagtagctgggactacaggcccaagccaccaagcctggctaatttttatatttttttagtagagacaaggtttcatcatgttggccaggctggttttgaactcctgacctcaggtgatccacttgcctcagtgtccccaagtgctgggattacagacatgagccaccacgcccagctcactagtatttttcaatggataatatcacttgcaaaatataaaaagggatagtatctcatcaatattgaaaactgagctgagcacagtggctcacacttataatctcagcactttgggaggactgcttgagcccacaagttccagaccagcccaggcaatatagtgagacttatctctacaaaaaaattcaaaaattagctgggtgtggtggcacgtgcctgtagtcccagttacttgggaagctgaggcgggagaatcacttgagcccaggaggtcgggctgcagtgaactgtgatcatgccactgcactccagcctggacaactgagagagagcctgtctaaaaaaacaaacagagaaaaaaaaaaaaaaaaaaagacatgccctttgaattcagcaatcccagttctagaaatatagtttacaaataatcttgtatctgatgtatacaaagtatgcaaaggggcattcataagaacattgtttacatcagcaaaacctgaaaacatatgcccattaattgaaggctattaaatacagtataaccatacaacagaacactatgtagctattaaagaaaataaggcagctaactgatcaagacgtattcatataataagaaaggaattacacatggcttgtatatgaacagagtatctctggatggataaagaaataactgctaacagtagttgtagaggtggaacagtggttgaattgtttacatgtgaacacgttacctattctacagaaatttttttttttttgagacgaagttatgctcttgttgcccaggctagagtacaatggcgcaatattggctcactgcaacctccgcctcccgggttcaagcaattctactgcctcagcctcccgagcagctgggattacaggcacctgccaccaaacccagctacttttttgtatttttagtagagatggggtttcaccatgttggccaagctggtctcgaactcctgaccttaggtgatcgacctgaagtgctaggattacaggcacgagccactgtgcccggcctactgaaaatttttttaaagaaaacttgagcttttggagcatggcaacctagcctgcagacaccgtatccccttgtccacttccccctgcaacccataagtccattcctaccacttaaaaaaaggaaaactcgtggaactataaagcacaaagtaaagaaaaacctcaactcatactcttttccaaaacagcattttggttttgtatttttttcctgctttgcctgaaacttctgtgtggaaactgccattgtccaggtgatccagcagtatatcataattacatcacaccattttaaatgaccccagcaactcaaataacgttcatgcagctgggacctcatcatgtatggcctatttacaaagtctgaagctatttcaatcactcagctgtatagctatacattttcttcaatcaacctttcctgccaaggcaaagtgcaacattagctggattccagtaaagaaggcaagggacagggtgagataatatgtcaaaacaagttctataaatacagcttttggcttgtatctcaaaaaggaatcaaaagagcttcaagtttaaacagaaaaaccctacagtccctgcagtatcttacttgaaggctctagagaacagaagacaccagggaactggaatcttatttctcacactgtaatatcttgtctctctctcccttatctcaggggcaggtttagatgcaattgcaagctttatcattccaactctgcatctcccctgcctcttttcttatcttaccacctctaccctaccaaacacatcaatttccttcctctctgtgaggctgctccacctcttaggcagacaggcccaatacacacaacatacaacagtctttccttagcactagccacctaacttctatcatctccaaaatccttgaccaagcagccaagaaccctgcctttaccatctgccccaacctcaccatcaaacacacgggcactcatgcgggatgcttccatatggtcttgtttcaggagctttgccctgttctgttgaaaagcaggaaactttattttctttctgttcttaaattcttaattctataaaactagagaaaccagaaactacttctgtagagacacttcctgagacagttaggttataggccagaaaatgcaaattttgtacctctgcttcagccaatcagggaacatgttcagcaaagcttgattcaccctaaaggacgcacagccctaagacaaattctattctattctattatcactttttaaaaaaagttactttggctggcctgtaatcccagcattttgggaggccgaggcaggtggatcacttgaggtcagagttcgagaccagcctggccaacggggtgaaaccccatctctactacaaatacaaacaaattagcccggcgtggaggcgggaacctgtaatcccagttacttgggaggctggggcagaagaatcacttgaacagggaggcacaggttgcagtgagctgagatcacaccactgcactccagcctgtgtgacagagcgagactccatctctaaataaataaataaataaataaataaataaataaataaataaataaggtacttcaattatcatgctttcatcactctgcaattgtgctcctaaaggtgcttctcgccgggcgtggtggctcacgcctataatcccagcacttgcactttgggaggccaaggcgggtggatcacaaggtcaggagatcgagaccatcctggctaacacggtgaaacccctactgaaaataaaaattagctgggcgtggtcgtgggcgcctgtagtccccgctactcgggaggctgaggcaggagaatggcatgaacccaggaggcgcagcttttagtgagctgagatcgtgccactgcattccagcctgggcgacggagccagactccgtctcaaaaaaaaaaaaaaggagtgcttctcacatttaaatacccacttaaatcatctgtcacatccttcaaatcactcctaaaaaaactcaactgttccacaaaatttaacttgtcagtgctttgatttcatttttacaaaaacaagctcttaaaaaaaaaagccaggagatctatcaatcaaaaaagcaactacatttttagaaaacatctactatatacccagaactaaagaggataccaaaaaaaaaggcacaatccctgtccttaaggagttaatggtcttgttcagaaaatacgacttgcactagaaacaagaaacatgggagagcatctatctaagggaaaatgttaccataaatgtgaaagacttaaaaaatctcaggagagctgattcttatttccctgtctaaatcaaatttttgtgctatttcatcacactgtccatgatacaatacattttttgctaccctccactgaattacatggcctactaataattccttcatcatcatttcttttgaacagacttctctgtgttttcctgtcactctcacacagattataagtttatggatatggcaaaacttgctggttctaccttcccatgctccccttgtaagggcatctccggaagatgtgtggtgcaggaacgaggtaaagaagcaggccaggcactgtggctcatgcctgtaatcccagcactttgggaagccgaggtgggcagatcacttgagctcaggagttcaagaccagcctgggcaacatggcaaaaccctacctctacccaaaaaatacaaaaaaattaactgggcatggcggcatgtgcctgtggtcccagccactcaggaggctgaggtgggaggatcacttgaccctgggagcagaggttgtggtgagccaagattgtgccactgccctccagcctgggtcagtgagaaccaatctcttcctgcgctcccccccgacccaaaaaaggctaaaattaattctgctttcaatatcttcagtaaatagtctggtactagtggagataaactagtaattttagagatgtttcacaaacttgttacttggcttgctgttctttaccaccaataaatgaactagagggccgggcgtggtggctcacgcctgtaatcccagcactctgggaggccaagatgggcggatcacgaagttaggagatcgagtccatcctggctaatacagtgaaaccccatctctactaaaaatacaaaaaaattagccgggcatagtggcgggcgcctgtagtcccagctactccggaggctgaggcaggagaatggcgtgaacctgggaggcggagtttgcagtgagccgacgtcgtgccactgcactccagcctgggcgactgagagagactccgtctccaaaaataaaaaataaaataaaaaataaatgaactagtacagttgatggtgatctgcaaaaccaaaatcatatagttattttcataaggaaattctaaaatgaaaatgggttagactgattcataatttaataatctcaaataacaaagtgtgctaataaaatagacaaatatttactacaaacccacaatgtaccctatacctagactctagagtcataccactgctttctaatcccagttttgctgcttactagccaggtaactggggaaattgtttaacttcttcataaatacctctgtttcttcatgcacaaaatggttacacaaacagtatctaccttacaggatatttgttagaattaaatttatacatgtaaagcatttagaatagtgcctgacacatagaaagtgctcaataaacatttgctactattattattctgggcaccaagcttggtgtttatggtggaaaagaatgagtcccaaaaaatttcagcctgttacatgatgattctatctcttcaaaataaagtacctgatcttaagatgtactgtacaacgctcaatggttatgttactcaaagacaacaggttcatctgtttactgagctagaaacatagtgtgtagtttcactttttaaaatgcaacagctatgctgatttttttttttttttgacacgggttttgctcttgttgcccaggctggagtgcaatggcatgatctcagctcatcacaacctccatctcccggattcgagagattctccggcctcagcctcccgagtagctgggattactggcatgtgccaccaagcctggctgatttttttgtatttttagtagacacggggtttctccatgttggtcaggctggtcttgaactcccgacctcaggtgatctgcctgcctcggcctcccaaagtgctaggattacaggtgtgagccaccttgcccagctgaaattttttttatcattaacacttgaagtaggccgggcatggtggctcaagcctgtaaccccagcactttgggaggccaaggcaggtggatcacccgagatcaggagttggagaccagcctggccaacatggtgaaaccccatctctactaaaaatacaaaaattagctgggcatggtggtgggcgtctgaagtcccagctactactacggaggctgagtcaggagaacccgggaggcagaggttgcagtgagctgagattgtgccattgcactccagccttggtgacagagcaagattctgtctaaaacaacaacaacaacaacaacaaaacgccaggcacagtggctcaggcctgtaatcccagcactttgggaggccaaggtgggtggatcacctgaggtcaggagttcgagaccagcctggccaacgtggtgaaaccccatctctactaaaatacaaaaattagccaggtgtggtggcatgcgcttgtagtcgcagctactcagaggctgaggcaggagaattgcttgaacctgggaggtggaggctgcagtgagctgagttcgtgccactgcactccagcctgggcaacagagcgagactccatctccagaaaaaaaaaaaaaaaagcaaacttgaagtaataaaataggcttcatttatttaaaaaaaaaattgggtacctgagattattccaaaatatttcctagcaggagggggaagtgaataggtaagaattctggcagcaataggctgacagatcttgcacctccaactgggcctgttagagtccagtatatcttcattatggattaccaaaccacttgttctgagaacacttatttatgtataaacatttattcattccttccatcaaaccaaaaaaaaaatttctttcatgaagctttcaaaatggacacactggaaaaatataaactaataaaatgagaccagggaagttataaattttaaaaaaggccaagaacaaaaagaaagctagaatataggtgtgctaatcagagtgtcacttactgaggctgagctgtaaaatcaaagagctgccactgattttaatctccaatgacaggctctacatagggtgcacaatgattcatagtataaatgggaaaacattaggacagtaaaatgagaagggcactaagaatagccaagaaagagaagatgaagcagatataatgccacactcaaaagaatttggaaagtcagtaaatatacaggatccaggagaggctaagcaccaggtcctagaccctaaacaaataagcatccaaaacctacaatgcacaaggtgcagaagagatccctaagtgattcagagccagaatacatcagtgtatagtcacacagaactctgcatccataccacacagccacagaagaagctgcctcaatcaaggtgtttctccagcatttaataacgtcctttcctctcctcattgactacagttacaaatagtatgggcagagaactgtctcatccccactcagctgacaagttctattcccaacactgcatgcttatgactcatgaggggatgggggaggggagtgaaaggaaactgtaaaacaaagcaacaaacttgaatttagacttacactgaccaggagtaagaattcatcactgtttaattagaatatctcataacaaaccaagaaagtatccttttaaaatacagtaacaaacccagtatcttctgaaaataacctgaaatttgtctacatgtcatgtcttctgctattccttaaacagacatgacaccaaaaggcattacaaggcctctgtaaggccaaactttacaaagcactcaaacagcgcaaacagcataggttgctgtggggcccaaagcaacagggcattccccacagttcctttcctggcagacagcgaagtcaacacacttaacccctactgcactctttcaagatgtgcactaaatcatttcttaaaggggtggaggtgcctcatctttttatactcaaattttatgtcaaaaaatttgagtgccaggaaaggaattcaataccaccccaagagctgatctttgtgacctgtaacaaaacaaagaggaaaaaaaaaacactaccacttcaacaaggtatgtttctaagggaacccaaagaccatttctgacatcacatttccctgtttggtaccctctcgccaagacggtattttgttaaatacaaatcttgtctcctcaccccatccctaacaacctgaagcattctctacaatttacaattgacaaacctgaacacagcaaaacaacaaagacaaacgagtcacctctttcacttgaaaacctcagtcctccacagagacgcacacagacagacagatggatgcacgtaagaacacaaactgtgtgccctggctgagtcctgagcaggtctgagccggtgcgggtgccaaagggtggccacacggcctagctagtgggctgctcctgctgttgctgtacaaatatagcaagctaaaaagtggaacagcagcttcagcagaacagattctgctccgtgctcagagagggaggagcagggaactgaacagctttacccatacatggttgctgaaagggggccattagtgaaagcccaattatctcacacacatgcattctgttcacatgctccagacaaaaaacagaaacacacaggctggtacttgaaataaggtttgagatattctatttcagtcaaggaacttccaaataatttcagtcactgacaccaagaatccctcagccacgggaaatggaaaagacatttgaaaacctttactaggtcagattcttcccagatcagcagtagtggtgaggctcaatttatcatttaaatcctaaaatttaacatgcaaaaaaaggttattctccattcgagtgaacaatgttaactttcactagttccttgctgctttcagaatgaaggtctcattccaactgtgtatgttttgagctcttttttattttatggttgatacaagttaaaataaactctaatataatttttaaaatctatgtctgaggatgatggcttatataaccagaagccaaatatttgtgttccaaaaattattttacttagaacaattcatttagattcacttcaatgtgaagtatgtgaaaagcttaattgctgaccagagtgaattttccaacaataagaaatgcatggctgattggctcaaatgattctattcttcagcccttactgaagtacttagtgcataccacctatgtaattttattccccccttatagagatggggtttcaccatgctgcccaggcgggtctcaaactcctaggtacaagtgatccactcacttcggcttgccaaagggctgggattactggcatgagccaccaagcccagcctggttatgtatttattcggtatcataggggctacagcacaaatcaaaaccatagtatcagtgacctccaatctaattcctagatgagattaacatgagatattaataataaaggcagacagtacatgactactgcactaaagcgtggggtacaaactataaatgctatacacattaagagaagagaggctggccttgatagctcacatgtataatctcagcactttggtaggccaaggtgggtggaccacttgagcccaggagtttgagaccagcctgggcaatgtggcgagaacccgtctctatccacaaacaaacaaaaaaacaaacaaaaaaaaaaaaggaagaaagaaaagagagaagagagactgagaacagacagacctagactttcttgcttatcccacctaccagaactctcattaagggcacctgcgcaccaggagtggtagctcacgtctgtaatcccagcactttgggaggccaaggtgggcagatcacctcaggtccggagttcgagaccagcctgaccaacagggagaaaccccgtctttactaaaaatacaaaattagccaggtgtggtggtgcatgccaggtgtgggggtggctgaggcaggagaatcgcttgaacctgggaagcggaggttgccgtgagccaagattgtgccattgcactccagcttaggtaacaagagcaaaactctgtctcaaggaagaaaaaaagaaggcacctgcgatatcttaaatgtgaagaatacagaatttgaacaagatgatttctaagatccctccatttctgaaactctgagtgtggtttcaacctgaaatgtttcatagtatgagattaataccacactgcttatggaagcaaaattatagtttttgcctactttagagaaaacatattctaaactaagataaaaataaattcagaccataactcagcatccactgtaacatttctcatgtaacactttcaggaaaatgttcttccatctgagacatttctgcctagcctgttgaataaattttaaaccactattaagaaaaaacaaaaacaaaaaccctgtcacagggaaatagaatggtggaactagaaatgtttatgctgatataactatgagatccttgattataaaacactgctaagttaaccagtcatcaaaaggagttccaggccgggcagtggtggctcgtgcctgcaatcccacgatggatcacctgaggtcaggagttcaagaccagcctggccaacaaggtgaaaccctgtctctattaaaaatacaaaaattagctgggcgtgggggcgcgtgcctgtaatcccagctactcaggaggctgaggcaggagaatcacttgaacccaggaggcagaggttgcagtcagccgagattgtgccactgcactccagcctgggcgacaagagcaaaactccgtctaaaaaaaaaaaaaagcttcaaagaaaaaagcactgcctagctcctatccattactgagtacacagcaggattccagcagtagaggcacattcatgtcccataaaacagacatgcaagtattcaacatgttattaaaagcctcttaacactaaacataaggagacctcatctctacagaaagaagtaaaaaattagccggacatggtggcacgtgcctgtagtcccaactactcagggggctgaggtgggaagattccttgagcccaggaggtcaagactgcagttagccgtgatcgtgccaccgcactccggcctgggtgacaaagtgagacactgcctcaaaaaacaaaaaaaattaagtaaaagcctcttaagtaaaagcctcttaactgggccacatgcagtgtttcacccctgtaatcccagcactttgagaggtcaagggagaggatcacttgagatcaggagttcaagtacaccctgggcaacacagaccctgtctctacaaaacttaaaaaaaaaattaagcctcttcattgtatatactggcttattcattgtatatactgacttcattgtatacactgtatttaattttttaagaatctgagcagtcctattacagcaactttgacttcccaaagagcagtttactgtgaattaatatgcttttttcgtgtttaagatcacagctttaattacctgtatgttctctactaaaaatacttgtgtgaaggcaactaagtaaaaataacacaaagcaggccaggtgtggtggctcacgcctgtaacctcagcactttgggaggccgaggcaggtggatcacctgaggtgaggagttcaagaccagcctggccaacatggtgaaaccccgtctctactaaaaatacaaaaattagctgggcgtggtggtgcatgcctgtaatcccagctactccggaggctgagacaggagaatgggttgaacccgagaggcggaggttgcagtgagccaggatcacaccattgcactctggcctgggtgacaagagtgaaaatctgtcccccatccccccacccctcccaaaaacaaacacacagcaatacaccacagttgtgtacatgaaaaggaattgctccaagtataacctcaaaatcaaaatgactataaacacgtaaagtatggcctttgatatgtcagttctcctcccttatttcctcaagagaaatacgggattggactagatcggggtccatatgtatggcccattgacatttcataaattcaaaaaacttccttatactatgtgtaaaactctacctctgtatgcatttataaggaaatggattcacaacttttaccagattttcagtttaaggactcaagacaacaatatacagttattccatctcacatttttttaaaaagttaaagtttggccaggcacagtggctcacatctgtaatacaagcactttgggaggccgaggtgggaggactgttcattgaggccaggagtttgaggctgcagtgagctatgattgtgccactgcactccagcatggaaaaaagcaagatcctgtctcttaaaaaaataaaaataaaaattgggaggtcgaggcagaggtatcacttgaggccaagagtttgagacctgcctgagcaatacagtgagaccccatctccacaaaaaaacaaaagccacaaaaattagccaggcatgatggcacctgcctgtggtcccagctactcaggaggctgaggcaggaggatcattttgattccaggagttcaaggctgcagtgagctatgatcacgccactgcactccagccaggccaacacagtgagaccctgcctcaaaaaaaaaaagaaaggtaaagcttccagcttttacttttatatctgtctcccaggctagagtccagtggcaggatcacagctcactgcagcctcaacctcctgggctggagtgatcctctcacttcagcctcccaagtatctggaactgagtacagatgtgtgccacctcacccagtttattttacttttttttttttttttttgagacagagtcttgctctgtagctcaggctggagcacagtggcgcaatctcagctcactgcaacctctgcctctcaggttcaagtaattatcccacctcagcctcccgggtagctggcactatagctcctggctccagtttctacttctaatcctaccttggagcaaagaaagtaggagacgaggccggggacagtggctcccagcactttgggaggctgaggcaggtggatcactggaggtcagaagttcgagaccagcccgggtaacgtggcgaaacccaatctctactaaaaatataaaaattagtggccaggcatgctggctcacgcctgtaatcccagcacgttgcgaggccgaggcgagaagatcacatgaggccaggagttcgagagcagcctggccaacatggcaaaccctgtctctactaaaaatacaaaaatagtcccagccacttgggaggctgaggcaggagaatcatttgaacccaggaagtggaggttgtagtgagccgagatcctgtcactgcactccagcctaggcaacacagcgagactccgactcgggaaaaaaaaaattagctgggtgtggtggcaggcacctgtaatctcagctactggggaggctgaggcaggagaactgcttaaacctgggaggtggaggttgcagtgatccaagatcacgccactgctctccagcctgagcaacagggtaagacttaaaaaaaaaagagagacaaatacttgggcaggggacaggacaccagagtatgaaagactggaatgaaggggactgataacaggtaggcaaacaaagaagccacccaacctgtcagcagaagtactatatgagaacagctattgccttatgcctcagtttgtaaagagtatataaaagaaaaaattagccttcatctaagataattttaaagtgtctgttaccgaaccatttaagcctaaaatttttaggttctcatggcaacctaaatcatcgcactgcgcatattgtatataaagtgcatatttagaggcttaactagtaaactcaaaatgtgacatatgtgcaatgtgggcgacaacattattctgggaaccttaactttaaaatcttccacattttattctgcagccccaaagatgatataatagagtcaactatgcagaagatccaagttcaaggaagaagaggtacaaagaacataaatagaagcaaagacatgaaagacaagaagaaaattcaggctatcagaaaaaaattctgaacatggctctctcccactgtgaatcaacctgtaaaggaaggcttaaaaaacaagattgctactgaggacatatatcaagatagcgtttgggacatgctttaatgtgggcccagtcaaaagaggacatagtcacagatcagacagtttggtatatgtggcactgactccacggcagtctagagaggatgatgtttctctctttggtagcagcttatagaatatagctgtttagaattaagaagcggtatcagagacaaaaggatggctgtgagacatgaaaactgggagagaggaccagactttaagaagaggaaaaaggctgggtacagtggctcatacctgtaatcccagtactttcggaggccgaggcaggaagattgcttgagaccaggagtttaagaccagcctgggcaacacagggggaccctgtctctacaaaaatggaaaaaattagccaggcatggtggcatgtgcctgtagtgccagctacttgagaggttgaggcgggaggattgcttgagcccacgaggtcaaggctacagtgagccacaatcatgccattgcactccaagcctgggcgacaaaggaacaccctgtcttaaaacaaaaagcccggcgtggtagctcatgcctgtaatcccaacactttgggaggccgaggcggatggattccctgaggtcaggagtttgagaccagcctggccaatttggcgaaaccccgtctctactaaaaatacaaaaattacccaggcatggtggtagatgcctgtaatcccagctactcgggaagctgaggcacaagaatcacttgaacccgggaggtcgatgttacagtgagctgagatcgcaccactgcactccagcttgtcacagcaagactccgaatcaaaacaacaacaacaacaacaacaaaaaacaaaaaaaaacaaacaggccaggcgcggtggctcacgcctgtcaacccagcgctttgggaggccaaggtgggcagatcacacggttacaagatagagaccatcctggctaacatggtgaaaccccatctctactaaaaatacaaagcattagccgggcgtggtggcactcgcctatagtctcagctactctgggggctgaggtaggagaattgcttgaatctgggaggcagaggttgcagtgagccaagatcacaccactacactccagcctgggcaacagagcgagactccatctcaaacaaacaaacaaacaaacagtaagacccgaaatattatttttgaaccccaagctcacttttgtatagatatacctactctagaaacaatgacaaaagcattcgcaaaatgcaccacaaaaacacaaaacaatttgcctacttggcttctgattttgccttagaagtatttttgaggcctgttttgatattctttagctcaaaatcatctcctctcgttaagcacattgtaaagtactttaaactcaatatagcatttatcatcatctcttccctcccacttgttaaagaactagcttgttccaaatatggcattatcttttccaagttctagggtttaggcatgacataattcctttaaagaattatttttcttgtcatgactgacaagcatgacttaaatggagataaacaggctactgaaaaacatttgggaatttttctgattacaactgctcttatttttatttttttttttttgagacagagtctcgctctgtcgcccaggctggagtgcagtggcgcaatctcaactcactgcaaccttcgcctcccaggttcaagcgattctcctgcctcagctgcctgagtagctgggactacaggtacccaccaccaggcctaaataatttttgtattgttagtagagacgggtttcaccatgttggccaggctggtgtcaaactcctgacctcaggtgatccacctcggcctcccaaagtgctgggattacaggcgtgagccaccatgcccagtgtacaattgctcttttatgatgagagaaaaacaatgtatagctttaaaatggggaatccacataaaactatcttccctttgaactccagtacaggggcttttgccaattaaacaagtcacctccacctgaggaaagaggcagacgctgcctgcccaggatgctgtagaagggattccttccatggatagaaagtttctctgcataacttttgtaaaggtcctttgctaacctcagaaactgatttcactatgaaaagtagaggaaaggtgaatccaatgtgtgggtagaaacaacagaacagtgctgggaaaattcctgcttctatctctatgtgaatttaagtaaggcattccatgtccctcattttcaaaatgataggattaaagaagaaaaaaatctctgaagtttctagcattttcagcctatagcttactttttctccctcctatgccagcctgggccacccaccaccttcccactgctgcagcaccttaccataattaggcagctttttaaagcttctaattaacggaacacagaaattaaaacctttaaactttcttttctatttctggctcactgcaaatgtgcaacagcattttattaaggagttgttaatgccacacagttcttgctatactggcttttctctgaaccccagtgacagttacacagtgacaagttgtaagcaaagaggttgttaccatgggaacccactaggattcctgggggtggatccagaaggcttttttttttctatcacagtattttttttttttgatgttctggatctggcaattcagaaagctgatcttattatttcagcaagctaccttcaagaaatagtaccatacagtatacatttctgaagaaatattagaccaagcgcagtgactcacgcctgtaataccagcaatttgggaagctgaggcggggggatcacttgaggtcaggaattcaagactagcctggccaacatggtgaaaccccatttctactaaaaatacaaaaattggccgggtatagtggctcatgcctataatcccagcactttgggaggccaaggcaggcagattgcctgagctcaggagttcacgaccagcctgggcaacatggtgaaaccccctctctactaaaatacaaaaaattagccaggcatggcagtgtatgcctgtagtcccagctactcaggaggctgaggcaggagaactgcttaaactccggaaggcggaagtggcagtgagctgagatcgcaccaccgcactccagcctgggctacagagcgagactccatttcaaaaaataaataaatacatacatacatacatacataaattagctgagcatggtggcgggcacttgcaatcccagctacttgggaggctaaggcagaagcatcacttgaacctaagaggcaggggttacagtgagctgagattgctcaagtgcactccagcctgggcaatagagcgagactctcccccaaaaaaaaaaaaaaaaaaaaaaggaatatttataactattttagtgacactctgttgcacaatagttaaatatattcaactcttagtttttcccctccctcttcataaaagcagctacatcaatataaactcaactgaagtttctatgacctatgtatgctgctatttctttccagaccacaacataagttatatttagcattttttctttccttttttttttttttttttttttggacatagagtttcactcttgttgcccaggctgaagtacagtgacacaatctctgctcactgcaacctccgcctccttagttcaaactactctcctgcctcagcctccgaagtagctgagattacaggcgcctgccaccatgcccggctaatattttgtatttctagtagagatggggtttcaccacattggccaggctggtctcgaactcctgacctcaggtgatccacccgccttggcctcccaaagtgctgggattacaggcatgagccacggcgcctggccatatttagtattttttctatcaagatttcaatgttttccaaagttcaagaaatctcagcttctctacacaattatgttagaaatatatcagacacaaaattataaaaataaagctggccgggcgccatggctcatgcctgtaatcccagcactctgggaggccaaggcagacagatcacaaggtaaggagaccgagaccatcctggctaacatggtgaaaccctgtctctactaaaaacatacaaaaaattagccgggcgtggtggtgggcaactgtagtcccagctactcgggaggctgaggcaggagaatggtgtgaacccaggaggtggagcttgcagtatgcagagatcgcaccactgcactccagcctaggcgacagagcgagactccatctcaaaaataaataaaataaaataaaataagccaagagaagtataagttcaatctccaagtatgcctccaaaactgtagtgtgtagataaatgtgatgttaaattacgtttagggagatgaactgccactcccagctaaatgtgtgttgtcactcagttccctggagacccattctgttagaagatatcttaagaaaacagatcatttacaagtctgatctgtggatctgtttttttcagaagtggaacagtcagaattagaaaaaaaaaaatttttttccctaagttggaagctttctggaaaagggttaagtctttccatagatctagcttagccccagagcaaacttataccagacaaatgaacattaacaaaaacagcacttgatttcacagtaataatctagaacttcagctaccctacgcctgatccataatagtttgagccagaaaagtacctggcacaaatttcaagagtatccctcacactaataactactgaaacctaaatataaattccatttaaatgtgttgaaaaccaaactcagaaccaattcatacaacaaattcacaaaccaaaagaaaaaaaaaatggttctatggagataagatataccattaactaccgtaggcaatagttattaagatactccacaaacatattatgtcttgggctgggcgagatggctcacacctgtaatcccagcactttgggaggccgaggcaggcggatcagttgagttcaggagttcgagaccagcctgaccaacatggagaaactccgtctctactaaaaatagaaaattagccgggcatggtggggcatgcctgtaatcccagctactcaggaggctgaggcaggagaatcgcttgaacccggggaggtggaggttgcagtgagccaaggttgcaccactgcactccagcctgggcaacaagagcgaaaccccatctcaaaaaaaaaaaaaaaataaatcatgtcttgttttgctatatttactcacctaagctttcctgtagcatgcccacaagtttttttgtttttgtttttttcttgagatagggtcttgctctgtcgcccaggctgaagtgcagtggtgcaatctcggctcactgcaatctccacctcctgggttcaagcgagcctcctgcctcagcctcccaagtagctgggattacaggcgtgtgccaccgtgcccagctaattttttctgtttttagtacagacagggtttcactgtgttagccaggatggtcttgatctcctgaccttgtgatccgcccgcctcagcctcccaaggtgctgggattataggcatgagccactgcacccagcccaagagtttgtttttaaatagtttctggccagcatggtggctcaagcctgcaatcccagcactttgggaggctgaggcaggtgaatcacttgaggccaagagtttgagaccagcctagccaacatggcaaaatctcatctctactaaaaatagaaaaattagctgggcatggtgccaacggcctgtagtagctcttctggagactgaggcacgagaattacttgaacccgggaggcggaggttgcagtgagccaacattgcaccactgtactccatcgtgggcgacaaggcgagattgtcataaataaatagatagatagatagacagactgatagatagtttcccaatgctatctataacccaaattagctcagtaaagaggtttgcaaagctttttaaaaaactgcatttgtaggccgggtgtggtggctcatgcctgtaatctcagcactttgggaggccaaggtgagcagattacctgaggtcaggtggagttggaggtcagcctagccaacatggcgaaaacccgtcactactaaaaaaaatacaaaaattacctgggcgtggtggtgcacacctgtaatcccagctactcagaaggctgaggcagttacttgaacctgggaagcgggggctgcagagctgagaacacaccactgcactccagcctgcgtgacagagtgagactccatttcaaaaaataataataaaaaataaaaattgcacttgtaaatgtatgcagagactattaaacagaaatagcacgcaataaaaacaatgaatatataataaacataatgtctttccataattatttcccatcagcttgaaaggggaagtaggaaggacaagtccacagtatagttttggcacatgagtttaatatcaaacagcctagaaacaaaaaggagaaaacaggacatgacaggaggcaaactcttggatgctttattcatttttactagtggtttactatttccttgattttatttggaaaagcatgtcttggcccagaaaggcaagagtgcagactgccagcaatatcagattatccttttcttattctttggagctactgaaaactgagccaaaatcagagttgtctaggagccttctgactgttcaggcaataaaaattacgaagtttcaagatcagagctccacaaggtttttaccatacaaattttttttttttttttttttgggacagagtctcactctgtcgcccaggctagagtgcagtggcgccatcttggctcactgcagcctccacctcctggattcaagcaattctcctgcctcagcctcctgagtagctgagactataggcacacaccaccacattcaacaaatttctgttatttttagtagagacggggtttcaccatgttgtccaggatggtctcgatctcctgacctcgtgatccacccgactcagtctcccaatgtgctgggattacaggcgtgagccaccacaccaggcctacagtacaaaccttaaccataatgtcttttgatggaaagctgcttacattttttttccagataactccttggagcttttaaagtactccatcttcagaagacaatgacttaaattcacagaattaaaatgttaagtctttttcctattactaatccttaatactgaactgttccaaaacataaaattaaagtgccatttgactagacatggagtagtcaacaaataattaccagatatctactttatgcaaggccccagtacttatgtaacactatagactgtaaaatttcctctatgcacagcactgggtttagtacgatacacacaacacataaaggcataatcattttgttttcttttttttcttttctttttttttttttaaagaaaggtgtttcactttttcacccaggctggctggagtacattggcacaatgatagctttctgtaacctcctgggctcaaggagttgagtcctgcctcagcctcccaaatagctaggactacaggtgtgcaccaccatgcctggctaaataattttatttgtagagacagagtccctgtatttgcccaagctggtctcaaactcctggcctcaagcaatcctcttgcctcagcctcctaaagtgctggtaatgcaggcatgagctaccatgcctggcccataatattgtttagatatatttgcaatcatcatttgatctctgatatcaaataatatcttctagctttttctatcctacattatctatatatggaagacagaatcttgatgttggctgtgtaccaggttgtatataaatctccattttggctgggcgtggtggctcacgcctctaatcccagcactttgggaggcccaggcgggcagatcacgaggtcagtagatcaagaccatcctggccaacacggtgaaaccccgtctctactaaaaatacaaaaaattagccaggcatggtggtgggcacctgtactcccagctactcgggaggctgaggcaggagaatggcgtgaacccgggagacagagcttgcagtgagccgagatcgcgccactgcactccagcctgggcaaaagagcaagactccgtctcaaaaaaaaaaaaaaaaaaaatctccatttcaaaactagcttgtctctttttaattcctgctcattagtattacagggaatgtttacatttctctggaataaagtctttcaacctaacaaaccaaaatatcacaggaaaaaaacaaaatcacgttagaagcgctaaactgtctttctcagagcttccccctctcccttattaacatttctcaaagagaaaaacaccactgtgatgctcctctcacagatcattcatgaagttactgagctgggaccagagagactccatcaactgggcacacagccattcaccattaccctttgtttaaagtctcaacagccattcaacccacattattgtgttccactcaagcccatcaacatttttttaagaggaaacaatcaggaaactaaaacaaacgccacttaactagaaatgaagaaaagactgaatccatatgcctcacaaacaaaaattctctaaaactgatggctcactttaagtttcctatctgaaatagcagtattatttttaacaggctcatattcctaaaaaaattaaaaacaaataattataaaaaacttgttaaaaaaataaactcataatcttgatctggcaaagcattctaaacaccaaatgcaaatatatatactgaaggagtcaagacctccagcggccttttgcctggggctaaggagggtatgggggaaaaagcactcttcccaacagctgggtgtggtggctcaagcctgtaatcccggcactttgggaggccgatgcggacagaacacctgaggtcgggagttcgagaccagtcacggctaacatggtgaaaccctgtttctactaaaaatacaaaaaatcagccaggcatgaatggtggcacacacctgtaatcccagctactcttccaaagagccatgatccctgacaagatgattctaaatttcaaattttacaagtgctgtgcagagctctgtactaagtctaactcaaagttatttcggctgaaaataacagaaagcttacataaaaactagagttaactgaaagggtactagaccactccaagaactccaaacaggcccacacctggaaagtctttaggcatccagatttttgctctgcatgtggatggctgccctctctccagagctgcatttctcatctatgcttctttccagatgaaatctacttacttctccctccctacggaatgaccttcactgcttccacctgtacgagcctgaacttggctgcataccagcatctgattttatgtcctgagttctctgaatgtaggtgactatttgtatcttaaagacttgaatctcagttctaatctcaaattcctaggacaaagtgatttgcccagcttgggccaggtgtccacctctggtgcaataagatattacaagaggggctaaatcacaaggtataattagagtagggactatatgcctgaaccactcccctaaagtatatgcaatacactaagcagtaaggcagtttccatcctcaaaaagcttaaaatcttgctgaaataataaaatactaaatcaggtacaggaatgaatggacaggaaaagcctcatgaaaaagattagctgtgcactaaatgacaaatactgaatcatgagcatggaggggctgaagagcattcctaaacacgaaatgtgatgtctgctcctcttgctctagccatctaggaaatacagacctaagggataaataatcttttaccacataaacagcttccagtaaaatatccttgttgaaagcctgctataaaatgactttgaacacaaagcagtgctgcttcatcatgcagtaatcacccactagctgacaaatgtcaaacagttatgcattttcaagctgtcatcaccaccctgacttcctttcactcctcggcccccacgagactcttgctcagagagcactcaaaatcaggcaagcaggctgggcgcggtggctcacgcctgtaatcccagcactttggggaggccgaggtgggtggatcacgaggtcaggagttcaagaccaccctggccaagatggtgaaaccccgtctctactaaaaatacaaaaattacccgggcatggtggtgggcacctgtaatcacagctacttgggaggctgaggcagggagaatggcttgaaaccaggaggtggaggctgcagtgagccgagatcgcgccactggactccagcctgggcgacagagagagactccatctcaaacaacaacaacaacaacaacaaaacaaaaaacaggcaagcagccagtaaatggcacaggtgtttctcactgagaatatcccacccgatctagcatggtaagttagcagcagcaacacccagacagaattcatccaggaaagaaacactagctgagctatgtgactgcagtgtgagggaaagcggctggagctgaaaagtagaatgtttcccatacacaaaagctagaagtacaaagcaactggaaaaagcgtacagcaaattatctgtacaaaacagaaattaacaaaaacttaacagatgtccaaataatactgggttaaaaaagacaatctactcacagtagactattagtcacctcacattatcaccaatatcatacatattcacacagtctgcaagagcttactcaatctcacaggaaacaaaaaggtaaaagaacaaggagaaagtggtgacagtttctaacttaatgattattttgctaaagagtagcaatgttactatgaaaatggaaactacttggccaggtgtggaggctcacacttgtaatcccagcactttgggaggccaaggcgggtggatctcctgaggtcaggagtttgagaccagcctggccaacatggtgaaaccccgtctctacttaaaacacaaaattagctgggtgtggtggcgcatgcctataatcccagcaacttgggaggctgaggcaggagaatcgcttgaacccaggaggcagaggttgcagcgagccaagatctcaccactgtactccagagcctggtgacagggcgagactgtcaaagaaagaaagaaagaaagaaagaaagaaagaaagaaagaacgaaagaaagaacgaaagaaagaaagaacgaaagaaagaacgaaagaaagaacgaaagaaagaacgaaagaaagaaagaaagaaagaaagaaagaaagaaagaaagaaaatggaaactactgacccttcgaaattaaaagtataacagtacaaaattacacagcccaggaatcaaaaaacttcattttgcataatccccaaactaaagacattcccccccaaaacacagttttaatggagttataacttagaaagaaagtaaaattattcaactccattttgtcaaagctgaatgtagctataaaaagaagacctggaggtcataaagttagtggagagttctttctaaagccgtactgggctgggcgcggtggcgtgcgtctgtaatttcagcacttcgggaggccgaggcaggtggatcacctgaggtcaggagttcgagaccagcctagccaacatggtgaaaccccatctctactaaaaatacaaaaattagccaggcatgctggcaggtgcctataatcccagctactcgaggttgaggcagaagaatcgcttcaacccgggaggcgaaggctgcagtgagctgagatcgcaccactgcactccaccctgggcaacaagagtgaaactctgtctcaaataaataaagccgtatctgcacccatgaacatatctaaaagtggcacatcaaatttgattaagtgagatccattaggtatcaatgcaatcactaaaaaaacctcatcattcttgatactttctccatttttttttttttttttttttgagacagggtctccctgttgcccaggctggagtgtagtggcgtgatctcagttcactgcaaccttcacctcctgggttcaagccattcttgtgcctcagccacttgaggagctgggattacagacacgcaccaccacatctggctaagtcttgtattttcagtagagacagtgtttcaccatgttggccaggctggtctcaaacttctggcctcacgtgatccgcgtgtcttggcctcccaaagtgctgggattaaaggcgtgagccaccgtgctcagctttacaacatatcaacagggctggactgtgctcatctttagaaaatatcaacagggctgggtgcggcagctcacacctgtaatcccaacactttgggaggccaaggcaggaggatcacttgaggacaggtgttcaagactaggagagatcccgtctctacaaatactacaaaaattagccaggtgtagcagtgtgcacctgtagtcccagctactcggaaagctgaggctggaggatcgcttgagcccaagagttccaggctataattgcaccactgcactcaagtctgggcaacaaagagagatcctgtctctaatggaaaagaaggccagcatggtagctcatgcctgtaatcccagcactttgggaggccgaggcaggaggattgctagagaccagggggtcaagaccagcctgggaaacatagtgggaccccatctctacaaaaaataaaattagccaagcgtggtgttgcgcacctatagtcccggctacttgggaggctgaggtggggaagaatcacttgaggcctgggaggttgaggctacagtgagccacgataacgccactgcactccagcctgagtgacacaatgagaccttgtctcggaaaacaacagcccaaaaaagccccaaactttacaaatctggaacttaatgaagtgtaaaataaacaaatatgtactcatggcctccacagcacagcagaggttaaaaaataactatagaattctataaagaaacctctactttaagaagattctaagccaattctatgacaagaccaaagttattttacaaaggtctcatcaaggaaactgtcttcaaggcagtcatgatgttgccctcctgtaatcaatcccaactactcaggaggctgagacaggaggactgcttgagctcaagagtttgcaccagtttgggctacatagcggacccgtggacccctgtccccaccccgtctctaaaaaaaaaagaaagctgttttcggcaaataaggactcttgatacaatatagtttacaaagcaaatagctaaaactgattaagtcttaaatctgcattacaactctaaatattagagccctcctccccgcctcaacttgtcacttgaaactacgaagagacccaagtgtcccctattacaaatccaaaatattcatttataattttcagttttctttgaacacagaagcctcctaacagtagactctcaaagtagaaatagtgaatatgaaatctaggaaaccatattacccaagtattccacaaggaacaacgtcctgtttagcacagcatttcagacacacaaatcttatcccttaagccacaacagacacaagaaaatgcaaaacaaaatgcactcataaaagggaacaaaaggaacactgacatagtagctactgctcatctatgtatggcactcctaggcagttcacctgtgttatttatttcatttggctgaaatgcattactgacccaagagactagtggtatgcccattttacacatggaaaaagaaacagcattatcaatactgtatcaggcactgttcagtgcctagcataagttacctcaattaatcctcacattactattctgagttggtatctccactttaaagacaggaaaacagggccagaaatgttaactggtggtaccccaaatccactgtcccaagctgtcacagctatccttaccaggctgtgtttataaagcccattcaagtcacatcattctttcaaaccatttcaaggattccacaatcaaaaaatcaactctcaattacagaaagacttaattctccagattttcatcaaaattttcttatttctattttatttgccttttgaccatttcagtgtactgtaattctagtatacgtgttctggtaactataggattatattaatagcaatcaactttgggaggctgaggcgggcagttcacctgaggtcaggagtttgagaccagcctgaccaacatggagaaaccccatctctactaaaaatacaaaattagccaggtatggtggcacatgcctataatcccagctactcggaaggctgaggaaggaaaatcacttgagcccaggaggtggaggttgcagtgagctgagatggtgccactgcactccagcctgggtaacaacagtgacactcactctcaaaaaaataaaaataaaaaaatcaagaatcaaagaataggccagacatggtggctcatgcctgtaatcacaacactttgggaggcccagacaggcggataacttgagatcaggagttcaagatcagcctggccaagcctggccaacatggcgaaaccccatctctaataaaaatacaaaaattaagaccgggtggagtggttcatgcctgtaatcccagcactttgggaagccgaggtgggcggatcacctgaggtcgggaattcgagaccagcctgaccaacatgaagaaaccccatctctactaaaaatacaaaaattagccgggcatggtggcgggcacctataatcccagctgcttgagaggctgaggcacgagaattgcttgaacccctcccagcagaggttgcagtgagccgagattgaaccactgtacgctagcctgggcgacagagcgggactctgtctcaaaagaacaaataaatactgaccttcattcagaaccataaagtctccaatactcattattaagaggttaataacaagagttattaagaggttattaagaggttaataaggaacatattgttaataacaaggagcattaagaggttaataacaaggagtgaatctgaagtcttacagcataaagtttgcctagctgccagagaccttatttctatttcttctttttttagtagaaaagttttacaaaatttgtaggaaaatacaataatttttgtattttttgtagagatgaggtctagctatgttgcccaggctggtctcaagctcctgagctcaagcaatctgcccgcctcagtcttccaaagtgctgggattacaggcatgcaccaccatgcccagcccctctctctcatatgtatacgtgtgtgtgtgtgtgtctgcgtgtgtgtgtgtgtgtgtgtgtgtgtgtgtgtgtgtatatatatatttttttttttttgagatggagtctcccactctcacccaggctggagtgcagtggtgccatctcagctcactgcaagctccgcctcccgggttcacgccattctcctgcctcagcctcccaagtagctgcgactacaggtgcctgccaccatgcccagctaattttttgtatttttagtagagacggggtttcaccgtgttagccaggatggtctcgatctcctgaccttgtgatctgcctgcctcggcctccctacatctttttaagggagaaaaataggagaaaggcctttcatgcaattgacagatactctcagtatctttttttttttttttttgggcgggggccgggggcgggggcgggggagggaatggagttttgctcttgtagcccaggctggagtgcagtggcttgatcttggctcactgcaacctctgtctccctagttcaagcgattctcctgcctcagcctcctaagtagctgggattacaggcatgcgccaccacacctggctaattgtgtatttttggcagagacggggtttctcagatgatccgcccaccctggcctcccaaagtgctgggattacaggtatgagccaccacgccgggccaactttcttcacactagaacaaactgagagacctatgagtatctttgaaatgttcatacctgaaagtattattctaactaggccattaatgacagatttacaaatttatctgtgcacaacataagatacctagaaattggtccacctaagaaagccattcatatattataggtataaagcaaaggcaggaacttgtcaattcttatcctcttcatgtgatactttttcagcacacattttttgaaaacgctgtgccaggcacagtggctcacacctgtaattgcagaactttgggaggctgaggtgggtgaatcacctgaggtcaggagttcaagaccagcttgaccaacctggagaaacctccgtctctactaaaaatacaaaaaattagctgggggtcatggcatatgcctgtaatcccagctatttgggaggctgaggcaggagaatcacttgaacccgggaggcagaggttgtggtgagccaagatcatgccattactttagtctgggcaacaaaagcgaaactccacctcaaaaaaaaaaaaaaaaaaaaaaaaaaaagaaagaaagaaaatgctgtatattcaaagataggaaaatctgactagattagaaatttaaaatgctataaacagtgatttggattatcgttatagaccactttatacatgctgacatatttgtattttcaagaagtttgaatatgtcagtggacgtctctctgtgattggcaatccatatgaagagcatgaattgtaatcaattgaacctttatagaactccaagagaggagaagatagcaaaataaaggagacattcctgacctcaagaagtaaaggaacacagccataaaaggaaattagggctgggcacggtggttcatgcccgtaatcccagcactttgggaggccgaggcgggcagatcacctgaggtcaggagtttgagaccagcctggccaaaatggtgaaaccccatctctactaaaaatacaaaattagccaggctaggtggctcatgcctgtagtcccagctactcaggaggctgaggcagcttgaacccgggaggcggaggttacagtgagccgagatcgcgccactgcactccagtctaggcgacaagagcgaaactccatctcaaaaaaaaaaaaaagaaaaaaaaaaggaaattaggtcctgatacatgctacaaaatgatgcagggaccctgaaaacaacacgctaagtgaaataagccagacacaaaaagccaagtattacatgattccagttacatgaaatatctagaataagaaaattcacagaaacaaagatagattagaggctaccagaggctggggggaggggaaaattgagagttattgcttaatggttacagaggttctgtatgcggtgatgaaaacattttggaaagatcacagtgatgattgcacaacacctcaatgtaactaatgtcactgaattatacacttaaaaatggttaaaacgggccgggcacggtggctcaagcctgtaatcccaacactttgggaggctgaggcaggtggatcacgaggtctggagttcaagaccagcctggccaagatggtgaaaccccgtctctactaaaaatacaaaaattagccaggcacagtggcaggaacctgtaatcccagctactcgggaggctgaggtaggagaatcgcttgaaccagggcgacagagattgcagtgagccaagatcgagtcactgcactctaggctgggtgacagagtgagactccgtctcaaaaaaaaaggttaaaacaacctaaatgtaagacctaaaactataaaactcctagaagaaaatatagaggaaaaacttcatgatattggatttgacaatgatttcatggatatgacaccaagtgcgcaggcaacaaaaccagaaataaacaaatgggactatatcgaacatgaaatattttgtgtatcaaagcatacaatcgacaaagtgaaagacaaattacagaatgggagaaaatatctgcaaatcatctatctaataaggggttaatatccagaaaatagaggctgggtgcggtggctcacatctgtaatcccagtactttgggaggtcgaggcgggcggatcacctgaggttgggagttcgagaccagcctggccaacatggtgaaactccctctctactaaaaatacaaaaattagccgggcgtggtagcgcatgactgtagtcccagctactcaggaggccaaggcaggagaatggcttgaacccagtgggcggaagttgcagtgagcagagatcacaccactgcactccagcctgggcaacagagcaagactccatctcaaaaaaaaaaaaaaaaaaaatccagaaaatataaagaacttctataattcaacaatacaaaatcaaaaaacttgattaaaaactgggaaatggccttgaacagacatttctccaaagataatatataaatggccaacaagcatatgaaaagatgctcaacatcactagtcagcagagaaatacaaatcaaaactaccacagtgaggtatctcacacccattaagatggccatgaaaaaataaaaagtattgtcaaggatgtagagaaactggaacccttgtgtactactggcaagactgtaaaatggtgcaactgctatagaaaaaagtataggggttcttcaaaaaacaaacaaacaaataaaaaaacactattccagtggcctagattctttcaaaataataaaaattaaaaacagaattatcacttgatccagcaatcccactttggggtatatatccaaaacaactgatattgttccagaggctggaatacctatttgcacacctagtcacattagcactattcacaatagccaagaggtagctgcaacccaaaagtccattagtggatgcagtccataaacaatatgatatatatatatacacaatggagtattagccttaaaaaggaaataaatccggtcacacagtacaacatggatgagtcttgaggacattacactaagtgaaataagtctgtcacaaaaaacagacatggtatgattccacttacatgatgttatctaaagtagtcaaattggtagaaacagaaataatggtggttaccaggggctagtaggagggggaaaaggggagctgttgtccaacaggcatagagtttcagatacgcaagatgaaaaactcacagatctgttttccaacagtgcgaatgtacttaatgtcacagaacacttaaaaatggctaagttagtaaatgttgtgggttttttttgttttttttttttctgagacagagtcttgccttgttgcccaggctggagtgcagtggtgcaatctcagctcactgcaacctccacctcctgggctcaagggattctcctgcctcagcctcccaagtagctgggactacaggcacatgccaccacacctggttaatttctgtatttttagtggagatggggtttgaccatattggccaggctggtctcgaactcctgacctcgtgatccgcccacctcagcctcccaaagtgctgggattacaggtgtgagccactgcgcccagccaattttgtgtttttaaccacaattttaaaatgtaggccaggctcagtggctcacatctgtaatccgaagttcaaaaccagcctgggcaaaacagtgacaccctgtctctacaaaaacaaacaaacaaaaaaaaacaccgggtacggtggcttacacctataatcctagtactttgggaggctgaggtgggcagatcacctgaggtcaggagttctagatcggcctggccaacatggtgaaaccccatctctactaaaaatacaaaaaccctctgggcgcagtggtgggcgcctgtaatcacagctactcgggaggctgaggcaggagaactgcttgagcccgggggacagggtgtgcagtgagcactccagtatggttgacagagcaagactccatggcggggttgggggggaccggacccacatcacaaaactgtgactaagataagcctattttgggaagataggcatttctatagcatatgaaaaggatgggcaagataaagacccaatatttaacaatcatctctgagtggtggcactatgggtgagtttcttcattttttgacttacctgttttttttttatagtgaatctgtaacttctgtattaagaaaaatacacggaagtctttagaaaaaaatcattttggctaaaaacttcactgtctgcctattacatcatgggtatttcaccatgttactgaagctgaactaataccatgtgagacagatgctgtttctttcattttgcaggtgcgaataaactgaggagcagaacagttgagtgacttgccaaggttgtgtaaccagtaaatgacagagcaagcattacaatccaggcctagttctaacttcaattcagggtcctttcccatttcattacacctcaaagggaagattgcattattactcgtgatattgtttaaaaaaaaaaaaaacataaccttgggcaagtaagtcacttaatttctagggccctcagtttcctcatccaaaaagtgaaggggttctagaaaagatattccatctctaacagcccctcttgctaccagatcttaagtctagatagcacaatctctaaagaaaaccctgggttttctttaaaggggtcagaatgaatggttgaatagaagttgaggcctgtgatctgggccaaaggccattcttaatggaaacaggtggtggactgtcatgaggaaagaaccactaggggaaccataaccttcctggttaaagcaacaactgaaagctccagctttgctttaccaacagtgctgcttcaatcttggctaactcatgatcagaaaccacatactaggtaagtaaagcctgaagaatataaaaattaacatgagaagaaaatcactgtagcaacagtttgtgcatgctattgtaattccatgattttctaagtggactctttaatgctaaaacagaaagggtgattctatattgagacgccttcattctcaccaaggattaatagagaggctgaaacttccaaagcgcttggagagaagctacacttgtgggcaaggggaaagcatccaattaaagccttcccaattcatgggtaatcaaagacagtgaaaagaactttaaaaggtgaagttccgggcgggggcggtggctcacgcctgtaatccccagcactctgggaggtcgaggcgggtggatcacccgaggtcaggagttcgagaccatccagcctgatcaacatggtgaaaccccgtctatactaaaaatacgaaaattagccaggcctggtggcacatgcctgtaatcccagctacttgggaggctgaggcaggagaattgcttgaacctggggaggttgcagtgagccgagatagcgccactgcactccagcctaagcaacaagagcgaaactccgtcttaaaaaaaaaaaaaaaaaagatgaagttcttgtaaaagattcattatttgtaacctcttacactgcacacattataaagcatttcatgctctttaaaactgttatacagcctttttactcgaaggtaataaacctacagctctctcctggcgagaaagagattccattttgcggaaacagattccagtcaaaatcttaccacattcccctcaactatgggtatgagcctaaaccaatgagaagctccttggtgcatgtgtaatggtctccaagaattacaacaacatcctacccggaggaccacaaccacgacaccactggctttaaaatcaaagcctggtccctagcgaagaaagcgctttaatgtgctcctcccgctcccgggtgcgagattcctgcccagctactaggccacgactgggtgagcacctgatgtggggggagggcgagccaaggccgtagcggatctggggcgaggaacgaggggctctcgaggctcgggaaaagcgctgccttctaggggcgcggacccttcggcacccacaggagtggacactaagaacacgtgagacgacaggggcagagatggggtgtcccgggcaggtagcctgggtccagcacggcagccagaaagacgaggaaaacggagctggccctgggcagggcacgaggcctctgagcctagagagtgaaggtaaagggcgcggggagaggaagcaaagccacgaggagggcgggtctccctgggcgcgggggcacgcgctgggcaaacgcgacaggacccggggagccggggaccccgacatgcaggaggagatcgcagccctaccccaggacgcagggaacgagaaaaggccgcgcccggagggccctgtgacccgcggcctccctaaccggacccgccccgcggcgcctccctcttgccttttttcccctccctccctcccgcggcccgttatcctgcggccgcagcactcaccagcggctgcacctgagcctgccgctgcctcagttgctgcctgcgcctccgcagccgccgccgccgcctcgctgctgaggccgaatcccgggggagcctccgcgtcccgccgccgctgccgctgccgccagagcagaacaccccaaaatggcggcacttccggcacctaccaccggcggggagggcagaggaggagggggagcgcggcgagggggaacgtatcaccgcggcgccgcccgcagcgccgatgcgagcggagcgcggcgtaggggcgggccgagcgccgggcgctgcagcgccccctcgggctgggaagtggaggagcagccgcacctaagcccctggggccgcgggcggagccctcaacctagggagctgcaggggcgcatctctttgtctccgatccctactggagggaagagccaggcctgggaatctgaagttctcgactccgcccatcgcacccacaggagctctagatgaccctggtgggcaaggaggcacccctactgggcactgaataggagcataataagatatttgttgaataaatggatgagtgagtgactggtgcttggccagcgttgggcacatggcacgcccctttttgccccagcagacaagcaacagcatccaggccttccttctttgctgggatgtgaatatgtgtgttccaagtgcagggagtgctttttagcaagataatcagtgtgaacgcacaacctggcaacgatcgctgcgacataaggaagttcacaaagattctattaagagaccgattgcccagccataacctgcttttaccgaaaaaaaaatatatatatatatttttttttcttaactcaggttaggtctctaaagacttcctcctgagttactctggaatccctgggtctagatggaacgcaagcagtacaatttgttgttgttgttgttgttgtttaagccaacatttattcctaggttccagaccttgtgaggcagttaaatgcagattaagaaagaaaactttgttctggaagcttttggccccatcaacatgcaaataactcatgggatggtttctctctaacatcatctggcttcccagagaatataatttttatacccacaaatactgattatatcctaccttaccacaaacaacaagtgggcttccaagcagaagcctcaagggttttcctctttcgcctttgggggggaaaaaaactaaccagagtttttctggtaccatatagtccttaaattgtacatgatcatattccctaattgtactgggtagttttatatacattcataatgctgatatatgatcttgttcttgttaatagttttatgtgtagttgactgaaaacatcctatatttatagaccattatagcttacagaatgttgtcacaaatattaccatatatttgctgctataggttgtagaaatgtttcaagcagagagtctgtctccttttgtgctccatagaatcatgtggatatccacatggctcacttcctcacctccttcagactttgacttaagtgtcaccttctcagtccagtcttccctaagcactctattttacactgcttgcatgcatggcatgtgcacacacacacacacccatgctttcaatcccactttcatttttatccaaaacatttatcattatctaacacagtttttttttttttttgagacggagtctagctcttgtcacccaggctggagtgcagtggcgcgatctcggctcactgcaacctccacctcccaggttcaagcaattctcctgcctcagcctcccgagtagctgggattacaggcgcgtgccacgatgcctgactaatttttgtatttttagtggagacggggtttcaacccctgttggtcaggctggtctcaaactcctgactgcaagtgttctgcccgcctctgcctctcaaagtgctgggattacaggcgtgagccactgcacccggcctcacagtatattttgtatttatatattttacttgttttattgacagtagcccagaaggtaaaccaaaggtaaacttcatgaggatagaggttttgtctgttttatttcactgctctatcctcagggccttgataatgcctaatccatagtacatgctcaataaatattgttgacttactgaataggtatatctaggtgccagatatggaaaacaaaatgttgcgcctttagaagcttcttggaacctgcccatgagctaaataaggaaaggcaccatgcccgtcttattatatctccagtgcttttcacaatatctgactcaatagatatttcttgaagagcaaacagaaactcttccatgcccatcttgttattctcctaatatctccattgcttttcactgtatctaactcgataaacttcttgaagagcaaccagaagctttttcctattctatctgtgccttgacttagggctcccatttgcaagggaggaacttgtaaggtattaatatcactcttgcatttagttaccaaggaaggccacagactgttagcccaaggttggggggaagaacaattacatgaagaacacaaatagatcttgtaacttcaaagggtttcagcaacatagacaaaatgctaaacagtccaaatacaaaaaaagcctagtgtgagatttaagagtatgtaaagcttcctgtttcatgttttgccttacaaatagattaagatttattttttttaaaaaatagccaatgtcggccaggcgcggtagctcatgcctgtaatcctagcactttgggaggccgaggcagatggatcacctgaggtcaggagttcaagaccaacctggtgaaaccctgtttctactaaaaaatacaaacgttagccaggcatgatggcgggtgcctgtaatcccagctactcgggaggctgagatggcagaatagcttgaacttgggagacggtggttgcagtgagtcgagatcgaaccactgcactccagcctgggcgacacagcaagactctgtctcaaaaaaaaaaaaaaaaaaaagccagtgttagtaagagtgcagagaaatagccttctccaagtggtgatgggagtaaagttcagataatctgcctagaggaatctaaacttttacatacctttctaggaatttatcctaagggaatattcatggataatggcagagattgtaacattttttatttttttaattttacttttctagacacagggtcttgctctgtcacccagcctggagtgtagtagtgctatcatagttcacagcaaccttgaactcctgggttcatgagatccttccaccagaaccttgtgagtagctgagatcacaggtgtgtgccaccatgtccaactaattttttttcttttgtagagacaggggtctcactatgttgcccaggctgatctcaaactcctgagctcaagcaaccctccccactcggccttccgaagttttgggattacaggtgcgagccatgacacctgaccataacattgtttaaacagcataaaatttgatacaaaatgagattgataaattatggttcattcatagccatataataatagataaatatagaggaaatgatgatagccaggcatgatggcatactcccataatcccagctaccctggaggccaaggcaggaggactgtttgaggccaggaattcaaaaccagcccaggcaacataacaagacaccatctccatataaataaaaaatttaaaaatgttagcctggcatggtggcatgtacatctgcagttccaactacttaagaagctgaggtaggaggatcccttcagcccaggagttccaggttgcagtgagctatgatcacgacactgcactccagcctaggcatcagagtaagaccctgtctctatttggttatttatttatttatttattatttattttgagacggagtcttgctctgttgcccatgctggagtacagtggcaccatcttggctcactgcaatgtctgcctctcagattcaagcgattctgctgcctcagcctcctgagtagctgggattacaggtgcacaccaccacgcccagctaatttttgtatttttagtagagtcggggtttccccatgttggtcaggttggccttgaactccttacctcaagtgatccgcccgcctcagcctcgcaaagtgccgggagccaccacgcccggcctatttacttttctttcttggttttgtttgttttgttttgttttttttttgaggcagagtctggctctgtggcccaggctggagtccagtggcacaatctcagctcactgcaacctccccctcccgggttcaagcgattctcctgcctcagcctcccgggtagctgggactacaggcacatgccaccacatccggctaattttttgtatttttagtagagacgggtttcaccgtgttagccagggtactctcgatctcctgacctcatgatccacccgccttggcctcccaaagtgcttcaattacaggggtgagccatcacgcccggcctatttttcttttttttttgagacggagtctcgctccgttgcccaggctggagtgcagtgacttttcacaggcatgattccactacagatcagcatgggagttttgacctgtttcttttccagcctgagccggttcaccactccttaggcaacctggtggtcccccactctctggaggtcacgatgttgatgcagaacttagtgcagacacctgattgacatactgcactatagcccagaacttctggactcaagtgatccccctgcctcagcctccagagtagttgggacttacaggcacatgccacctcgccctgcccttgtctctaaaagaaaaaaagaaaactctttttttttgagatggagttttgctcttgttgcccaggctggagtgcaatgatgcaatatcggctcactacaacctccgcctcctgggttcaagagattctcctgcctcatcctcccgagtaactggaattacctgtacctgccagcatgcccaactaattttttgtatttttagtagagacagggtttcaccatgttggccagactggtcttgaactcctaacctcaggtgatctgcccgcctcagcctccgaaagtgttgggattataggcgtgagccaccgcgcatggccggaaagaaaactcttaaggcctggttacattcaggcggtgctgcgagcgtcacactgcatcacatctggaggcctatagcctatgatgtcaagttgtctgtcctgcttttactgacacagactcatcagtggttgaggtggcccgagcctgatccctctatggtcaaatttcctatgagtgttttatatatataatcagaaaatctgcattttggtaaaataatggatctagtcaatagccatcaatggataaaagcattagatgaaaccctcatatatatattatatatatatataatatattagatgaaaccctcatatatatattatatatttaatatattatattatataaataatatatgtatatgtatatatttatatatttatattatatatatttatatataatatataaatatatatatatatttatattatatatgtataaaatatgtgcaatataatatataatataatgtgtaatatattagatataatatattacataatataatatgtaatatattatatataatatatgtcataatatataatattatgacatatattatatataattgtatatataatatatataatatatataattgtatatataatatatatataatatatattgcagccaataatatatatattgcagccaatatatattgcagccaataatatatatatacaatataatataatgtatatataatatataattgtagtcccagctacaatatataacacataatatattgtatataatgcggtatgtaatatattacatataatatgtaatatattatatatgttatatatagtaatatatgttatacataatatatgttatatataatatataatatgttacatataataatataatatgttatatataataatataatatataataatataatatatattatatatgtattttttgagacggagtcttgctctgtctcccaggctggagtgcagtggcgcaatctcagctcaccacaacctccgtctcccggattcaagcaattctcctacctcagcctcctgagtagctgggactacaggcacgcagactacagatggggtttcaccatgttggccaggatggtttccatctccagatcttgtgatctgcccgcctcaggcttccaaagtgctgggattataggcatgagccacttcgcctggccttttttttttttgtgagacaaggtctcactctgtggccaggctggaatgcagtggcacagcttgctcactttagccttgatttcttaggctcaggtgatcctaccatctcagcctcccaagtagctgggactacaggcacgtgccaccatgcccaggtaattttttatagagctggggtctcactctgttgcccaggctgatcttaaactcctgggctcaagcgatcatcccacctcaggtagatgtgaaccatggcacccggcctatgtaactttttgaaaagaataaagtaaatctacctctattgcaccgacaatataatattcacagatatcactgagtgaaaaaagcagaggccgggcgcagtggcccatgcctgtaatcctagcactttgggaggctgcggcgggcagatcacctgaggtcaggagttcgagaccagcctggccaacgtggtgaaaccccatctctactaaaaatataaaaattagccaggcattttggtgcatgcctataatcccagctgctcaggaggctgagccaggagaatcgcttgaacccaagaggcagaagttgcagtgaggagagatcatgccactgtattccacccttggtgacagagcaagactctatctcaaaaaaaaaaaaaaaaagccagacgttgtggctcacacttgtaatcccagcactttgggaggctgagtcaggcagattgctagagctcaggagttcaagagcagcctgggcaacatggcaaaaccccatctgtacaaacattagctgggcgtggtggtgcacgcctgtaatcccagctactggggaggctgaggtgggaggatcacttgagcctgggaggtcaaggctgcactgagccaagatcacaccactgctctcagcctgggtgatgggagtgagaccgtctcaataaaaaaaagaacagaaaaggccagaggcatgagaatcgcctgaacccaggaggtggaggttttagtgagtggaggatgcgccactgcactccagcctgggtgacagagtgagactgtctcaaaaacaaaaaacaaaacatttcatctatatggttataatgatctttatcaatatgtgtacatgaatatacaaagaccacatgttgtatgaatccatgtatatgaaatgtttggaataggcagatccactgagacagaaagtcgattcgtggttgtcagggaatgagggaatggggagtgattgctaatgggtataggatttctttttgggatgatgaaatgctctaaaattagatattggtgatagttgtgcaaccctgtgagtatattaacaaacactgaattgtatagttaggagggtgacaaggcatatgcattatacctcaataaagctgttcccaaaaataatgttaacattggaggggggtgggcataatggactctcagtactatttttaaaacctttctgtgcatctaaattattccacatttaaaagtttattctggctgggcgcagtggctcacgcctgtaagcccagcactttgggagtccgaggcggacagatcacgaggtcaggagatcgagaccatcctggctaatatggtgaaaccccgtctctactaaaaatacaaaaaattagccgggcgtggtggtgggcgcctgtagtcccagctacttgagaggcagaggcaggagaatggcatgagcccgggaggcagagcttgtattgagtggagatcatgccactgcactctagcctgggcaacagagtgagactctgtctcaaaaaaaaaaaaaaaaagtgtatttcgctgggtgaggtggctcaggcctgtaatcccagcattttgggaggccgagacaggtggatcacgaggtcaggagattgagaccatcctggctaacacggagaaacccatctctactaaaaatacaaaaaataagccgggtgtggtagcgggcgcctgtagtcccagctacttgggaggctgaggcaggagaatggcatgaacccaggaggcggagcttgcagtgagccgagatcgcaccactgcactccagcctgggcgacagaacgagactccgtctcaaaaaaaaaaaaaaaaaaaaaaagtttattccacaaagagacaccacacccactaaaatggctataatgaaagacagataataagtgttggcaaccatgtggcaacattggaaccctccatactctcctggtggggatgcaaaaaggtgcagtccactttggaaaactgacagttcttcaaaaggttaaacactgtactaccctatgacctaacaattccatgattagtcaaatatacaagagaaatgaaaacctatgtccgtaagttgtatgcaaatgttcccagcagcattgttcaaaatagccaaaagtggaaacaactcaaatgttcataaactgataaatggagaaaaacatgtggtctgtccatacattgaaatattatttggcaataaaaagaaggacagtcctgatacttgctacaacatggacgaaccttgaaaacattctaagcataagacaggtatcaacacacaagtgatatctattaagaaaaaaaaaaagctgggcgcagtggctcacacctgtaatcccagcactttgggaggccgaggcaggctgatcacctgaggtcgggagttcgagaccaggctaaccaacatggagaaaccccgtctctactaaaaatacaaaattagccaggagtggtggtgcatacctgtaatcccagatactagggaggctgaggcaggagaattgcttgaacctgagaggcggaggttgtggtgagctgagattgtgccattgcactccagcctgggtaacaagagcgaaactccatctcaaaaaaaaaaaaaaaaaagttgggtggggtggctcacacctgtaatgccagcacttagagaggctgaggcaggcagatcgcttgagtccaggagttcgagaccaacctgggcaatatggtgaaagcctgtctctaccaaaaatacaaaaattcgccaccaggtgtggtggtacgcacctgtggtcccagctactcaggaggctgaggtgggagaattgcttgagcccaggaggtagaggttgcagtgagctaagatcacaccattgcactccagcctgggcaacaggagtgaaactctatctcaaaaaaaaaaaaaaaaaaaagcagccagatacaaagaacacatattgtatgactccatttatttgaaataccctaggctggatgcagtggttcagacctgtaatcccagtactttgggaggccaaatcaggaggattgtttgagcccaggagttccagatcagtttttttttgttttgttttgttttttttttgatatggagtctcactctgtcacccaggctgaagtgcagtggcgcgatcttggcttatcacaaactccgcctcctgggttcaagtgattctcctgcctcagcctcccaagtagctgggattacaggcgcccactattatacctggctaatttttgtatttttttagtagagacggggtttcaccatgttggccaggctggtctcaaactcctgacctcaggtgatctgcctgcctctgcctccgcctcccaaagtgctgggattacaggtgtgagccactgtgcccagtcccgagatcagtttgggcaacatagtgagaccccatcgctacaaataataaaaaattagccaggtatcgtggcacacgtctgtagtctcaactccttgggaggctgaggtaggaggactgcttgcacccaaaaggtcggggctacagtgagtcatgatcacgctgccactgcactctagcctgggtgacagtgagaccctgtttcctagaaaaaaaaaaaagaaaagtaaaaagaagaaatgccctcaacatgctaaacatgtaaatctatacagtcagaaagcaggttagtagtgtttgcctaaggctggaggatgattgggagaaaatggtgagtctctgctaattcataaggggcttattttgagggcaatgaaaatattctaaaattaggctgggtgcggtggctcatgcctgtaatcccagcactttgggagaccaaggcgggtggaacacctgaggtcaggagttcaagagcagcccggccaacatggtgaaaccccatctctattaaaaacacacacaaaattagccaggcatggtggcgggcacctgtagttctagctactggggaggatgaggcaggagaactgcttgaacccgggaggtggaggttgcagtgagtggagatggcgccactacacttcagcctagtcaatagaaggagactccgtctcaaaaacaaaatataaaaaaaagaaaatgaatcttttaaaaccaccagatgggccgggcatggtggcttatgcctgtaatcccggcactttggaaggccgagggggacggatctcctcaggtcaggactttgagaccagtctggccaacatggtgaaaccctgtctctactaaaaatacaaaacttagctgggcgtggtggcagctactcgggaggctgaggcaggagaattgcttgaacctgggaggcagaggttgcagtgagctgagatcacgccattgcactccagcttgggtgacaagagtgaaactctatcttaaaaacaaacaaacaaacaaaatctccaccagatgcttgggccgggcgtgtggctcatgcctgtaatcccaacactttgggaggctgaggctggcagatcaccataggtcaggagttcaagactagcctggccaacatggtgaaaccccatctctactaaaaatacaaaaaaaaaaaaaaaaaaaaaaagaaagccgggcgcggtggctcatgcctgtaatcctggcactttgggaggccagggggatggatcacctgaggtcaggagtttgagaccagcctggtcaacatgttgaagccatctcactaaaaatacaaaacttagctgggcgtggtgacatgtacctgtaatcccagctactcgggaggctgaggcaggagaattgcttgaacctgggaggcagaggttgcagtgtgctgagatcacgccattgcactgcagcttgggtgacaatagtgaaactctgtctcaaaaacaaaaaacaaaaaacaaaaactccaccagatgcttgggccgggtgcagtggctcatgcctgtaatgccagcactttgggaggctgaggtgggcggatcaccttaggttcgagaccagcctggctgacaaggtgaaacctcgtctctactaaaaacaaaagttagctgggtgtggtggcatgcacctgtaatcccagctactcaggaggctgaggcaggagaatcgtttgaacccgggaggcggaggttgcagtgagctgagatcttgcgactgccctctagcctgggcaacagagtgagactccgtctcaaaacaaacaaacaaaaagtaaatagctggcattacaaccattcttcttacctttttgtaggttgcaggttttatatttgagctcttcataatatttttcttaaggatatattaatataatgtatattttcctattttttcctgctatgtaaacactgctgtttggtcagatgaaggagggagccctgccctaggacaggggaggggaggaggaaggcgacctcaacccaggacccctgttcaccctgggatcaggccctcacccaggtagctcctctgtttgaaagctctaagcccttccactgtcctcttcagggctaccccgccacacagcctctccttgtcttgtcttccctttggcggggtcacacccgcacctgggtcactgcccccttcctctggtcgagggttggggggagtgtcccctcctccctcggccggagtcacagttccacacgcaggggtccttcctgcccctctcacctggggtcacaacccccctccctcggaggagggaggtcaccggccacaggcgggggcctcagtttcccacgctacagggctcacacgtgtctggcctgcgacgcgctctcccttcgccggggtcccagtttcccgcccaggaaacctcggtccctcctccgaggccgccgggccctcctccagagtcccgccagtcccccagagtccaggccagtccccgccgtcacccggtgcgagcccgcgagaggcctagtgcagctggcagccccgccccggcacccgcctgctcttctcgcgggtccggaccgcgagcgcgggggccgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccaggtgagccgggccggggagcccgggcccctgccccgtccccgccgctccgtccctgtcgggccgctggggtctccaccgtctttgctgagccacctctttgcctcggcagctggtacaggacgagaacgtgcgcggggtgatcaccatgaacgaggagtacgagacgaggttcctgtgcaactcttcacaggtgagggaccgggccgaggggcaggctcgggggcccgctccccctcgcccaccgccctgagcctgggacggctagagaagtgtgggggaggtcaccatgcaccggagccaggtgtctcaagctgctttgcctccggtctgtgcctctaaatggcacctggaggtaggctagaagctgtgaaaggcgtttatttaaaagttcaagttgggccgggcgcggggactcacgcctgtaatcccagcactttgggaggcgggaggaggaggcgggcagatcacttgagcccaggagttcctgaccagcctgggcaacatggcgaggcccccgtccctacaaaaatacaaaaagtagccgggagtggtggcgtgcgcctgtactcccagctacttgggaggctaaggcaggagaatcactttagcccgggaggtggaggttgcagtgagccgacatctcgccattgcattccagcccagccttgggcgacaggagtgaaacaatgtctcaaaaaaaaaaaaaaaaaaagtggaagttgacaaagcctgatttctcctttgtgaacaaatgtaatgtattcttatttcggtaaccaaaatcagaaactaaaattgaaaggcaactttcccatgccttcctgatttcattcattctttctatactttgagctctgagtatgggtcagcattcccagtgttagggattccagatgaaggccctgccaactgtaagacgaaaagcacccccttaacactctcccctccccagatttttcataaaactatccattgaaaactgtagagttcatttggctctgatttgggggaatttttagtcatatattagaaatcatggtggaactccaaagttctctcataacaaagtttaggcctaaaacataactttcattaaatgtgactggcctgtttgtggaatcttccacaatggttattagaagatgttatctacaatctgagctatttgatttttttttaatgttgccctatctttatagcgtttggcatctaatagcactaaacaattatctttctcatttgttttactgatatagcatgatgaagatactattatttcaacctgaggatttttttgaaaccttgaaaatatttgtgacttggccaggcgtggtggctctcacacctgtaatcccagcactttgggaggctgaggtgggtggatcacctgaggtcaggagtttgagatcagcctggccaaaatggtgaaaccccgtctgtactaaaatcacacaaaaaaattagccgggcgtggtggcaggcgcctgtaatcctagctacttgggaggctgaggcaggagaatcgcttgaacccgggaggcagaagttgcagtgggccgagattgcaccactgcacgccagcctgggcgacagagtgagtctccgtctcaaaaaaaaaaaagaattactgatcttcatttagaaccataaagtctctgatactcattattaagaggttaataacaagagtagctggagcatatctgaagtcttaaagcataaagtttgcccagttgccagagaccttatttctatttcttttctttttttttttttttttttgagatggagtctcactcccttgcccaggctggagtgcaatggtgcaatctcagctcactgcaacctctgcctcccagttcaagtgattctcctgcctcagcctcccaagtagctggaattacaggtgcctgccagcatgcctggctaatttttgtattttttatggagatagggttttgccatgctggccaaagtcgtctcgaactcctgacctcaggtgatctgcccaccttggcctctcaaaatctgggattacaggcgtgagccaccacacctggccacctatttcttctaagtgataacattgcactaatgaaggtcagtgcattgttttaattttatttttgtttttgtttttgagacggagtcttgctctgtcgcctaggctggaagtgcagtggcacgatctcggctcactgcaagctccgcctcctgggttcatgccattctcctgcctcagcctcccaagtagctgggactacaggcgcctgccaccatgcccggctaatttttttgtatttttagtagagacggggtttcaccgtgttagccaggatggtctaaatctcctgacctcgtgatccgcccgccttggcctcccaaagtgctgggattacaggcatgagccaccatgcccggcccattgttttaattttaaaatgataaccctattttctaccatatgttccctcaaaaaacagtggtaaaaaagagacttatggacagagaaatagaaagccttggcaaaatattgtaccccaaatctgcagctgaatcactacacaggtgccaaaattatgcaaaaaaattacactggctgggcctggtggctcatgcctgtaatcccagcattttgggaggctgagacaggaggatggcttgaggctaggagattgagaccagcctgggcaacatagcgagacccccatctgcacacacacaaaaataacaaaattagccaggcacagtggcatgcagctgtagtcacagctacttgggaggctgaggtgggaggactgcttgagcttaggagtttgaggctgcaaggagccatgattgcataccactgctctctgacctgggtgacatagcaagatcgtgtctctaaaataaaatatatatatatttttgagatgttgttttgctcttgtctcccaggctggagtacaatggtgcgatctctgctcactgcaacctctccctccagggttaaacaattctcctgcctcagcctccctagtagctgggatcacaggcatccaccaccacgcatggctaatttttgtatttttagtagagacagggtttccccatgttagccaggctggtctcaaactcctgaccttaggtgatctgcccgccttggccttgcaaactgttgggattacaggcgtgagccaccatgcccggccaaaataaaatgttaagacgtttgcagctgaattttttgcagctaaaatgtatatagctaatatcttgcagctaaatattcaagtacccaaagggtagtttaagaacactttacctgctggtgtggtggctcacacctgtaatcccagcactttgggaggctgaggcaggcggatgacctgaggtcaggagttcgagaccagcctggccaacatgatgaaaccccgtctctactaaaaatgcaaaaattagccaggcttggtggcgcgtgcctgtagtcccagctactcgggaggctgaggcaggagaatcgcttgaaactgggaggtggaggttgtggtgagctgagatcacgccactgtactacagcctgggcaacagagcgagactctgtctttaaaaaaaaaaaaaaaaaaaaaaggaacactttaaatcttggacataattctaactcagcagcatagctgttgcttgatgaaaaaccaaccatgtaggccagccattttaaagacatttctgtcctcacctggaatgggaaaaaaaagcatttctgtaagaagtttctattttagaaaacaggcaacagtgtattcccattgtagtaaaccctgaaacttccttgttgctttgctgcttcttgggagccccttatcatcccacccacatagttttttttcattctctttttcatactggtggacctggttccaggagtggaagagactaggagtcgagcagctgcggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtaccaaagttctttctgggctgggcatcgtggtacacacttatgatcccagcactttgggaggcttgagatgggaggatggcttgagcccaggagtttgagaccagcctgggcaacatggcaaaaccgtctctacaaaaaatacaacaagttagctcagtgtggtggtgtgcacctgtagtcccagctacttgggaggctgagatggatcaccggagcccagtaggtagaggctgcagtgagccgtgatttgtgccactgcactgcagcatagccaacagagtgaaactgtctcaaaaaaaaaaaaaaaaaaaaaaagtctttctggtcccatttatagcagatttccagaacttcaatagcatggtctactggtgggccttgttggaaggagctgtgtgcttgatttcaggctgttgggaggtggtttggtatgatggaaagcacctgagccttgtgacagggtaacctggggctctgctgcctgccagtgaggatcagcaaaagtgacttctgccttatgcaacatgttttctcaaactaaatgtattatgaagtttaaataagaaattacatcaagtgctggcctatagcgggcactctaaaaacggagttgcaaaagccattcaaccccagcaaaaggctagacacttgttctaataccatgtcaggaaacaatatcatagataatagtgctgatcattttcagctttatagtactcaagtttcttcaagtattccagagtaaagttctggatattagtttctggaaacaggctccaaactggattctgcctattaatgtgtcataattggcaggtgggatgctttaaaaatatttaggagaaacaaataccctgtagtccatcatcattttgtaacctaagttacaaaatgtctggctcccacagagcattttctaagtcatgtgaatagctaagtctggccttgtgttactgtggactagtgtgtatatagttgagtaatattaaaattttggtcataagggctctgctggaagcagggtctcaggagggtattttgcaccaagtgagaattgaactagcaagttagaaatctgtattttcttggttctgttgagttctaaaccaatgagtatccttaggacatgttaaccctcctatttaaattatgagttacttgtttttctagccatggtgacaagttgcataaaaacatctattgcatactcgttcctagaaattcttgtaaccaaaagcccagctcggagaggacgtggagtaggctgaggcagtcttgaacttaggatctcagcttcccatgtgcaacttcctttttctaggatttggcagagcaagaattgggtagaaagactgactttccacctgacctgttgcatagtattgtgagactggctgactgcagtggttacagtactctcccatttataatacaagcagcatgatttttaatgcctgcaaaatagagtttccaaagaaatgaaatctcagagtcctttagcacctgctcatgggtcaagggcaccttgacacctgcttctttctttctctgctgatttcccaaccctgtacttcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacagggcttaagcccagacttgacgtaacagaaatgtgccaataggtaataggtaatttttctttctctgacttgttttgttttcttgaaataacactgttgtgtggctagaaaggaaaagatttagtgtggcttgtattcatgggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacaccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaaataaaaccaaagttacatttcctgacagatggataagaaaacaatagaaggaacatcctgaattctagagttgactcttgctggtgaagtacaccttcagcttagtccattctcctaagtaaagcctgaaggaaaactcttaacacctaattctttgtggaaaaatgatcaactagccatttcacaggctatagaacaaaagtacaattgggcatctttccttatgtcctgggatcaggggtgcttacatttaacattgatcaggtaaagaggagaggctgtgcctaaggtctgagaaaaggcttgctctaagcaagctgtggtgaggcacaggatgactagggaatggcagagaacaggctggcctactgtcagttcaagcaaccagctgagcagcagcagtctaaaaagccccaaacagaacacctccatggattcagggaagggctgaggcactgcctttctagtatgtgccaaaaaaaacataactctgaattggggcccaggggactttgagtttgtatggggagggaaaaggagtgagcagttctcctcccctccccacagccttaggccaacacaaactgcaaattggtaagcagcaccttaatacctcttgtgacagttacggctgaagtggcagggtcaagcttgtaggtgttggcatccccctttttatatcggtcccggaagacatagatgctcccgttacagctggcaatcttccagagggatggggcagagctccaggcctcaggaaggcaaagccgggtgaagctgtctagcaagggattgtagcacaccagggagtccccttcagccacgatgaacaccagatctttatgcacagctgcgtgcatgcggcctgcaaagggcagcacatagggcttcacatggcatttgtctgtctctgtgtcaaagcactggatgagtcgggaaggtttggtaaagaagtccagatcattctcctccccccctagtaagtagatgatcccgttgaggttggcaccagcagcccctgacacagccacctctagctgagttgtctctgtccacacattatcacctacgcgataataaatgactgcgttggagagggtatcttgcagtgtcttgccacccagtgaatatatggcatctttcccgggcacagacaccagggtgtgctggagccggtcccgaggcaaaggagcacaccactcccagtcaacggtggcattgttgcacttccacatgcgccgtgggatggaccctcccaccacatacaagtctccaccatgcttgcaggccgcagtgatctggtggcacaaactgttttggccacttacactgatggagtcatcttctgcacagtgcaaggacacagccaacgagtgggtacgagatgactctttcccaatcaggtaaatgtgcacattctccccaatttcctattggcaaaattaaaattatatgacagctgttaaattctaggctaaggctcagctaagacacatatccttaagatcctggccctcacacttgttcctagctttatcatactactctctaattactgtatggcatccaactctcctctagtcactttctttgaggcaatttatgccgggcggagaatctgttgtattcatccttgtagcttttaaaaaactctcataagctagtgcttcagacaaagggtgattaagattgttaacttgatgacagtagttctcaaggaactttgaaagctcatagattggtggtactggggttacaaagacatccttctccccagctcatatcaacttcaagccagagataacttattcaaaaataaataaataaatacaaaaaattaaaaaaacaagagatggccgggcacagtggctcacacctgtcatctcagcactttgggaggccgaggtgggcagatcacctaagctcaagagttcgagaccagcctgaccaatatggtgaaaccctgtctctactaaaaatacaaaaattagccgggcgtggtggtatgcacctgtagtcccagctactcgggaggctgagacagaagaattgcttgaatttgagaggcggaggttgcagtgagctgagatcatgccattgcactccagcctgggagacggagtaagactctgtctcaaaaacaaacaaacaaaacaaaacaaaaaacagagacgaccattcataatctggccatcaaaaagaggccaggttaggccaggcgcattggctcatgcctgtaatcccaagactctgggaggccaaggtgggtggatcacctgaggtcaggagttcgagaccagtttggccaacatggtgaaacccatctctactaaaaatacaacaattatctgggcgtggtcgtgggcgcctgaaatctcagctactcgggaggctgaggcagaaaaatcgcttgaacccaggaggtagaggttgcagtgagccgagatcgcaccatcgcactctagcctgggcaacaagagcgaaactccatctctctctctctagcctgggcaacaagagcgaaactcccatctctctctctcacacacagacacacaaagaggccaggttaggccaggcacagtggctcacacctgtaatcccagcattttgggaggcagaggcaggcagactatctgagatcaggagttccagaccagcctggccaacatggtgaaaccccatctctactaaaaatacaaaaattaggcgtggtggcagcacctgtaatcccacctacttgggaggctaaggcaggaaaatagcctgaaactgggaagtggaggttgcagcgagctgagattgcaccactgcattccagcctgggcaacaaagtgagaatccgtcttaaaaaaaaaaaaaaaaaggccgggcgcgggggctcatgcctgtaatcccagcactttgggaggcggaggcgggcggatcacgaggtcaggagatcgagagcatcctggctaacacgatgaaaccctgtctctactaaaaatacaaaaattagccgggcgtggtggtgggcacctgtagtcccagctactagggaggctgaggcaggagaatggtgtgaacccgggaggcggagcttgcagtgagccgagattgcgccactgcactccagcctggacgacagagcaagactccatctcaaaaaaaaaaaaaaagaggccaaattaactgatggcaagaatgcatggagagtatgcagtctcaacaattaagagatttgccttaccttcaagcttgtcctgagtgactctgcaaaagcctctctttcctctttattaaagttgatccaggcttctattgcctctgttgggttctgagaacacggaactccatctgtgagagccagaggaaaggcatggtcaatgacaatccgaaagagaaattcagagtaagggactttaaagatgtgaaccactttattagactactgctgggcatgtgtatatgtgtacatgcatacatacacatatacatgaaattaacctaaaattgctttttttttttttttgaggcagggtctcaccctgtcgctcaggcagaagtgcaatggcgcaatcaccatcaccatagcctcaacctcctgggctcaagcaatcctgtttcagcctcccaagtagctgggactacaggtgtgcaccaccacgcctggctaattttcttattttctgtatagacaaggtctcactgttgtccaggctggtctcaaactcctgccatcaagggatcctccctccttggcctcccaaagtgctgggattacaggcatgagccaccatgcctggcgggtcttgcttttttttttttttttttttttttttgagatggagtcttgcactgttgcccaggctggagtgcagtggcgtgatctcggctcactgcaagctccacctcccgggttcacgccattctcctgcctcagcctcccgagtagctgggtctacaggcgcctgccaccatgcccaggtaattttttgtactttcaccatgttagccaggatggccttgatctgacctcgtgatctgcccgcctcggcctcccaaagtgctgggattacaggcgtgagccactgcgcctggcccgtaccttgctcttttttaaagatagtctcatgtgttacatgagccctcaaaaagttgggtaaagactcataaccgttcctctccatggaaatctttagtaaaaggtaaaagatttatacaatctgaagagaaaccagagtatgtgccttgcttttttaaaatcaaaatggatgactcgatattttcccatctgccatggaagcaacctactaagctacagagctcacaccatttttttttttttttttgagatggaatcttgctctgtcgcccaggctggagtgcggtggcgtgatcttggctcactgcaacctctgcctccgggttcaagtgattctcctgcctcagccttcccaagtagctgagactacaggtgcaagccaccatgcccagctaatttttgtattttttgtggagacgggatttcgccatgttggccagggtggtcttgaactcctgacctcaggtgatccacccacctcggcctcccaaagtgttgggattacaggtgtgagccaccatgcctggccaacctcacaccttaagtatggctatatctcacttgcaaggttaggattgtttcctaacgttggcccatcactaaaaaagtttttagtcttagatatcttgccccatcaccaatttacataggtaattagacccactgggacatacgaagtacaggataaattagagtataatacaaatcactcctcactactctgtgtggttaaatgttgtgctttaattttcctgacttcttcctctaacgcactgtgtctctgacagcaattacactgaatctcacctcaatctttctcagcaggttatctcagtaagaatgcaggaataataatgtaaactaacaccaggaagcttgagggttcttttctcctaaactagaacattcactgaacatcatagccaagtaactgggtatggtgtgtcccctccctaaacttacccgagatgatatctgtgagtaagcggtggggcaagtggagaaattcctctgtattctgcagctgggccaggtgggtcttggcacagtgcttggcagccgtatagagctcaggatcactgtgccgatctgccagccacatcacctgaaggcagtttcccacttgcactgtgcgggccaaaaaccgagagcattcctcaaagagagatgtcagctgatacatgtctgacacctcataaatttcctgcaactcctcagctcgaagtttcacagtcccatggtagatataatcaaccaggagctggaaaacagactcgctgacatcctgcagcacaatcacccggttgtgggcctccttcaggttggaagtgaacatggatcggaagaagcagctctgagctgagaggaccagccgatggagctgaaactcccggccttccaccgaaatggtgacatcagcaaagagctcctcctctagacacagtttcatgatgccttgagccacacggcctgaatgtgaccgatctttgaaagtgtagttcacaaagtagttctcatccatggatgctccaggctcctctggtgattccatgctagccaacttctctctctgccagctgtctgcaaagcaacaccatcttgagtaacctgaggaattcacagccatagtctgtgaatccaactgtccaactcagggagggaaaaggaagaagtgagagcaaagtgggtccagattggccttagtcctggccctatccatgatgtccctgacgctatcctttaaccaaatctgggttcgttatccccagtggcgcccctccgctaatgatataaataaaagttccaactctgggtgttttcctgagaaaacacggaataattcctttccataatgttaacaaaagacttgggatttaggtcaatatatgaaagcaaagggctgggagaggcctgtgatcgtaaaagccttactaaccaaataactggggcataaaactagtgaagctcaggggcagtagaatcagacaaaaaggacccctggccccggcctagtggccaggtcctctccttcccagcgcatggagttaagacgctccatatgaagcctagcctgggatatccgtgggtcttacatttgctctcttctgagctgcttcccccacacttccccgctcgctcgaaagactccctatggctgcgtcccagaacttgagtccatccgcccccaggccggggcactgggaggcccatcaccctgtgcaatgtccccgctccaccttgagtcgtcttggaaacggtcgccagggaaaccgttcttcccgctcaggcccgcccgccctcgtcaaaagcttggctcagagagcgggggaggggtgtgtagcgtagaacccaaaacgcccgccccctcccctcctctcacccgcctggttcttcagcgtcctcgccttctctctaggctctgccacaaggagctaggaccacgctcacctcacgatttccctacctgcctgtctcgctttctcacctgcgttccctcctttcatcccggagcccggaacctccgcttccggctccacgtccgcccggaagaagatctgctgcacacttccgtttccggtccgtgcccttggggctccgtgtcctgctgtctttccgtccgctgcctagtctgcatctgagtaacatggcggcggcggcggtagccaggctgtggtggcgcgggatcttgggggcctcggcgctgaccaggggtgagcacgggcagccagctgagaccggggtcaggcgcagcggcgtgcccagtgcagagagctcctcagggctcatcccgcgcgtctgtgccttttatctccctgtgcagggactgggcgaccctccgttctgttgctgccggtgaggcgggagagcgccggggccgacacgcgccgtgagtatgtgcgggcagcgctcttctctgaactatcggcggggccccttagatgcctgtccttgccctaggatgcccttccctacgtcctcctggcaaatcttggagatctgacttgcagtggtcttcaccctgcatgcagaatcgagccctccctgtgcccttaggcctgttatggccctgattgttccttgtccatttcaatcatcccctttttgtctgattaaactgtcagctctttgaaagcaagcaatataacctttaggcctcagagccctgtaataatagtacctagcgttaattgagtgcttaatgtgtgcctggaacctcgctaagcgttttagtgaatgatcttatttcgtcctcacaacagccttatggggtagatagcatcttactcttcttactatagatcaggaaacagtccaaagaattaaactgcccagggtcaaagacctagtgaatgacaaagtaggcctgcctgctgccagaggcagaaacacctaaccattattctgtagcttgtgatgtgtgattgctcagtggtttagggttgcatgaatgagtatgtacatattatgttacagtcaagatacacggactgggagttaggagacctggcatttctcctttcctgggttttctcattgacacacacacacacacacacacacacacacacacacacacacacacctgggcctcagttttctcattgacacacacacacacacacacttttaaggagagagagagtctgtgagggatcttcaagccctgaagttcttagcttgagaacctggtataaacttgcgtgctaaggagctacagagaggcaaaagttcagttcccatcctcaaacagctcttagtctgacaggagaactgagactactgctttagcagaaatgcaggcaatgtgagggaagaactgtggagtaattttgagaagaggtgaacaccccagctgctatagtaagagtctttctgaggaccgtgtagttaaggtggcactttccccaagttttcatcactgtattccctagaagggaaacctttcacatgcacctttctcaaggtgcttcagggagcctttcctggatttgacatcccttacaagcctaagagactgcatgcagggctggcttttgccttctccatttcttttttaaatatgccttttccttccagccactgtcagaccacggaatgatgtggcccacaagcagctctcagcttttggagagtatgtggctgaaatcttgcccaagtatgtccaacaagttcaggtaatacttactaatgttatttgggtctgggtcaagaaagaaccatgttcgcagggcatgtgggagtgggcagacttgtttcaaagaaactacagattcctccatcccaagcttggacttttctctcagcattaaaccaggtgactccagctgaagttagctgttccctcagtagctctttgttccctctcccctcactttcatgtgtgcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgaggtcagttgggagatctgagaaggttttgggggtaaggatattaatttcagtttgtaacatacaatagaacacagcagttaaactggaacttcagagtcaagtagatctgaagttggatcttggttctgccactaaatggctgtgggacctcagataactcaaatattttgtttaattttttttttttttagacggaatcttgctctgtcgccaggctggagtgcagtggcatgatcttggctcactgcaacctccgtctcccaggttcaagcgattcccctgcctcagccccttgagtagctgggactacaggtgcatgccaccacgcccggctaattttttgtatttttttagtgaagactgggtttcaccatgttggccaggatggtctcaatttcctgacctcgtgatctgcctgccttggcctcccaaagtgctgggattacaggcatgagccaccatgcccggcccttgtttaatctttctgagctttcattttcttaccgggaaaataaatataaagctgtccttatcttatagaatggttataaggatccaatgagatagttcaagtaaattgcttgcacacagtgttttcaatacatttagctattaatattttactgattatctactgtttgccagactctgggatggagagagaaataacatgaagtatttgtcctccaggagtcccctacactctagtgaaggagaaagacacctaaacagcttactgtagtaacatataatacaaaggatattagagggatgctttaagaaagcaggaggggcacttggccctgtctgggaggcttctttgaaaagagagaatgtttgtgctgaatctaaaatatgagtaggagaccaggtagccttgtgagatggaccagggaaatattcctgacaaagtgaatagcatgagcaaacacaggcatgctgacatgctaagctacagctgtggcctgggcctttggaagtagttgtaagcataggagaatcttgaggttttgaggttcagaatagaaggcagggtcacagggcagaactctcccaatcagggactcccatctcagccctccagatccttctgttctccctagattgtctacaacctgttgtctctgcgcttcaactcacggatccgtgtgaagacctacacagatgagctgacgcccattgagtctgctgtctctgtgttcaaggcagccaactggtatgaaagggaggtgagttaccggatatggtggacctgcctctgggccacagttgcagaactggttcagactacgggatgcagtgtagccccttccccctgttgttagtcttgatggattggctgtttgaggtggtctctttcctagatctgggacatgtttggagtcttctttgctaaccaccctgatctaagaaggatcctgacagattatggcttcgagggacatcctttccggaaagactttcctctatctggctatgttgaggtaggagccttggaactgggacagcagcctcagggagggacttgcagagaacccaggggatccctgggaatggcaagaaatacggtctgtggattgtggtggtttaagagcatgggccctggattcagatcctagcttcatttttgtaacctggggcaagttacttggtttgactgtaactcagttttctcatcttaaaatggcaataataatagcactttaatagatttgtggctggcattaaataatgtatgtgtaggctcacgcctgtaatcccagcactttgggaagccaagacaggaggagtgcttgagtccaggagttcgagaacagcctaggcaacatggtgaaacctcttctctacaaaaaaatagaaaaattaacggggcatggtggtgcattcctgtggtcctggctgctcaagaggctgaggtgggaggatcgcttgagcctagaaggcggaggttgcagtgagccgagatcacgccactgctctccagcctgggcaacagagtgagaccctgtctctaaataaataaatgatgtatgaagcctgctgtattgtaaaggctcaattgatgctgtgtgtgtgtgtgtgtgtcagggtctcactcttgtcacctaggatggagtgcagtggtgcgatcatggctcactgcagtcttgaccgcccaggctcaagtaatcctcccacctctcagccctccgagtagctgggactacaggcatgcaccaacatgcccagcaaatttttgtattttttgtagagacggggtttctccatgttgcccaaactggtctcgaattcctgggctcaagtcatctgcccgcctcagcttctcaaaagtgctgggattacaggtgtgagccaccacacctggccagtgttatccattattgtaatgatcattttaatgatcaaggcagccttgacgacacagtctgtccctaaaacctgaaagtagaggattattttaccctgccctgactctctgggaaggcagtgacggggaagacaccagatgcttagccctcaaaaattacctctgaggtgggaccagtaacgtgaataaagaatttcagtggtgctgcaggttatttgcaggaagatagtgtgtaatattatcactcgtgaattttatagcaaagtaactgtttagaaatgcagagatgtggtgctccagccctgctcttttagttcccagtcactcctgctgtgttagtgctttgcatgctcctatttccctcttgggctacttctgggcagggctatctccctcgcttctccctttcaccccactcctgctatctgcctcacctggtttgcctcttcactctagcacctgatgatccttaccttatccatttgatccccaagtaacaagaaaagctgtgtcaaatgtactgctttagatctggactgtgaatatgccaagggcaccgggcctgaggttgtgtatctgccagtttaggtttactcttttcagccaccgactactccctaatcctgggcaaatgcttaccattaccttgtaagagtgtgtgggtgggtgagcagtcagttcggagctcctgatgtgggagtggtgagcaggggaatctgactggtgctggcagggcatgagaggtatcctacattttggaatcacacactctagctggttgggatgtgatctgacgggtaacacaggtatggatggagacttactgacagaggctgggacaggagtcagtaaccgagaggaatgggctggggaagtcaccaatagccttgtgaaaagtaggctcctgtgtagctataataaggacttccttagtgctcaagcctgccttttgctcctgcagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagacttaccactttgtgtgtgcttgtaatgtggagaagtgatgctttgggggggacacaggcaggcaggggtgtttccctgctctcttagagaggcactactaaaccagggagtctttgatgggtttttttttttttttttgagacagtgtttcgctcttgttgccgaggctggagtacaatggcgtgatctcggctcaccacaacctccgcctcctgggttcaagtaattctcttgcctcagcctcccgagtagctgggattacaggtgtgtgccaccacacctggctaattttgtatttttagtaaagacggggtttctccatattggtcaggctgttcttgaactcctgacctcaggtgatctgtctgcttcggcctcccaaagtgctggaattataggcgtgagccactgtgaccagctcttttatgtttttttgagatggagtctcgctctgtcacccaggctggagtgcagtggtgctgtcgcagctcgctgcaacctccacctcccaggcccaagcggttctcccccctcagcctcccaagaagctgggattacagatgcacgccaccacgcccagctagtttttatagtttttgtagagatgggatttcaccatgttgcccaggctggtctcgaactcctggcctcaaatgatccacactggcctcccaaagtgctgggattataggcgtgagccaccacactcagccggaggtctattttaatgggactaaagagtgtagttgcagacgtggtggcctgcaggcatggatgtatttctgagagggattctggagctgtaactgaaagttctcacagtccacagggttcaggatgggtgtggcatggtagccaatcactcttgggctacaggaatctccctggtttctggcctgagctgagaatggtggggttctttttttcttcttcttttttttttttttttgagatggagttttgctattgttgcacaggctggagtgcaatggcatgatcttggttcactgtgaccgccgcctcccgggttcaagcaactctgcctcagcctcccgagtagctgggattacaggcttgcgccaccacgcccggccaattttgtatttttagtagagatggggtttctccatgttggtcaggctggtctcaaactcccgacctcaggtgatctgcccgcctcggcctcccagagtgctgggattacaggcgtgagccaccgcgccaggctggtgggggttttttgagacagggtcttggtctgtcacctaggctagagtgagtacagcagtgtgatcgtggttcactgcagtctagactgcctgggctcaggtgatcctcccacctcagcctcctgagtagctaggaccacaggtgtgtaccaccatacccagctaatttatttgtagagatgagggctcaccatgttgcccaggctggtcttgaactcctgggctcaagccatcctcctgtcttgccctcctaaagtgctgggattacaggcatgagccaccgtgcccgctctgaattaagaatgttgctaggaaacaagaggtcccagggctggggcaaaaaccactcaggagctgcagatttgtctgtctgccaggggacaatacgccctagcccagctgatctgtctgtccagcctgcggcagagtgcctgagaggggagtgcttggctctgcctgtctgtggggccgcccagccagcccaccatgcagttggaagactttgcagctgatgcttttggcagctgaggggctccttggaggctgggctgggccagactgggtgtcggggctggcctcagtcgcaggatattttgagggcgcagacagtaagatggtcttactgcctgagctctttcctaccctttgggagggccaagctacagctatttgctaccaaacacctttttcctattaactaagcataccgcccagctgggcaggaacaggctgagggcctgacaagcagggagccaggctcctgccaacaaccaaagattccccatttctaaaggatggaaagagcccctgggaggtgaccgaggccacagccagcccctccctgttcagcactgaagaatgacacgcattacagagctctggagcagcccgcagtggaaagttggagctgaggtgtgtggcaggcagatgagggagcagagaactgctgaacagagtgagactcagaggacgtggttgagcatggctgcgaccctgcagttcctggtttgcctggtggtagccatttgtctcctctctggtgtgactacaacccagccccatgcaggtaccaggcttcagggtgggtggagaggagccaaggctgctggctgacagcagttaacagttggctctatttgaggctagtcgggcatagaagcgtgggcatggtgggtaccaggctgatgtgtgctgtggtgggtgacagtgtgggccccacccccagaactggaaaggtacaggtgacacctagggagatagccctaggtgctcttaatgctggccctgggctcattcccactgatgcccaaagcagggtctcttgacctgcctgggcttggaacaaacattgcaagggtgaggcaacaccccaaggtgtgggccggacggagctgccacagacatcctcccctgctctgtcctccctgcctcacatcctcccctgccccgtcctccctgcctcacatcctcccctgctctgtcctccctgccctgtcttcctcctccctcccttactgctgaggaggagcagggagagtaggctctttccaaagaggtctttgtccttgggagagtcactggcactgttttaggtgactttatcctcagatgactatagggaggggaggagggtggggaagggtcttgtgacccgttggcctggagctctttaacaagggcattgtgcaatttaaaggaggtgtcctgggcatttgccaacatggtaactgggcttggaatgatgcttttgagatcagaggacctatgcctgggagggtgaatgtcaatgtgcatgtgtgtgcgtgagagggaggggaaaggagggcatgggatggcattcctgcccttttgtagaatgatgaagcactcgggacctctaccaggcagcagaggggcacttctgggaggctggggtgttcatggtgtagcatggcaggggcctgactcctctctgctgccccagggcagcccatggacagcaccagcgtgggaggtggcctgcaggagccagaggccccggaagtgatgtttgaggtctttcctcccagcctgggacatgggggtgggcacgtccagaggtccctaagctcagggttgggaagggggatgtctcagggtggacctgctagggttgggtggggcaagccagcatgcgtcctgctgcctgcttctgccccttcccccagcccactcttgctccctgccctgctccccaggccacagcccaccccttacatggctccccttgcagctgctctgggctgggctggagctggatgtcatggggcagctgcacatccaggatgaggaactagcgtccacacacccaggccgccgactcagactcctcctgcagcaccacgtgcccagtgacttggagggcactgagcagtggctgcagcagctccaggacctgcggaaggggcctcctcttagcacttgggactttgaacatctgctcctcacaggcctgtcctgcgtctaccggctccacgcagctagtgaggctgaggaacggggccgctgggcccaggtcttcgctctcctggcacaggaaacactctgggacctgtgcaaaggtttctgcccccaggaccggcccccttccctggggtcctgggcctccatccttgaccccttcccctgaccctcctcttttgttctttcacctgccattaccccctcccatctcctcctcaaccccccaggcagacccatcttgcgcaggggcttctgtctggcatctgattcttttcaccgtgttcagatctctgggcttggcttgcaccctggacaccccctctctgcttaccccgaccagatcttgtttcctagatcttgagaggctaagaacccaggctctgggtcgcaaggagtgcgcaaggagtgggcacagagctaagggcacgacttgcaggcagtgtgtgtgtgagtgtgtgtgtgtgtgtgtgtgtgtgtgtgtgtgtgtggagatcaggggtcagggttgagaagtgtgttcaagagatgctgaagggaagctgccccaagtaaggcctggtcagaccttccaactcctaccctggcagtctgtgacaggtcctgtggaattcacaggaatcctctaggtgctgagcatccccttttaggcacaaccaaggatttggggtctctgagcctccaagttcccatctgggttgggagaatcgactttttgagttctgtcagttggaagagtggagggaagcagggggagggaggaacattatctcttttggggtagggaggcaatatctcaacaagcgtcgggtgaatacctcagaggggggagtaaggctgggagaccaaggagagacaagcggaggtgggctggagcaggtgtggccctgattctgtgttgctcttctcataaaatgttctgtttcggcctcctggagcctgtgtcattctatgtcggaataagcgtctaacccctgctctgggcaaatcactctccccatcccgggaaggcaagagtcagggcaaccaggtatcaactcctcatctcattcccacgccctgctggaagaaggaatgcactgtttccttgaatcccatgcaccctgtggggtaatggggtgctgttccttgtcacagaaaggcatcagccgggggctaaggctgaggtcgtaggtcaatgatgagtcagagggctagacgaggtagggatataaaagggaggcccccaacggactaggcgaatgtggttccatcaaattcccacctcctcaccctcccagggtccaaggggaccttgctttccaacctccaaccccttccccgggcctgcgggcccgcagtagtcagcaccttcccgcctgccgccggcgaatgcgtcgcagtcaagacagcgcaggggcctgggctgccgggcgctgcgcgtgcccgctttccgctttattggcagagtccaggcgcgcccggaggccgtggcgctcgcgcgggactttcgagcctccggcccggcctggcatgcacgcccctggccctcccgggctcttctctggcccggggctcacagtagctccgaggccccgaggcccggcggggcggcgggggcgaggtcggggtacaccaggaagccggagaaggtgatgtacttgccgtggttgctgtaggcgccgtagccgtcgtggtcgtggctgagcagccagacggcgtcgccgcgccgcagggccagcatcacgctctggctctgcatctcgcggcgccgcgacgcgccgtcgtcgtaaatcatggcctgcacctcgtcgcggttcttcatcagcttaaccgacagcgtcttacgcggcagcttgcccagcgtgaaggagaagaagtaggcgccgggcagacggcagcggaacacgccggccgccgcgtcgaagtcgccgccaatgttgacgaactcggtgtcgaaggcgagtggttggtgccgcggcccggggccagcgtccgagcccaccaagctgcgcgtgcgcgccgccgagaaggccgagcgcggctcggggggcgcgggcggcccgcgcgcaggcgcgtcagcgtcggcgtcggcgtagactaggtagccgctgaaggtggcgccgggcgcgcctagcgcgtactgcggggcgccatgcagccgcagccacactgtgtcgccgtagtcgagctgcagcatggcgctctggctggctgcgcgccgcgcgcctggccgccgctgctcgtcgaaggccagcgcctgcacctcgtcgcggtttcgcaccagcatcaccgacaggctcttgtgcggggccttgccagccgtgaaggagaagaagtaggcgccgggcacgcggcagcgaaactggccggtggccacatcgaagtcgcccccgatgttcacgtacaccttgtcgaaggtcaccgccatctccgacgtgccctccaggggggtggtgcgtgccgccgagaaggccgagcgcagctcagaggatcccgggccgggggtcgggcccagggcccagcaggccgctgggcccagcaggcccagcagaagcggcagcatggcgcctgggagggagacggaggggcgagagtggagtgttggcaggggcggcttccaaacgcccggctctccaccgggagacaagggttctcttcccagccctgcccttgacccacaagtaggtttcaattttcctacatccttggattctcaaactctagcgagcctcactgtcacttggagggcgtgttcaaacatacatagttgggccccatcaccagagttcattcagtaggtctgtgatgggcctgataatttgcatttctttgttttgtttgtttgttttgagatggagtctcgctctgtgaaccaggctggagtgtagtggcacgatctcgtttcactgcaacctccacctcccgggttcaagcagttctcctgccttagcctcctgagtagctgacattacaggtgcgcaccatcacgcccagctaattttttgtatctttagtagagacggggtttcaccatgttggccaggctggtcttgaactgacctcaagtgatccacctgcctcagcctcccaaagtgctgggattacaggcgtgagccatcgcgcctggccttgaaaccccgccccccccccttttttttttgagacggagtctggctgtgtcgccaggctggagtgcagtggcttgatctcggctcactgcagcctccacctcccaggttcaagcgattctcccgcctcagcctcccaagtagctgggactacaggcttgcacccagcacacccagctaatttttgtatttttagtagagacagggtttcaccatgttggccaggatggtcttgatctcttgaccttgtgatccgcctgcctcggcctcccaaagtgctgggattacaggcgtgagccaccgcgcccggccgaaacccctttcttaagtgaaagcttgaacacagactagcagaaacactctggttaaagaggcctacagccctgtctgctgggcttgcccctacacctcccatttgacactcaggggccctggtaacccgggggattcaggggagtctctgagttcccctcagctccagttggctgcattttcctgtggttattttatggtccttggtctgccactcacgcaggcactggctctctgtgtcaacgctctgcatgaccgttactgtttaagccccatctgagcaggaaaggaaatcgctgctccctgacccctttcctggcctcaccaggggcccttcctgcacagaggaggcgagaacagttgggctttgaggtagcttcctcccccttgaaatcagagtaaaagagaaggtgactcctttctctttgcttggaggctggttactcagaagaaggagtggcgagccaggggctactggggatggacagggacagcaacaattccagcagggctttggcaaggctgtgaagtcagcagctttgttccttgggagtgatggattggagaggacagatagccagatctgggttcaggtcctggctctaccactcacactgtgaaaccttgggcaggttccctaacttctctgggcatggcttcctccatgtaaatggggaagagacctcacacacaggcttgctgtgggggtgtgctgagataggtgtgaacatggtttgtcaacggcagtgctgaggtgtgcagatgcttctgtcggttgccctgacaaaagtgatctggtccagttcttgacgtaagggtttagggactcagtcactcctacccctgagagcttggtgaaggcactgcttaactcaaaggagtcactctctgatgtagggattccatcctgcttcctagtagggcacgtgctttggggcttgaatacccaaaagccctgatgtggaaacaaaacaggaaagaaatgagctggagacagcctgggatgtgggctgctttagaaaatgccctgtatgtgtagctctgtgtctcttagagacagcagggacctgctgagaagggttgtcaggtgtagatgtgcagaacgtcccagctagaatctagctcacactccacatgttagagcagcacctggcgtaaagtatgccaccttctcattctcatactaaagaccccaagttgctagccaactgaatgctgtctccttccagaggaggtgctttttgtaattctcacaaaggtgtcctatggattagttaggtgtcccttggttaggacagggaggagggaaggggccatccacagtggtgaagatggcacctcacaagtgtccagtgcattcccttttacaaagttcttttagacacatggtcttggcaaacctacaagacaggtgggccgtctcccattttatagatgagaaagctgaggcccaacaagggaaagcattttggcccaaggtcacccatggagcactgaggttttttgactcaaattccgtatgccttcctgtcactcttccctcctagacacaggtatgtccagccaatttgttctgtgcctcagtttacctttttgcaaaactaggagaggagatcagaggaatgagtcttgggatccagggtgaggaagacagaaagcaaaaccaaacaaaagcaagcaaacacattctctagtgttttgtcttctgggaacacggaaaacagctcagcttttccataccgctgctttcctagtgggtcctgccccagaagcagctgcccagcaacctcctgaccaaggctggtgcaccccaccagtgccaagggtcttcctgtgcacccagtacccagcctccgtttcacccacactgcccaattcccagatccctggatcctcgtccttccctgaacccccttccctgagcaggtcagaggtgtgggagggtgtgtcaggtgggtgtcatagctccagggaaggaaatggctgttcctggctctgtccaggtggggttcaaaatagtcatcttcaaagagaaaaactgggacacagagctggagagacccagagccccggagccaaggcgggaggtgcagcgatgtcaggctgaggggatcgcagagttcccccttgccctgccactcaccagttaacccttccctcaagccctgccagagccccctccccaacctaccttgaaagcccctcatccttccaagaagtcccactttcacagaagccaattaatccttatttttaaaaaacaaaaaccaatccctctcccccgagaccttccctccatccatccatccctttggaatgaaagcccttgtgcctgtttcacgaaaaggctcccaggtcctcctttcaaggaaaaaggacccaatttccccgcgcctccccagccctcgcttccagtaaagggggaacctcggctccctgcctcccctcagctgccctcacctggctgggggcggcggtcgagtcgggttcggtctgagcccgcgatctggctccgggctgcgggctgcgggctgcaggctgcaggctgcgggtgccgggctgcgcgctgaccgcccgcgctgcggcaggggcggcgggggctccggctgcttttcccggctctgaggcggcagcggacagggtgctggggccaggggccgggcgtggggaggcgtgagggaaagggaaggtcagctagagagggagccgagcgagagcgaagaggcgggggagagacgggagggggagaggaggggagtaggggagagggaggggcgagctgcggggcctaggggctccgcacggagtctgcgccgagcactggacccttcctcatctgtgacctccttagagcttcgtcctctgggtctagagagcaggcatcattaatctgagcagttggggaaactgaggccagaggcagcagctaacgcggggtggcccagagcgctctacagtccagcttccttcctagtgtggggagagagggctagagctggactcagaggctggactagcctttgggctgcaaggacagtggaaggtgagattttggctgggacagatgtccaagctaagtggccttgggggagaggtctgaaggaagagaaggataaatgggtcaatgttgccagtaaaggaagagctgaaaataacctagtttttcctcctcacctccaaattggaaaatgcccacggtcggttaggaaagagggagaagggagtctgcaggcatcagaggggcagcctgcgttccccggggtgaggggcagtaaggaggagagtccttggggcagaatggaattttctgctgggaaggttgctcctgcaagaagggacaggattgagagggcaataggtggggaagaaaggcctctggagagggaaactgatgccctgcctcgctggggccaggctagcaagagtccagcagggcacccgggctgggaacagcggtcttcccatggtaatactcaccagaggcactagtgctggcctctactctgggcttcgagcccgtgggatgggggctcagactccctttctctaggctgctgttctctcccctgacggctgtagaggtgacgacactgcctggcactcagtagatgctgactgagtggatgacttttgaagagctctactttcagcagccaagagctggtgccctctgcctggccctggttgactccagagccatgggctctaattctgcctctgctgcaggtctgctctgtggtccctgagaggcctggacccctgcagaacccccgtcctctggagctttccttttggagctctcaaagtttaccccaccccagttaatctatttgtctctaggaagatgttggtagaggtgattggctctgcttcaagggtgttaggtgaatgatggaatgaattaacgaatatgtgccagaatagaaaggaatgaatggaggtgttttgggctggataatgagggtatttggtgacagagggtgaagcacctgtctagcccttgtcagatcacaactgtctctttcaccaacttgaaaagcttgggccacaggactgtggggaggacaagaagcagggtaagggtgggatgagccacacagggatgtcgaaggagagctgggggatgccaaaagccaacctatggcaatctatggcccttcttagggccatgggccccttctggatgagaagagtggagctgctctcctgagggtgattccaatggtgggaggggaggggaggggagaaggtatattataggataatataatctcagttgaggtttggttcaggctgggatttgacactccctggatccacaagagttctcaccagagaagtgagggttgaggtagagatgggtggctggggcagatgacatcaggatttgcatcaggggactgggatagggaggaagccactgggaaagggatatagagaaagatgatgccatgagctggtgggtgtaaggcagatgggtgggctccagaatgggagttaagaagaggtggcagcaggatccagagaaaagccctaggctggttatagtccctgctccctcctctcttgttttgcagccacaattttatttatttttgagagagggtcttgctgtgtcacctgggctggagtgcaatggtatgatcttggctcactgcagctttgaccttgcgggctcaagtgattctcccacctcagcctcccaggtagctgggactacaggtgcaggtcaccatgcctggctaattttttttaaaattttttgtagagacgaggtctcactctgttgcccaggctggtcttaaacaacaattattttatttattttttaattgagacgggtatggctgggcatggtggcttacgcctatgatattagcactttgggaggccaaggtgggaagatcgcttgagctcagaagtttgagaccactctgggcaacagagtgagaccccatctctctctctcttttttttttttttttctgagacagactctcgctctgttgcccaggctggagtgcaatgctgcgatcttggctcactgcaacctccgcctcccgggttcaagcgattctcctgcctcagcctcctgagtacctgggattacaggagcgcgccaccatgtccgactaatattttgtatttttagtagagacggggtttcaccatgttggtcaggctggtcttggaactcctgacctcgtgatccgcccgccttggcctctcaaagtgctgggattacaggcgtgagccaccgcgcccagctgtccccatcacttaaaaaaaaagttaaaaaaattaacattaaaatatatataaattgagacgggttcttttttcttttcttgagatggagttttgctcttgttgcccaggctggcgtgcaatggagcaatcttggctcaccgcaacctcccgctcccaggttcaagtgattctcctgcctcagcctcctgagtagctgggattacaggtatgcaccaccaccctggctaattttgtattcttagtagagatggagtttctgcatgttggtcaggctgttctcaaactcctgacctcaggtgatccgcccgcctcagcctcccaaaatgctgggatttcaggagtgagccactgcgcctggctgagataggttcttactctgtcacccaggctggagtgcagtggcacgatcttggctcattgcagcctgggcttaagtgatcctcccccgtcagcctgccaccacgtggcagctaataaacaacaataatttttatttatttttattttttgaaatggagtttcactcttgtcacccaagctggaatgcaatggtgcgatctcggctcactgcaacctccgcctcctgggttcaagtgattctcctgcctcagcctcctgagtagctgggattacaggcgtatgccaccacaccaggctaatttttgtatttttagtagagatggcgttggccaggctggtcttgaactcctgacctcaagtaatccacctgcctcggcctcccaaaatgctgggattacaggcgtgagccacggtgcccagccaacaacaataattttaatagcaggttcctttcactgagtgtagtagatgctgtcagtggcccacccacacctccaggcctaccaggagggcacccacagacagttcctgaccaggcgcctacttcctgtgtccctcctgagggcattttcagctatgggagttagtgtggggcaggcccaaagggctgtagagttaatacccccagagcaaccatcagccaatggtccagagttaggggtaaataccccagctttctggtccctcgatgggagcattccaattcccaattccaggtcatgtttcagactcagagagactccagcagagttaagttctccatggtgaaaacccactggtatctgtgcgcttttttttttttttttgagacggagtctcgctcagtcgcccaggctggagtgcggtggcgcgatcttggctcaccgcaagctccgcctcccgggttcacgccattctgctgcctcagcctcctgagtagctgggactacaggcgcccgccaccacgcccggctaatttttttttttgtatttttagtagagatggggtttcactgtgttagccaggatggtctcgatctcctgacctcgtgatccacccatcttggccccccaaagtgctgggattacaggtgtgagccactgcgcccggcctatctgtgcactttattctgtttcctctctttgtctcatttccccgctcgctcactccgcttcttgggatcacaactctctccttcaccagcttgaaaagcttgggccccaagactatggggaagacaagaggcatggtaagggtgggatgagccacacagggatgccgcaggagagctggggaaggctggaagccaacctagggcagccacaacccttcttagggccatgcagcccttcttagggccatgtgtcccttctggatcagaaaagttaatgcaggagtaggatttaaactcagagctatctggctcccaaacccagtccttaaccagtatactctgcagcctccctttctctgattctctctcagcctttttatttttattttttaagacagaggctgtagtgcgtggtatgatctcagctccctgcaacctctgcctcctgggttcaagcgattctcctgcctcagcctcctgagtagctgggactacaggtgtgcactaccacacccagctagtttttttgtatttttagtagagacagtttcaccgtgttggccaggatggtctcgatctcctgacctcgtgatccacccacctcggcctcccaaagtgttgggattacaggcgtgagccaccgtgcccggcctgaagaggctctttctaaataatggtgaggattttgacagggtgagatggaagtggagatggaggagtgagggggtgggatccagtcaaagataagaatgtgaaccaaggtgaggaggtggcgtaggtggagcttagggaaggaaatgtaccaggcttggttgtggataagggtttgtgatgggaagttatggtaaggagtgtggggcttaactgctgagctaaggagcttttaccttacagtagaggagaagaaggtgtgctcaaagctgtattttaagaagattactctgcagattgaaaagcaggagaaagaagaggggagaggaaggcagatgggtgagaagatactgaaagtgtccagatgaaagtaaactatccaggggcagtgagaaaggaagagacagatgggagagggactgagaagagagattcagagactgacagagtgagcacacagctcacaatttaattagcttcctgctttgccagtggattacagggaattagcaaagctcacagtctagggaccttgctgggagttgaggggaaattaatgagaaagacaacaacatgccccagggagaaatgaaagaggaggaatgttagccaagcagagatgccagcaggagaaacatacgtctgggcgctgagtccctgcctttctcggagatttcagccctccaggggagcagactttagggttcctggtcacgctcctggccccattgcccttggttccaattcctctgagcacttggtaaatgaccccggagaggggaagctgggagtgcttgtgaagaccaagttcccaactctcccctggcctttttcccagcagggctctaagatcccaacactggccttcctagaaggcagaactgaatcccctgggccccttctgcagatggaccaggaggtgacctgctcatgacctgatgtgacaaattgcattttcaaatgcgacagtgtcatctcccatcccacttgctcttcttacaatgtgaccttgccagtcctcatgaaaaggaggagttacgttaggtcattgaaaggtgatgccgctgctgcctggatctctctcttgaaaccctcatccctggagcccagccatcagactgtgaggaagcctaggtcacatggaaaggccacgtgtaaatattgtggccaacagtcctagtcaggaccagctacatcatttgcagagtccagtgcaaaatgaaattgtggagtggctgggcacagtggctcatgcctttaatcccagcactttgggaggccaaggcagggagatcacttgaggccaagagtttgagactggcctggccaacatggcgaaaccccgtctctaaaaaaaaaatacaaaaagtggccaggtgtggtggctcacgcctgtaattccagcactttgggaggccaaggcgggtggatcaccaaaggtcaggagctcgagaccagcttgaccaacatggtgaaaccccttctctactaaaaatacaaaaattagccaggtgtggtggcacgtgcctgtaatcccagctactcaggaggctgaggcagaagaatcgcttgaacttgggaggcagaggttgcagtgagccgagatcgcaccactgcactccagcctgggcaacagagcaagactccatctcaaaaaaaaaaaaaaaattagccgggcatgatggcactcacctgtggtcccagctactcgggaggctggggcatgaggatcgcttgaacctgggaggcagaggttgcagcaagccgagattgcaccactgctctccagcctaggcgacagggcaagaccctgtcttaaaaaaaaaaagaaggtggagggtactgttaaaaagttaagaatttagagctttaaaccaagcatatggctcttccaagtgtggcaccttgctcagccatgcaagttgtggggccacgaagctggccctggccccagctgcggtaccagcatcactgcaagtgatgtggatgtgaggaagccttcaagaggacaccaggcctggcctctgactgcaactgtgtgagcggccctgaatgagaactgcctagctgaacctagtactccaccagacccacaaggaataaagatgattgttgctgggctttttgttgttgttgtttgtttgagacggaatctcactctgtcacccaggctggagtgcagtggcacgatctcagctcactgcaacctctgcctcccgggttcaagcagttctcttgcctcagcctcccgagtagctgagattacaggcgcctgccaccacacccggctaattttttttgtatttttagtagagacggggtttcaccgtattggccaggctggtcttgaactcctgacttcaagtgatccacctgcctcggcctcccaaagtgttgagattataggtgtgagccaccgcgcccagccgactgttgctgttttaaaccagtaagttttgggttactgtagcaacagagagttggaacactggggtaaccagacctgatcaaaactggctgaagatgcaggacagccaccaagtttctccccatacccaggctcattccctgaactgttgttgcatgttctccttgacccatgttagcagaagacattggaggcacaaataactccagactgacaggagacccaaatcctatgtctggctatggaatgctgcacattgacaccaagatctgcacatctttggggacaaaagtcagcttttcaattggagaggttggagaaaaaacccactcttctgtgagctgaaacagtggtagtattggcactggcaggagacagtgtttgggtctccatggcctgcaggaagggagaaaaggaaggctgtgtcctgccaaggtgagtaacagagagaagccctgtggctttttttcttttcttttcttttcttttctttttttgagacagagtcttgctctgttgcccaggctagagtacagtggcgcaatatcggctcactgcaacctccgcctcccgggttcaagcaattctcctgcctcagcctcccaagtagctgggatttcaggtgcccaccactgcacccccggctaatttttgtatttttttagtaaaggcggggtttcaccatctttgccagactggtctcaaactcctgacctcttgatccacctgcgttggcctcccaaagtgtccacccacctcggcctcccaaagtgctgggattacaggcatgagccaccttgcccggccagcttttttttttttttttttttttgagacagggtctcactttgttgcccacgcctgccttgaactcctaggctcacacaatcctcctgcctcagcctcccaaggagctgggattataggtgcatgccactacgtctggtcacattctgattctgactggtgaggggttgtgttgaattgctttgtctgtgttcaccccagtgtagtgcctgccagagtgtaggtcagaagagtcctgagtgactggtgagacaacttgaatgtaaacataatctacaacccagttgagtaactgctggaggaggagggaagggggcagggagaggcttatagcaatttatcattgccccctcagttttttgtttgtttgtttgtttttaagacggagtcttgctctgtcgcccaggctggagtgcagtggcgcgatctcggctcactgcaacctccgcctcctgggttcattctcctgcctcagcctcccgagtagctgggactacatgcgcccgccaccacgcccagctaattttttgtatttttagtagagacggggtttcaccatgttagccaggatggtctcgatctcctgacttcgtgatccgcccgcctcagcctcccaaagtgctgggattacaggcttgagccaccgcgcctggccggggtgccccctcagtttttaaaagagtaggcagaaatacaaaccagaaagtgtgggaggatcacttgagcccaataggtggaggctgcagtgagccaagatggcacacctgcactccattccttgtgggctgggtggaaattaggaagagaaattaattctaagtggagcaatgcagctaggcttaatcagagaggtaacacctaaacgaagcagtgaaggctgcactggactttgacaggtaacaatagactgaagagcattctgggagaaaggagcagggagcaggaggtaacgctcttaggcaattcagaatcatggtgaagagtagtgtctggcatcagactgcttcagtttgaatcccagcttcttcattatttgtatgacctgtttccccacctgtgaaatggggataataaaagtatgccccattgctgcaaggattaaagacatttagcacagagactggtatactgtgagcactcagtatgtgttggctgttactactgtttggtgtgtttgaaaaatgagtaataatatcggtgtggctgcagtatggaatgtggagctactgatgggagataggcccagaaaaatgtggttgaatccaatcatgaaggattttttatttatttatttttattttttgagacagcgtttcactctgcttgcccaggctggagtgcaatggtgtgatctcagctcactgcaacctccgcctcccgggttcaagagattctcctgcctcagcctcctgagtagctgggattacaagcatgtgccaccacgcctggcttattttgtatttttagtagagacggggtttctccatgttgatcaggctggtctcgaactccggacctcaggtgatctgcccactttggcctcccaaagtgctgggattacaggcctgaaccaccacacccagtctcatgaaggatttcaagtgccagcctatgccatccagactttattctggaagccaggggatgccgatgccaatcctgtcagaccaaacttataagtattgtgggctgggcgtggtggctcatgtctgtaatcccaacactttgggagccctagggtgggaggattacttgaggccaggagttcgagaccagccttggcaacatggtgagaaccccgtctccacaaaaaaaaaaaaaaaagaaaaaaattagctgggcttggtcgcacacacgcatagttccagctactcaggaggctgaagtgggaggattgcttgatcccaggaggttgaagctgcagtgagccatgattgcaccactgcactccagcctgggtaatagagcaagaccctctctctcaaaaaaaaaaaaaaaattataagatgctattgttattatttttacctctcaaactgtcaaagatcaatgaggtttattatacattctattggtgagatgtagagaaacagacattcatacatttttagtaggagggtaaaatgacacaattggacagtatctaccaagtttaaaaatgtgcatgccctttaagtcagtgattttacttcttgaagagatgtttttcagatacatgcccacttgttgggaattacatcttattcattttagcatggcttgtaatagcaaacagtttgtaatagcaatgacgtgttatttattgcagcattgtttgtaatagcaaaatactggaaataatctacatgtccggcaaaaggaccaataaattatgatacatatatacagtagaatacgatgcatccctacaaaagaatgaggaatcattttgtatactgatgaaataatcgctaagaaatgctgttagttaagtgaaataaaaaacaaggtgcacaacataccaccatttatgtgaaaaaataaaaagcatgcatttgcttatgtgtacttggaatgaatacctctgaggggatctattagaaaccattaacagcagttgctgttaatatgtctcccatatttttcttttttgttttttttgtttttttttgagacggagtcttgctctatctcccaggctggagtgcagtggcgagatcttggctcactgcaagctccgcctcccaggttcacgccattctcctgcctcagcctcccgagtagctgggactacaggcgcctgccaccacgcctggctaatttttttgtatttttagtagagacagagttttaccgggttagccaggatggtctagatctgacctcgtgatccgcccgcctcggcctcccaaagtgttgggattacaggtgtgagccaccgtgcccggctgtctcccatatttttcactgtttcacccctttgtaactaaaataacaagaggtggggagagccactatctttttaagcagctgctccattcctaccggtttctattcaacctgagatcagctgcaagcccttagcctttttctcaggcacctctggcaaaccaaacttcctatatcctatgcttatgcagctgattttttttttttaatctaaatgcaggtctctccacttactcttttaaatttcatcctgctggtttcagcccactgtttcaagttattttagaatcttgactttgaaatattagcttttcatcccaacagtggtgccttctgcaaatttggcaagtgtagtgggcactgaccactactaggctgaccagggtctaggagcacagaactagagatacttcctcagcaagctctgcagcaatcggataaccaactggggtgaaggagcacagcagttacatgaatccacctgactgggcagtctctgagatcgatattttcctactagcctcttcaatcgtgagacaatcaatgtctaactggaaacaaggaacactatgtatggcccaaggaattttcctagtggccttctgagtaaataagtaacaaattattgttgatatttttatcattttcgccgcatcttgttctttgtgaagataccacttatttttctaggtgttctcaagcaaggtgttctcaaatccatggtttaatgttatattctagaatagattttgagggaaatgtgcccaggatctcccttttcttcttttttgtcagggtatttgcagctgtccaggactgtggcccctgtccttttcgccgcagctttcatagccacattggcaaaggtccctggatcttatctgcaaaggtctgtcatcaccttgggatttgcagctcattttgaatggctaggtggttaggttttctcttatcttttcttctatttggggtttaatgtcctctaacccctgttttgctgaactcttcccagtctggaagtgcttttcctcgggggagaaagaggaaaatcagagttgagtattctgctttctctgaaaactgccaacctgacatcttcatccccagatggaaccctgtcttctcctttttcctcttgcttgaacataaccagcaatatcttttattgtctgcaccttttccaagtctcagtttatcacggacttcacctttccttccgtctcttgtaccccaccttttaaattttgaacttatcagagagctctctacagagccacactggtttctttggctctccttttctctgcacagggattttcagcaaatgcgatagcctaatttatcccagagcttcctatccctcttgtgccatattgccatcttgtctctaaacttagaatcataacttttttctaacttttcaaatcatttttctgggattatttatttatccaatcatccattcatcccatgcccacatgcccttccttccaaatccaactttctcctttggttcctgtctcatcaacagcaccaggggagtctttccccatcagaaggaaggttgggggagcagctccctggcagctttttcttccagctgagaggaaactgtcattgatgaatgtgaagagtttatcagccactcagcgactagctgggcgagactgtagttaccaggacagggcagtctccagctcagtgcctgctgctctcagagcacgtcaggcagtcagatgtgtgcttccctggggacacgacttccacgagctcatctagcagtctcaccctcaacacctggtttcctccaatttggcagtgtgctgtggtgtaaagcttgcaggatgtggactccaatatacccaggtttgcattctagttttgctatttactagcaagtcacttaaatctttatctctgagcttccatttctctcacttaaaaagtgagaaaaagtggctattatcaggctcatggggtgattgagctgacatatgtatgtacctgtgcatggaaggtttcaaacacaccagcttctgtgctcagcttagcttcatggagtctcacgtgtcacatgttctgggtgaactgttgtttttttccctttctattaaaactgtttcttttggacagggtgtaatgtatgtctttgcccagtgaaccttccttggatgagccatgcatcccactagaaaacagtccagctctgagaagagtgtgggggcggaggacaggaaacagaacagaacagcagaatgtatgtggttctggggctgaccctggacctctaccccttcagatgggcctgtgactcaggcctggctagcgtctcccagacacaccaaatgctttacagatgggtgtgtgtttcaagccagagtcctcctggggatttttgctggagctctccaaagtgattttgctctttctctggaatcacaagctctaagaagccatgtgagtggagctgccagctggcatcttgttgccatgtggagagcccgtcggagagggaaaccagccgaggggtgggaagaccgaatcccgatgcccttgtttgaacccccagattcaccactggccatttttattacttgagccaatgtagccagtttgagttgggcttctgggcatctaactaactgttgagcatacaatgttgatcctttcattattataataaaaccacgagttccctcctctcattaagattcatacttcactcttcgttaaaatctgtgctccgatcatcatgcagaaaaatactgggacgcaatgcatgtgcgtgccatattagaaattccagatttgcagacccatatcagaatctgggctttgctatttaccaccagtcttgggcaaatcaatgaacccttctgagtctcacttttccactactaaaatgggagcagtatttagcttatatggctgttttatgggttggagctaatggcgacatgggcagggcacatggtgagccatcactaaatattactaggtggtaggaacatttatgttatgtcagtagctttgactctgactatgctgaatctatataattcctacactttgttccatgtcacatctcttagctaccatggtatccaggcttatggtggctttgaccaaggagaggagaagaacttgcaggcttttgagaaagatgggagatgaggaggtggacagaaatttcaaagttcgattgggggagatgatggaattagtcttgtttaaaacacttgtgactgcagaactttacacccactttctatttataaatagccctgtctctcagctcagctcctcctgcacaaggcttccgtggaagacaacagacacagagagcagctgccagtgcggcacaaatgtacagagcagaggctgttggggaactggggctgcatgtgggcttggggcggaaggattaaagacgctaggtcaagaaatcttggccgattgcggtggctcatgcctgtaatcccagcactttgggaggctgaggcaggcagatcatgaggtcagaagatcaagaccatcctggctaacatggtgaaaccccatctctactaaaaatacaaaaaattagccgggcgtggtggtgggcacctgtagtcccagctacttgggaggctgaggcaggagaatggcgtgaacccgggaggcggagcttgcagtgagccgagatcgtgccactgccctccagcctgggcgacagagcaagactctgtctcaaaaaaaaaaaaaaaaaaaaagtagggtgtggtggtgcacacctataatccctgttacttgggaggctgaggcaggagaatccttgaacttggggggcggaagttgcggtgacctgagatcacgccattgcactccagctggggtaacaagagcaaaactctgtctcaaaaaaaaaaaaaaaaaaaaaagaaaaaagaaaaaaaaatctcaaggagcccgggcgcggtggctcacgcttataatcccagcactttgggaggccgaggcgggcggatcacctgaggtcaggagtttgagaccagcctgggcaacatggcaaaaccccgtctctactaaaaatacaaaaaattagccggatgtggtggcaggcacctgtgatcccagctactcttgggaggctgaggcaggagaattgcttgaacctgggaggtggaggttgcagtgagccaagattgtgccactgcactccagcctgggcgacagagtgagattctgtatcaaaaaaaaaaaaaaaaaaaaaaagccaggcatcatggcaggtgcctataatcccagctactagggaggctgaggcaggagaatcacttgaacccgggagacggaggttgcagtgagttgggatcgtgccactgcactccagcctgggtgacagagcgagactctgtctcaaaaaaaaaaaaaaaaaaaaaaaaagaaaagagaagaaaagaaatcttaagaaacctgggtcaaaaagcagtattttatcctctgccagaagcctgtgtaggtagaggagagtcatggccatcctctgtaccctggtcaaagatggtagaactccagctttatctactgcctactgccttgagctggcagcaggaagacaagatagaggctgcagcaacagctgagcagagatgatgcctaaaggcgacgggaaagaaagggaggtgacaaattcagaggcgtttctgagaatccagcagtgattttctagaagcagagggaggggtagggaggacacaaactcatctccagggtttctagcttggggaataggggcataatgctgtgtttataatagaatttagagtgcaagtaccaccacaggcttgggaagagggcttgagatgtaactcagtttggggatcctcaaggacattcagtggatattcagtggatacagctaggaggcagctgactttgttcaacacacatctgtggagtctctaccatgtgccagtccctgttctaggtgctcattatatggcagaaatccagctttgaagaaaggttaggacagtaagagatgcaattccacttgcctccaaatgctttagcctttactaacgccgtaactttgcccatattattgtctatacttggaaagtagcccctcccttctaattcttaaaattctaataactatcacataccaaatatttactctatgccagacatggtactaaatctaatactctagggtgggcatggtggctcatccctgtaatcctagcactttgggaggccgaggagggtggatcacctgaggtcaggagtttgagaccagcctgggtaacatggcaaaaccccgtctctactaaaaatacaaaagttagccgggtgtgatggcacgtgcctgtaatcccagctactcaggaggctgaggcatgagaatcacttgaacccaggaggcagaggttgcagtgagccgagatcgagccacttcactccagcctgggcgaaagggcaaaactccgtctcaaaaagaaaagaaaactgtaatgagtattactttgcattctagacatgaggagcctgaggcttaaaatgaccaactttcccaaggtctcacagctagtgacagctagaaattgctgccatcccatcatcctgccacccaagatccccactatcctgacaaagccacaatcggagccgcttcttcatgaagtctctgatctccccaaatggatgtaagctttctctctgtgcatcccatggtgcttggttccggcttctcatgccgtatcctgctttgtagaaccatcatcagagagtgttaaaagagcttcaacgaataccttctttcagggcaccaggcctcactgttgtacatatggtttcacttaatcctccaatactcctagagttttatgttcttgtcattctgcctccctgtcagtggacagtaagcgccaaagaggacagggagattataggcctttgcatcctctgctgcccctcgcacagaactctgcccaagctactcacttaatgactgacagttgcatttataaactctaaatgtgagcccctcagggggaggaaaggcatgagattccagcaaaaagtgagcagtctgaggtgaggcatggttctgttgtttccatcttcaccctctgtcttttttccagccaaaggacactctcaccagtctgatgccagaagggcagggccccggctagatggccagccagagtaggtgcagtgctggcttgtccttatccaacctctggctcttcatgctactctgtgtggaaataaaagcaatacctaatagattttccatggaaatgtggcactgccagggaatagtccattctcttggctgccttggcgaggcagaggctggtgttacaaacttttctttcgtccacgtgtcatcttggagacttggagagaggacaagatttgtttccttatttgctgcctctcaggaagctgctgagtcctgaataacatctgcaggtcacactggtttctcttcctcttcttccactctctcaagtaccaacctctaaccgtattgtggtatggtactgatcggaatctacttaaaaacattctttttcagagttgcaataagatgattccagagcaattacagttttcatgcaaaatctgcttagttccagacaagagatttggtgcccagagtacagaggactctacttagaccaaggcaagatgggctctttgcaattccatcttataatcatgggacactggcgaccagaacacttaactcatgcactggaaggggtctccctaggacctctctctagacagcaaatgtatgaggaagctgtcatatggggaagattggatagaaggaaaactttcactcactttagaaaattaatcctcattcttagccaagatagtctcctgaaaagaagctattttttggccaggcatagtggcttacaccagtaatcccagcactctgggaggcctaggtaggcagatggcttgagtccgggagttcaagaccagcctgggcaacaatatagcaaaccctgtctctactaaaaatacaaaaaaaaattagccagatgtgtgggccgggcgcggtggctcacgcctgtaatcccagcactttgggaggctgagatgggcggatcatgaggtcaggagatcaagaccatcctggctaacacagtgaaaccccgtctctactaaaaatacaaaaaaattagccgggcgtggtggcgggcacctgtagtcccagctacttgggggctgacgcagaatggtgtgaacctgggaggcagaggttgcggtgagccgagatcgtgccactgcactccagcctgggcaacagggcaagactccatctcaaaaaaaaaattagccagatgtggtggcgcacacttgtaatcccagctacttgggaggctgaggtgggagaatcatctgagcttgggaagtggaggctgcagtgagctgagactgcaccactacacttcagtccagcctgggcaaccagagtgagaccctatctcaaaaaaaaaaaaaaaaagaagtgctaatttttggttggtggtaaaagaatctctcactggcaacttcccctccagggcaaaaatcagagtgcaagattctgactcctttcaagtttaaagggaaaaataagatgagagatgaatagaagggggaaaaatataaaatgagatgtcacatgtgactttttcctttaagtcaagatcttgctctgtcacccaggctggagtgcagtggcacaatgatagctcaccgcagcctcaaactcctgggctcaggtttctctggccccagcctcccaagtagctgggactacagatgtgttccaccatgcctggctaatttttttttttttagttttagtagagacaggatctcactatgttgtctaggctggtctcaaactccagaactcaagtgatcctcccaccttagcctcccaaagtgctgggattggctgggcacagtgtttttgagactgtctcaaaaacaaacaaaacaaaacaaaacaaaaaaacacaaaatgctgggattacaggcataagctactgcacccagcacttgtgacttctttaggaaagcctaaacagagctctgaaaaggaggtaagacaaatatctttgtatttaaaaaaacaaaaacaaaaatgccaaaatagaaactaccatgccaccttgggaggcagcctgaatgaacccatccattctgcaaggatgttttagaagcacccagtagaggtgctgacacatagatcagtttcaagaaatgttaccagccaaatgtcttaggagttctactacactgaactaatggtacctctaggaagatttcttctctaggaagaaatccttgccatacagtaacttagcttttcatctatataaaccatcataatagtctagaaaagtaatggtgatcatttctattttcagttgtttccgctatttataattctgcagaggcaagatctgtctttccttatttaagaccattctactctgttgggagcttgttcactgctttgactacaaatgcaggcccactttcctcagatggatggcttacataacatttggtttggctgggcacagtggctcatgcctgtaatcacagcactttgggaggcccaggcagatcatttgaggtcaggagttcaagaccagcctagccaacatggtgaaagcccgtctctactaaaaatacaaaaaaatgagccgcgggtggtgacatgcacctgtaatcccagctacttgggagagtgagaaacgagaattgcttgaacccaggaggtggaggttgcagtgagccgagatcagccactgcaagacagagagagaccttgtctcaaaaacaaacaaacaaacaaacaaacacaaaaacacaatgtggtttactggctacaattttagcattttatagcctccacgaaagaataaaaatgcctcgactggcttcatgtcctggaagaattattaaggaaaaaaaaaaaccttggaatttgatagaccctggtttgaattcagccctgaaaattcctgactatgatttcgagtgagttgcttaattagagtctcacataaaacgaggatgcctatcctaccaaaaaatcatgacaattagaacttctacaacaggcttggcagtcactactaaccaatctgttctcctgtcttgctcccttatctgccacagtaccttaaaatgaccacctacaattactaccacttgaccagctagtttttcttttttctttttttttgagacggagttttgcttgttgcccaggctggagtgcaatggcaccatttttgcccactgcaacctccgcctcccacgttgaggcaattctcctgcctcagcctcttttttttctttgagacagtcttgctctgttgcccaggccggagtacgttggcgcaaccttggctcactgcaacctccacctcctgggtttcagcgattctcctgcttcagtctcctaagtagctggaattataggcatgcgcctccatacctaatttttgtaattttagtagagatggggtttcaccatgttagccaggctggtctcgaactcctggcctcaagtgatctgcccacctcggcctcccaaagttctgggattacaggcgtgagccaccgcacccagtcttttattttaatatacattttaaaggctaagtgaagcagtggaaagggagaaggaaaaaaaaatctgttaactggttgtgatcaactagttgcaatactgctgcacttagaccagccacgaccccactagcttttctataaagcccagtgaggcttttttttttttttttttttttttttttttggctctcagttgacacctaggctggagtgcagtggtgcgaccataggtcagtacagcctcaacctcccaggactcaaccagtcgtcccacttcagcctcctgtgtagctggcactacaggtgcacaccaccaagcctggctaatttttaaatttttgtgttgagaaaaggtctcactatattatccaagcaggctgttttagttggcctgttttaaaggactaaatatatatttttcccccacagattttcaaatcagagagaagtaatgctcctgctgtataaaacatgaacttggtgttggatgtagtttttgtcagttagtttgtactatcattacatgctctgaaggagggagagtttgaaggcacagccctctcacccagttgggactctcagtgacttcacaaagagatggcactagaactgaatctgacagtacagaaacatgtcactggcaagagggggaggacatttctagaataggaaattatagttaagtcaaggtatgctgaggtaacagagatgatggaatatagggcttatgttgaatgtttctttcatcctaaggttgcttttttttttttttgagacagagtttcactcttgttgaccaggcgggagtgcagtggggcaatctcagctcactgcaacctccaccttccgatttcaagcgattctcctgcctcagcctcctgagtagctgggattacaggtgcccgccaccacgcctaatttttgtattagtagagacagggtttcaccatgttggtcaggctggtctcaaattcctgacctcatgatccacccgcctcggcctcccaaattgctgggattactaaggttgcttttttaccctagtatttttataatgatcccccaaagttccaggaaacccataccttctttatttttaagatgcagtttcactcttgttgcctaggctggagtgcaatggcacgatctcagcttaccgcaacctccgcttcctgggttcaagcgattctcatgcctcagcctcccaagtagctgggattacaggcatgtgccaccacgcccagctaattttcctccctttatttctttaaaaaatagagacagggttttaccatgttgcccgggctggtcttgagctcctggactcaagtgatccactgcccccagcccaccccacactcttcttaagtcaaggtttcaatggtcaccacatactctagaggaacagtttgtggcaacttagcttggtaccacaaaggaaaaccagtttcacaagtggcttactagagaacccctacttttctttttcttttttttaagagacagagtctcactctgtcacccagtggcacaatcttgggtcactgcaacctccagctcccaggttcaagcgattctcctgcctcagcctcctgaactacaggtgcgtgccaccatgcccgactaatttttttgtatttttagtagatatattggccaggctggtctccaactcttggcctcaagtgatccacctgcctcagcctcccaaagtgttaggattacaggtatgggccaccacaaccagcctaagttcatattacttactgagttcattatttcttgcatgtgtttctttttttttcttttttttttttttaagagatgggagtttcactcttgttgcccaggctggagtgcaatggcgtgatctcagttcattgcaacctccacctcctgggtttcaagagattctcctgcctcagcctcccgcatagctgggattacaggcatgtgccaccatgcccggctaattttgttatttttagtagagacagggtttcttcatgttggtcaggatggtctcgaattctcgacctcaggtgaaccacctgcctcggcctcccaaagtgctgtgattgcaggcatgagccattgcgcccggtcgcatgtgtttcttaatggcacctacctgcatttcctagcccctgaatatctttagacttttatgttagtagcttatagtaagatattatggaggatcataggtataggactctgactagacctctagcttggatgcagcaagactgaaacagctggactagtattttgagcaatcctaggccttggagaaatttctcagccacccaacttgcacaggaaaaactgaagccttggcgtcctctggtggtagactggttatcagagtcagacatgcttctcaactaggaataggcaagcatgaaagttcacagaagccacaggataaacatggcacattttcccagatcatctttacttaaagattttttgggagaaaaaggtaggcagcaaacatttttatattaaaacaaatgcagatagtaatattgaaatagtatataaaattgacattactttttgagacaaaggaagagacatcaaagacattttaagccgagctcctcatgagcttcctaaaccccaggggagggaagagacccctgcattctcgttctgtctaatattatcagtggggctgttttgacagagaagtctcagaagcagcgaattaagtgcttactcatttggcaatgtcccagtgagttatataaataagtgaaaccacaggctttctcattttagagcattttaacctgctttttagaaggcctgagtaaacagaagctttatgcttgagttgaattttattttctcccaaagtgatttttttcctcctataaatgttaacatgcttaactgagggtatggcatgtgaggtggtcagtgtcctaagacccatgtcgacttgggttggcattaccagacatggagttacaaatatactttccaaggctgtcatcagaaatgcaaaactactcaccttcggcaacaataacaaaaaggaaacaaaacaaaaaactgaagaacaaaagattatatataattagaactgtatggtgtaatttaagcactggcaaatacttggctcttaaagaagggggttactcctgcaggatctgcttttcatattttatgtgaaaacaagaacttcctttgaggaaaaaagtgccattatacttcctttccaaatcttgcttattttctgtaattgtctttttctttgttgttgctgaccctttatcttatttattttttttcaggtagcctcttgaactagagtaggctcagaggctccctgtaggtgacattttattactttgcaataacagactgaaggggcagatcctcacacagactttctagggtaatgtagcaatgtactgtccttttcttgaagtatgagagacaaggtcaatgaaatgtgcttagaagcataatgggagtcagattctggtgcatgctactgacattttagggtctacccaagaaaaagtaattcataacctcccatatagtttaatttagtgattttgttaagttttacaaaattatttctcatttttcttggaattctactcttcattttacaaagccttaaattgagactcaaaaatcacatgacaaagtgcctgtagcttcaggaaaatacaactttttttcccttctggttaagtaaaataagaatttggagcaaaaatatcctaattcagaataactaaagggggagtatcagtggtaagttatgttgtgctggaaaaaagaacaaaaaaggcagacaccaaacacctgaattttcccaagattaaatgattattaaaaaagcgcgccacactgtatagaaatcaacattctctcccataattctgtgcatctgggactacagaaatgtcactgtccctgccccacatcttcaaattaacattttcaggtcacaacaataagtcttcccaaaggggaccttccggaaaaataagctatttcctcggctcatattcccctggaaaacaaaacaaaacaaaacacaaataatatctagcgagatgagatcagccaatccaaatcagcagagaggtccaattgggagacgtgactaaatctaggacaaaactgggactatcactacagaacaaggattagtattctctgaaaggctgagctactatgaactaactacaatttctccttattaagttcttactctgggcagacagaacgcccaggttggattctggctttgccactttccagctggcttagcaaatgagtcatgtagaacagtgcctaacattcagtaagtgctagctttcatttatttctttgtttttcttttttgagatggagtctcgctctgttgcccaggctgtagtgcagtggtgcaatctcggctcactgcaacctctgcctcccaggttcaagcgattctcctgcctcagcctcctaagtagctgggaaaggaacgcgccaccgtgcctggctaatttttgtacttttagtggaggtggggtttcaccatattggccaggctggtctcaaactcctgacctcaagtgatccgcctatcttggcctcccaaaagtgcagggattacgggtgtgatccaccatacccggcctatttatttcttaatgaaatgaaatcatgtttctaaggactacttataaaatcttataatcaaagtaataacaacctggacaacatagtaagaccccatctctacaagaaattaaaaaattaaaggccgggtgtgatggttcacaccggtaatcctagcactttgagagaccaaggcaggaggatcacttgagctcaggaatttgagaccagcctgcacaacatggcaaaaccccgttgctacaaaaaatacaaaaaattgggcagacatggtggctcacgcctgtaatctcagcactttgggaggctgaggcaggcagatcacctgaggtcaggagttcgagaccagcctgactaacatagtgaaaccccatctctactaaaaatacaaaaattagccgggcgtagtggcggacacctgtaatcccagctactcaggaggctgaggcaggggaattgcttgaacctgggaggtgaaggttgcagtgagccaagatcgtgctattgcactctagcctggatgacagagcaagcctccgtctcaaacaaaacaaaacaaaacaaaacaaaaaaacaaacaaacaaaaaacaaaaaacaggggtgaggggggagggatagcattaggagatatacctaatgctaaatgatgagttaatgggtgcagcacaccaacacggcacatgtatacatatgtaacaaacctgcacgttgtgcacatgtaccctaaaacttaaaagtataataataataaaattaaaaaaaacaaaaaacaaaaaacaaaaaaatgagctgggcttagcggtatgtgcctgtagtccaagctacctgggatgctgaggtgggacgatcacttgagccagagacctcagccaggaggcagaggttgcagtgagccaataccatgccactgcactccagcctgggtgacagagtgagaccctgtctcaaaaacaaaacaaaacaaaaaaattaacaggacatggtggaagcatgcctgtagtcctagctacttgggaggctgaggtaggaggattgctttaccccaggagtttgaggctacagtgagttgtgatgccaccactgcacaccagcctgggcgacagagcttgtctctaaaaaataaagaaccaaataagtaaataaaaataaagtaataatgttctgagtgcaactgagtacactctggagtataaatctgagccttcccaaatataggccatgtgaccttgcattatgtaattggcactaaactgctctaagccccagtttcttcatatgtgaaatgggtgattaagaatgacacctattctcacacagctgttttgaggattacatgagctgatgtaagaaaagctcttagcatgatatctggtatacagtaaatgcccaatcaagatttgctgttgttgtaagcacctacaggaacaactgttcctactttaagtgtgtttgacaccgtaatccattctctgtctgctttcttcctataacagagtgttagtcagaaaaggaaggaaggaaaggccattttttccatttaaacagggaccacactgtacaatagagagtaaaactcagaatgaaatgcacaatgttcatagtaggtctgtactgaaatcattcaagtattcaagcttggattcacagaggggctttgtgggcacactaagcaagagcaactacaaacaacacttaggccttttcattcagatttcaaaggcctttctcttatatatcactagtgctataaaataatgcaacaaagagcttctttatacgctttcttctacaatcttttaagaagtggaccccccttcaaaaacagctttaaactgataatcattttaagtgatcctgtgctaaatttagcccacagccaatccatttgttgttgttattgtcttttttttttttttgagatggagtcttgctctgtcacccaggctggagtgcagtggcacaatcttggctcactgcaacctccacctcctgggttaaagcaattctcttccctcagcctccccagtagctgggactacaggcacacgctgctacgcccagctaatttcttttgtattttagtagagatggggtttcactgcgttgcccaggctggtctcaaactcctgacctcaagtgatctgcccgccttggcctcccaaagtgctgggattacacctgtgagccactgcacctggcctgtagttttttgttaagagacacgtctggctgtgttgcccaggctggcctcaaactcctggactcatgtgatcctcctggctcagcctcctgagtaactggaactataggcatgagccaccatacctagccgttattttattttccttttttggatacagggtctcactctgtcacccaggctgaagtgcggtgatgcaatcttggctcactgcagccttgacctcctgggctcaggtgatcctcccaccttagcctcctgggtagctgggactataggtgctatgcctggctaagtttttgtattttctgtagcaatgaggtctcatcatgttgcctcaactggtctcaaactcctaggctcaagcaatttgcccacctagacctctcgaagtgctagaattataagcgtgagccactgcacccagcccattattttattttccaataaagctttgcctagataataaataattttttgttgcagattatacacctcatagtaataacaaaccctaaattggtatctaggcaaaatcatccactaacaagactctagaagtataagaccagctctgtcaataccactgtgacaaataagtggttatgaaaggtgagtttgggggaaaaaaagagtctaaaatcaaggccatcattttaccaggataataatctacctggatcgtatttgtaagttgaatgtgggcactcaaatggcttctaggtctcatctagggattctttcttcttcattactcctgctcatgatttctaaacatcacattttactattatgccaaagtgaaaacacagaacactgtaaagtgtacattaactggcagactagactaactctagctaaagtgagctacaagagttaacttgggattccagagacaatatttaagaaaacaaataaataaaaataaaacaaaataaaatgagagagacagagaaaaagaaatacctctttttgtagcatgcaccaacagtctatccaagacgtatatattggggagtaaggagggcatccaccagcaagactaaaatagaaaaaaacatggagctattcatgttaatattaaccattctcttgagacgttgataaaccttgtcaaaatattctgctgcacagaagattccctgagagatcattttagttcaatgaaacaaatcatattgaagcaggggaacgatcaagcatccaaaagagaattcctcccctatatttaggtttcaaataaataaataaacataaacttcaaccttaatttctaaaacatttagacttttcctttgtggacaaatgaaactccagaacacagcatttacatgattaaagagcagggaaaggtggccgggcacggtggctcacacctgtaattccagcactttgggaggccaaggcaggtggatcatttgaggtcaggagttcaagaccagcctggccaacatggtgaaaccccatctctactgaaaatacaaaaacatgagctggcatggtggcgcatgcctgtaatcccggctacttgggaggctaaggcatgtgaattgcttcaacccaggaggcggaagttgcagtgagccaagattgcactactgcactccagcctgggtgacagagtaagaaccagtctttttttaaaaaaaaaaaaaaaaaaaaagagcagggaaaggagatttaaaaactaactggtgttcacaaagatactaaacatgaaaacggatataaacagtagatatatatgttcctacttaggtataatcacttcatcttgaaaaaactgtaaataataataatacatttaattcatccttcaagtttacactgtgctaaaaaatggcagttgctctacgtatcagaaaacatcacagcttgccaggagtaacatgaaacaaacaaaaccagaaaacaaacaatgtaaaatgttcaaaactccacatagctatctgatcttatttgaaaacagtaacatgtttaatgatatgtcaggtaccatatgggaaaagaattttgaattaaacaaaaaaggcaaggctgggtgcagtggctcacgcctgtaatcccagcactttaggaggtcgaggagggtggaccacttgaggtcaggagttcgagaccagcctggccaacatggtgaaacactgtctctactagaaatacagaaattagccgggggtggtggcaagtgcctataatcccagctactctggaggctgaggcaggagaagtacttgaacccaggaggtggaggatgcagtgaaccaagatcgcgccaccacaatccagcctgagcaacagagcaagactctgtctcaacaataacaacaacaaaaaaatacaaaaaattagccaggcatgctggtgggcacctgtaatcccagctactcaggaggctgaggcaggagaattgcttgaacctgggaggtggaggttgcagtgagtcgagattgcaccactgcactatagcctgggcaacagagtgagactccatctcaaaaaaaaaaaaaaaaaggcaaaattttgcccaactcagtagagtcacttggcatctagaatttggaaatcaatggagtctaccactataccaaaacctgcccttctaaccaatacagagaaaaggtcatcaaactttccatagactaaatatcctaattctggttctttaaaactcactttctccataaagcccctaggaaaaacaggtatggattgtcatttaatccctgatataccttttgtcactttcatagaaaagataaagatttaaaataacaatatgttggctgggcatggtggctcacccctgtaatcccagcactttaagaggctgaggaaggagaatcacttgagcctagaaatttaagaacagcctgggcaacaaagtgagaccctgtgtcttcacaaaaaataattagccaggcatggtggcatgcacatgtactcccaactacttgggaagctgagatgggaggatcccttgagctcaggagttcaaggctgcagtgagctaggacttcaccaccacattgcagccctatctctaaaaaaattaaaaataaataaaaataggccaggtgcagtggctcacgcctttaattccagcgctttggaagtccgaggtaggcagatcaccggaggtcaggagttcaggaccagtctggccaacatagcaagaccccatctctactaaaaatgcaaaaattagcccagcatggtggcacatgcctgtaatcacaacttcttgggaagctgaggcatgagaactgcttgaatccaggaggtgtctgttgcaatggagcgagactgcaccactgcactccagcctgggtgacagagtgagattctgtctcaaaaaacaaaaacaaaaacaaaaacaaaaactataaataataatagtaattggcctggcatggtggttcatgcctgtaatcccagcactttgggagactgaggcgggtggatcacttgaggtcaggagttcgagaccagcctggccaacatggtgaaaccctgtctctaccaaaaatacaaaaatattagctgggcatggtggcgaatgcctgtaatcccagctactcaggaggctgaggcgggacaatcacttgaatccaggaggtggaggtcgcagtgagccgagatcatgctactgcactccagcctgggcaacatagcaagactccatctcaaaaaaaaaaaaaataataataataattaataaataaatacaaattgaggctgctgctgcatagggcatacaaagaaaaaaattaggaatcttctaatggtatcaattatacttttcctccccccctttttaaaaaaataccaatcagagattgatactgatcattcatctttcctaaatttctacaaggctgctccgcctgtcagcatacagtcaaccacctactagaataagaaatacaaagtgcttacccacagttgttgacagccataagattggagacaagcacaaagggataggtcaacatactcgcaaaaaactgtaaaatggaaacaaggcagctgttattagatcattcctagtctttattctcctttcctttaccttaaaggcctagtgccactgcggtgagacactctaacacttgtctcgcttcatcggtaccctggaaagacaacagttacagttttgagcctggagatgcttcttcctcttagcacaccactgcatccaacattttaacaaaaggccagaagaattctctgatcctgagtagctgggactataggcgcacgccaccatacccaactactttttttttttttgagatggagtttccctcttgttgcccacgctggagtgtaatggtgtgatattggctcactgcaacctccgcctcctgggttcaagcgattctcctgcaacctccgcctcctggggttcaagcgattctcctgcctcagcctcccaagtagctgggattacgggcatgcaccaccatgcccagctaattttgtagttttagtagagatgagatttctccaaattggccaaggtggtgtcgaactcccgacctcagcctcccaaagtgctgggattacaggagtgagccaccgcgcctgccccagcttttttttttttttttcacttttgtagaaatggggtcttgctcagttgcccaggctggtcttgaactcttggcctcaagtgatcctccttccttggcctcccgaagtgctgggtttacaggtgtgagccaccatgtctggcctgaacaatattatttcggaggaaaggcacgccccttatgaaagctaagcagtaccaaaccatgcaggatgtgaggcaggggttctgccttactctctttattttcacatgtgagtctgtggttccttcgaaaactgagttattctctctttttttttgagatggagtctcactctgtcgcccaggccgaagtgcagtggcgtgatctcagctcactgcagcctccatctcccaggttccagtgattctcctgcctcagcctcccgagtagctgggattacaggcatgcaccaccacgctcggctaatgttagtatttttagtagagacggggattcatcatgttggccaggctggtctcgaactcctgacctcaggtgatccgcccacctcaccttcccaaagtgctaggattacaggcatgagccatggcgcctggccgaaaactgagttattcttacctttgacaaatataacaaatttcagggagatgtcccagtgagacatctggttatcttaaagcagtgatgacacaagccagatttaaaaggaaaacaaaacaaaacacaactattcctagaaggttaaaaggattttaaaaaactcactcctgtgacagcttgagaataactcttcatttcattcatggtagaaacctaaaataggaaaagagccttaaattaattacctacaacactacaacacatcaatatattcttttttccttttcttttcttttctttttttctttcagacagtgcctcactctgtcacccaggctgaagtgcagtgacctcctgaagcacacatcaccacgcccagctaatttcaaaatattttttaagaaatggtgtctttttttttttgagataagggtctccctatgtttgcccaggctggtctcaaactcctgggctcaagagatcctcccaccttgacctctcaaagtgctgagattataggcataagccactatgcccagctaagagacggtgtcttgctatgttgcctaggctggtttcaaactcctggcttcaggcaaacctcccacctaagcctcctgagtcgctggaatcataggctggagctactgtgccttgctctccatgtcaatatagtctatctctaaattatcagtttgacagcttgaaaattaattttttttttttttttgagacaggatctcatctctcttgttgcccaggctggaggtgcagtgagctgtgatctcacaaccttgacctcctgggctcaagtgaccctcccacttcagcctcccaaagtgttgggattacagcatgagccaccacacctgtctaaaactaattttgaggacaaaaccataaaacactgattattagaataataaggcagtggtcaaaatgatcaacctgattcaatattaacagacaaattcatattatactaaaatgctttagggacgaatgtaaaaggatttcaaatactaaagaaaatgagattgataaccttttcacacatcctagaaatacagtccctggaaaaccacatttatagtatatctaagggacaattcactacctttgttttacacagctagctttctaccagatgcgttgaagaaaatccctctctgtactcaagaggtttacaacatggatttagtcatataccctgtgatgtgttcaatttatcatcatgctatggagctgccgacatacaagaggccccacaactgctgagataagaaagacaacttctagataagactgattctcaaaaggctgaggtttctagaaagcccaatacaggcaccctcttaagtccagattagatgaaaagcccccgatacaccataaagatgtcctgctttcccaggttctctcaagttaagtatcagtaaagaagtgatctctttaaagccctgaagtaacacagggctaagtctcttgggtatactctgtcacatcttacggacttttaacgtgtatcgttctacagtaaacagtatcgttctacagtgaacagtatgctcatttcattagcatttgaaaatttgactgataatttttagctatataattgttcagtctggcatgtagcaaactgtcatcttgtttatttatttattatttattttttgaaatggagtctccttctgtcacccaggctggaatgcagtggcgcgatcttggctcactgcaacctccgcctcctgggttcaagcaattcccctgcctcagcctcccaagtagctgggactataggcacgcaccaccacgcccagctaattttttctgtatttttagtagagacgaggtttcaccatgttggccaggctggtctcgaactcttgatctcaggtgatccgcccacattggcctcccaaagtgctgggattacaggtgtgagccacctcgcccggcccatcttactttaaaagctaatctagctgccagattaaagccaaggtgagcacatctcacgaaggtcacaacctaccccactgtccagtgcataggtattgacgaggtaggccagtgagttacacagccacaaagaaaggatgtcacctagaaggcgaggaacaagacccctacatgaagaaacaataaaaataagaaccaaaaaatgtgatcagtaacatgacaggctcttcagtacaaatgtttgtcaaataattagaggtcacaaaacattctagggaagtaaaaaaggaatcaaacaccagaatccagcccgcatacctagttcattctcgttaacacagctgtacttgaagctgatctccagtgacttttgttcctatgtttaaaatgcaggtcggctataccctcagtggctcaccttactattcataactgtaagcagggaggcaaaagatttgcgaggtgctttgcagaagagacttaaatattgttttgctttgactagcttaaaaaaatgattttgctaagctatctgatattcatatttggcagagcaaaagacgagaaaaattacaaagcaagaatggtcccaagtacagatacagatgagaggcatcaaaaaccacatttctagggtctgggtgacctaggtgaggcagcatggaatagtgggaagagcatttccccacggattgaagaccagcttcaaatgccagctccagcactcagcagcgatgtgacaggcagcagatgaaactctcagagcatcaatgttttttaatctctaaagtgatactaattatagctgtcctgcctatctcacagggtatttatgatattcaaaatccgtatggggagatactctgaaaattaaaaaaaaaaaaacaaaaaacaccatttcggtaatgatgcaaaatttttcctcatagaagaatgagggtagtagtctaagttcttccaaagtaaattcaagccttgcaaaaacttactcttttacggtaaggaaaatacaagttaagatgatttccccatttttcaacatttaatttttctcattttattatctatatagaattgggagtttactacaagggtagaaacttggaattaagtcctttgttaaaaaaagaaattccttatttatttattaattattattatttttttgagacggagtctcactctgtcacccgggctggagtacagtggtgcaatctcagctcactgcaacttccacctcccgggttcatgcaattctcctgcctcagcctcccgagtagctgggattacaggcacacaccaccacacctagaggtggggttttaccatgttggccaggctggtcttgaactcctgacctcaggtgatccaaccgccttggcctctcaaagtgctgggattacaggcgtgagccaccacgcccggcctcaaatgttttaagtatctagaagtaaaggtttgggatctttacaagataattctagtcatatggggcctaaatatgcctttctgcagagaaaaaagaaaaaaaaataaggggcctaaatagaatgtaacgtgaggtaagcccagggagtacgttttccccaaggattaaacaaagactcactattcttactttcagaaaacgtttcccactcatgcaaaaattacacactaatcaacatttactcacgcgaaaaatcctagaatgccctcttcccgatagatggttattatggaatcacaaagtccactacgtacacaagaagaaaaggtaaaatatattaagattcttttggagctataaacaaaataatttcaattatcacattggacaaggtcaaatccacgacctccttccctcacacttttctagcactctctcactctgcaaagatagctaaatttggagatagaagtgaaaatattaactacctaggggtatagtcatatggagtcaggggctctgcaacttactctgaaatcctacgtaggctactaaacctgcctgggtatattttctcccattttattgttttttgtgcagatcaaatgacatcagatacgaatttgttctacaaattgtaagggtatcataaaaatacaaagtagtattattctagtactttggcttcaaaagatctccttgagtatgtgaaaacaaaaatacttaccagtacttggattctctgccaatgaactgtaccatagatctcagagtgatcactgtggaatatagagaaaagatgtttacaactatgttaaggccaggtgcggtggctcacacctgtaatcccagcactttgagaggccgaggtgggcggatcacctgaggtcaggagttcaagactagcctgaccaatatgatgaagccccatctctactaaaaatacaaaaattatccaggcgtggtggcatgcacctgtaatcccagctccttaggaggctgagacaggagtactgcttgaacccggaaggctgaggttgcagtgagccaagattgtgccattgcactccagcctgggcaacaagagtgaaactccgtctcaaaaacaaaaaacaaacaaacaaaaaaaaactatgttaagatagattttgatagccctgggaaaaaaaaagattttccacctaaagacattttgctatctggataaattggataaaagccaaaacaagcaagcaaacaaaaacatgcaggcaaggcattttagtcaactcccacgtcaacctatctaagtggtcaggagagatcaggttataaaagaaaggtcagttgtcaactgcaaacataccatggaagggatgtgtgatgagggtagcagcagaacgagcgatcatctctcgagttgtctagaaacaatcaacacacacttctgaaatctaaacaaatgacactcaaatgcctgtgagaaggaatgtgggtggatatcgtggtataggataagaaagtgaatgacacagccctcctgccctggctggagtcaagaagagtttgaatgggatgtgaaagatctcattcattgtcattttatcatacttttcactcatggatctcaatgttctattatagttacttctcaaaatttctctgcaaagcaggcttctgttgttttctcaattttacaggtaagagaaaaaaataaagaaacaggaaaggtcaccaacaaagtcattaagctgaaataaaaaatatgaggcctttattgagattattaagttgctctcttattggtaagtgattttggagagtctgacatcattctagataaatgacaggctccatttagtctctactcacatttttgggagaagagaacaattttgttttgtgactacaacccagtaactgtgcagtatcttagagctgctgtgtttttcctagtttatctttctactctagggctctgtaaggaagtaataaagaaaattaaattataatctttgcatttaggttctgggattgcaaatgtaagcaggtctaccattggcttttgcattttttttttttttttaggacagtcttgctctgtcacccacgctggagtgcagtggcgcgaactcggttcactgcaagctccgcctcccgggttcacgccattctcctgcctcagcctcccaagtagctgggactacaggcacccgccatcatgcccggctaattttttttctttgtattttttagtagagacggtttcaccgtgttagccaggatggtctcgatctcctgacctcatgatccgcccgcctcggcctcccaaactgctgggattacaggcatgagccaccgtgcctggccggcttttgcatttaaacagtatctttatggtcactgagttttttcttttctttttttttgagacagagtcttgctctgttgcccgggctggagtgcagtggtgcgatctcagcttgctgcaacctccacctcccaggttcaagtgattctcccgcctcagcctcctgagtagctgggattacaggcacacaccaccatgcccagttaattttttttgtatttttagtagagatgggatttcgccatgttggccaagctggttttgaatgcctgacctcgtgatctgcccgcctcagcctcccaaagtgctgggattataggtgtgagccaccacacccggcctagtcactgagttttaagacagccctcaccccttctccaagggcataagatcctatgggactggatgggcaaactaaggaaaatactaattgcatagtaatacatgtatccctgctttttttttttttttgagagggagtctcgctgtctcccaggctggagtgcagtggcgcagtcttggctcactgcaagctccacctcccaggttcacgccatgctcttgcctcagcctcccgagtagctgggactacaggcgcctgccaccatgcccagctaatttttttgtatttttcgtagagacggggtttcaccgtgttagccagggtggtctcaatctcctgacttcgtgatctgcccgcctcggcctcccaaggtgttgggattacaggtgtaagccaccacgcccggccgtatccctgcttttaagcaaactaatttcatgaaaatttacagaaaatagagctaatttatctggtttccagacctttagtaatgtttgttttggaatatatatatatatatatatattttttttttttttttttttttttcttgagatggagtctcactcctgtggcccaggctagagtgcaatggtgcaatcttggctcattacaacctctgcctcccgggttcaagccattctcctgcctcagccccccaagtagctgggattacagacatgcgccaccatgcctggctaatttttgtatttttagtagagacggggtttctccatgttggtcaggctggtctccaactcccaacctcaggtgatccgcccgcctcggcctctcaaagtgctgggattacaggcatgagccactgcgcccagcctttggaatatgtattttggatggctgcatttcctggataattgtgacttcattaatgacaattaagacaatgtgaagacttaagtaataagagaatagttctgaaagccaggcacagaaacacctatggcagcatatgggggtgggaaatgggtgatgaggaacttttcagagtcagaaaaatgtcaaaagagcctttctgcatagatactatccaacatacaaagggcctggtcgctattttaatacttttttctaaagacaaggtcttgctctatcacacaggctggagtatggtggcacaatcatagctcactgcagcctcaacttcctgggcttaagtcatcttctcaccgcagcctctcgagtacctgggactacagatatgtgccaccacacacctagctaatttttctattttttttgtagagaggaagtctcactatgttgcataggctggtctctaactcctggggtcaagtgatcttcctgccttggcctcccaaagtgctgggattacaggcgtgagccaccacacctggcctattttaacacttttattcctgaggttttcaacactattagaagactttcagtattctaaagacggaatgtgtgggcaaaatgagttttcttgaaatgcatctattctgaacagcaagcactgatcctctctctttttaatgttatacatgtagtaaagcccaaattaatttgaaggtttaatttcatttgggaacagacactgaacacacaggcctgatgattctgattccatagttgcaacaccacagtttgatctgggcaaacagcacaggatgtaattcatctcttacctccttgataacgtggtcaaaggaagatgagacttctttctgtacatttccaggtcctaactcctggaaatcaaaatcaaagaaaatagagatcttgatttttttttttttttttttttgagacagagtctcgctctgtcgcccaggctggagtgcagtggcacaatctcggctcactgcaagctccaccgcctgggtacaagtgcttctcctgcctcagcctcccaagtagctaggattacaggtgctcgccaccacgccctgctaatttttgtatttttagtagagacggggtttcaccgtgttagccaggatggtctcgatttcctgacctcgtgatctccacctgcctcggcctcccaaagtgctgggattacaggcatgagccaccatgggcggccgatcttgacggtttttatttcttttgagatagggtctcgctctgtcactcacgcggagtgcagtgatgtgatcatggatcactgcagtcttgacgtcctggactcaagtgatcctctcacctcaacctcccatgtagctgagatacagaggtatgtgccaccaggccccgctaatctttgattttctgtagagaaggggtctatgttgcccaggctggtctcaaactcttagatgcaagtgatcctcccaccttggcctccgaaactgctaggattacaggcatgagccaccatgcccagccatcctgatggtttcaaacagaactgtccaaactggtggccaccccataggacaacactcactgagatgaataggagactgactacttggcttttctccaaaagaggccccaaaagcagtaacaacttgcaagggaaaggccctcatgcttagaaatcagctccaacatacctcacccttgtcactctcctggtaatgctatagaaaaaaagaaaaaggatgattagggttattacagtgtcatgtgaaagaagacataaaatgaaaactctactgacagaaagtaaattagctgaagttttttttaaagtttttgtttttttttttaagctgcaaatcttcagttaacttctactcattaatcaactggaaatatggatctccaagataaacttgttgctaagtttaacatattggtcagttggaagaaaagcaaatggtcatgaaaactcttctttgaaaaaagaaaaggggacaggtgtggttgctcatgcctgtaatcccagcactttaggaggccgaggtgggcagatcacctgaggtcaggagttcaagtctagcctggccaacatggtgaaaccccatctctactaaaaatacaaaaattagcggagcattggggcgcacgcttttaatcccagctcttagggaggctggggcaggagaatcacttgaacccaggaggcagaggttgcagtgagccaagatcacgccactgcactgcagcccaggtgacagagcaagagtccgtctcaagaaaaaaaaaaagaaaagggaaggctgggtgcggtagctcacgcctataatctcagcactttgggaggccaaggcaggtggatcacctgaggttaggaatttgagaccagcctggcctacgtggtgaaactccatctctactaaaagtacaaaaattagctgggcttggtggcgggcgcctgtaatcccagctacttgggaagctgagacaggagaattgcttgaacccggggggtaaagactgcagtgagctgagatcacatcactgcactccagcctgggcaacagagcaagactccatctcagaaaaaaagaaaaggggccgggcatggtgcctcacgcctgtaatcccagcactttgcgtggctgaggcaggcggatcacctgacgtcaggagtttgagaacagcctggctgacatggcgaaaccccctctctactaaaaatacaaaaattagctgggcgtggtggtaggtgcctgtaatcccagctacgtgggaagctggggcaggagaattgcttgaacccggtaggtggaagctgcagtgagccgagaccatgccattgcactccagcctgggcaacaagagtgaaactctgtctcaaaaaaaaacaacaaaaaaacccaaaaaacgaaaagggaacatgcgcagtgactcacgcctgtaatcccaacactttggaaggccgaagagggaggactgcttgagcccaggaattcaagaccagactgggcaacatagtgagactttgtctctaaaaaaataataataaatttaaagaaataattacaaaataagaacaacaacaaaaaagaaaattcaagaactctgtttttttttttttttagatggagtttcactcttgtcacccagctggagtgcaatggtgcaatctcggctcactgctggagtgcaatggttcaatctcagctcactacaacctctacctcccagattcaagcgattctcctgcctcagcctcctgagtagctgggattacatgcgcccaccaccacgcctggctaacatctgtatttttagtagagacagtgtttcaccatgttggccaggctggtctcaaactgctgacctcggctgatccacccgcctcagcctcccaaagtgctgggattacaggcatgagccactgcgcctggccaagaactttcagttttaacagaaaataagtcagtaaaaacatagcccagggttcccacttttctcatggaaaacgcatgaccaataccaaattagggcaagactcttttcttccctgcataaaaggacagagaattgatattaagactgaagagctgaaatcgcctcactttctcctttgtatctgatggtttctaaaacaagcaagaggttttttttttctcttctagagaagagatcatgaatactgccagagcccagagaaaaattcttgcaagaggaattttttgtggcgtattttggaaatagaatgtgagctaggtgaaaataaaattatcaattgagagctccttcttgtgtaaccaccagttttattgttttcttattttttaatgtcagttttattattttctagccatatcagatttcaaaaatagacaacattttctcttgtaaaaagaattgtgtttaaaaaaatcacgggcaagagaacaaatgtgaagataaagcaaagtaatgtattttggccaaattccaggtccttggctagaattaattctaatagcttcaggtctctaaattttcacttgtttctatactttgttatttactccatcgatataattatctaacctgtcttctacatttcctgaatttcattttaattcttgttcagtttacaaaattatttcttgtaaaggttaataattttctcagccctgcatagatccttcttcttgactgtacaagcagctttggatgctaagtgtagtaccaaccctgtaatatttcactggactacatttggaacatattcagggtacctggttacctcaagtttgtcttactttacagttacataaagtaacttagtctcaagcagcactttctctttttctctaagtctatacacaaacctctttggctagatgacaactgcctttccatatgtaaatttcatggaagtaacagcaacaatttcactgagtcccgccgggcgcggtggctcatgcttgtaatcccagcactttgggaggccgaggcgggcggatcacgaggtcaggatattgagaacacggtgaaaccctgtctctactaaaaatacaaaaaattagccgggcgcagtggcgggagcctgtagtcctagctactcaggctgaggcaggagaatgacgtgaacccggcaggcggagtttgcagtgagcccagatcgcgccactacactccagcctgggcgacagagtgagactccatctcaaaaaaaaaaaaaaaaaaaaagaaagtgtttttcaagaggaagaaaggacagggttataaatgtatcttttaaattgctcttgatatttagaacaaactatgcataacaggtaagcaacatctatgggaagattgatttaattttcctcttacctgtaaaactttaccatggaccacagttccaaggactcccgaacacagtcttggagttaagcctgtgaacaacccgcgcctcccatcgatactggcaatgtgctgagctaagaacacaagtcagagatgttgtcaagttctggtcaagagaaatggatatactacaatttcaaagaaacaagctttctatatattttctttcaataacaactcctgcctatcacagtcctcaacgtcatgcaaacccaaataaatcaaaggcacttaccataactaaagagaccaggaagctgacacacttgccgcccaaaaatatttcgtcctattgttggaggaagaggctcatatcccacctttaaaaacaatggaatatatcaatattaaagcaatatttccagaaatgtcttgcttgcaaggtcttgaataaagaacacaatttgggttatttttaaacacaagtaaaaatgcagcataggttttccaaggcaatgatgaagcatcattcttgtaggtttttcttctgttggtaatactgagttcaataaactccaagtttcattttggttcaaattctatgacgtaaaccatgtagctgaaataggctaatatcaaactgaaagaagggaacttttgcgttaggaaagctacagtttactaagggggctcaaaaataccttctaaataaaatctaaggcacattttgtatttgaacaaaactagaagacatccattacgccagcatcagctgcatatttggcaacccagacaaaacactcaaaaggcaaatgcagatatagctggataattcacttaggaaagaattacaagctaacttcatgttagaagaacaggctgtcggtcgggcgcagtggctcatgccttgtaatcccagtactttgggagaccgagggggatggatcacctgaggtcaggagttcgagaccagtctggccaacatggtgaaaccctgtctctactagaactaaaaaattagccgggcgtaggggcgggcgcctgtaatctcagctacttgggaggctgaggcaggagaatcacttgaacccgggaggcagaggttgcagtgagccgagattgtgtcactgcactccagccgaggccgacaacagcgagactccatctcaaaaacaaacaaacaaacgaacaaacaaaaaaacacaggctgtcattaacagctaatgaagtccattttatatagttaatgattaccatggtctttgtacaatatacccaggatttttaacactacagatacttgacagaatgaatgctgtaggacatagttttgattattgttgtgactcttaatctgtcctattaagtaactcctgggctggcgtggtggctcatgcatgtaatcccagcactttgggaggccaaggtgggcggatcacctgaggtcaggagttcaagaccagcctggccaacatggtgaaaccctgtctctactaaaaacacaaaaattagccaggtgtggtggcggacacctgtaatcccagctactcaagaggctaaggcaggacagtcgcttgaacctgggaggcggaggttgcagtgagccgagattgtgccattgcatgccagtctgggtgacaagagcaaaactccatctcaaaaacaacaacaaataaataaacaaataactcctgtctgagctccctgaaagtgctaccaagtaaccatttttatttttatttagttagttatttattttttggagacagagtttcgctcttgtcgcccaggctggagtgcagtggcacgatctaggtcactgcaacctccatctcccaggtttaagccattctcgtacctcagcctcctgagtagctgggattacaggcacccaccaccacacccagctaatttttgtatttttagtagagagggggttttgccatgttggccaggctagtctttaactcctgacctcaggtgaaccgcctgtttcaggctcccaaagtgttgggatttacaggcgtgagccaccgtgcccggcccaagtaactatttttacaactgagcatttgggaatttcaccaaaactcctgggctacttggcaacacatagatgttgtgaaatcagaattaagaatattcaaagtttttggggcaagagctctgaacatcattagaaaaccccgtctcccagagaagtattgagtagtgggttcttttttgttttgttttgtttttttgaggctgagttttgctctgttgcccaggctggagtacaatggcgcgatctcggctcactgcaaccttcacctcccgggttcaagcgattctcctgcctcagcctcccgactagctgggattacgtgcacgcaccaccacacctggctatattttgtatttttagtagagacggggtttcaccatgttggtcagactggtctcaaacatcgacctcgtgatccgctcacctcggcctcccaaagtgctgggaaggcgtgagcgaacgcgcccggccccaagggttcttactatatactgcaacatgctgtcacctccgatgctatctagccccaaatgtgccaattctgttttggatgttacagtacattctaatcagtctttgttctaagtacaaagaatttatttgcaatagcctttaacatatggaatctgaattcacacaggtctactcagcaagaaataatttggattcccaacaactcaagaataagaaatggggccctctctagtgtcttgcctattttttacagaaaagtagacggcgagacaggggttctaaaaactgttccattcctaggcacagtgcatgaggtaattatgtcaactctcagtaaaagcataaaaaaaagaatgacctgcccattacagggatatagcaaaggaactggaaacactaagtctatcacttacttggcctacctgcatgtgaatataaaataccatgtaataattatttgacagtagattagaaactaactcccatgtttaaactcgctaaaactcagcttcactaatttccagctctgacaaatgtgattttcattgtcaggagccacatgggccgctgctggaaagcgctcaatgcatccttccgaaatctgacagagcaaccccttcattaacacttctgaatgagctccttgtgtttctctcagtatctggtgcgaaaacctcggaacagaaaagcagtagtaacagtagcataaaaagaaaaaaaaaaggaataaaaaataaaatgttggttcccacctaacttcacatttgtcttcaactgagtatttcgtgttttgcgtctgagattttggggggagtagtggtgaatgtgaatttcggaggggcgagagggagggttcggaagcctttggtggcgaccggccaggatccacctcagtgacgaagaaccaaagttcagaggatccgccgggcagggcagggccgggtggcggttggctaagggaggagagggcctcaacgctgggcggcgaggcgagggctcggcgaggcccccaagcggggccgcgggactgaggaagctgtccctgcggggaggtaaagggcagcggaggagcagcagcatctcgggagaatgaaaggcccgcaaggctgagccgatcctcaggcgccctgagcagcagcgaccgaacggggcgccgggcggggtagggagcggcgacgcctcatacctggatgagcactttcacgtacatgagcggctgggacaggatggtgagaccggagcccaggagcacctgactggccgcgtccgccatgatggcacccgcgggcggacggacagacagacggagccaccaagcgacccggtgagccggtcctaggtcacgtgccagggccgccggtttcactggcccgcccgcggcgcgcgcgcacgcacgcagcagcacgcgcctctccgcccagtccccgcccccccgtcccgccccgagaaacggcaggcgctcgcgagggggcgctgaggtcggggcggggcttaagggacagaggcgcatgcgttctgccgggggctcgcccttcaccaggaatgacggtttctcttgcacatgcgcttccaggccgcaagtgtccggaaacagaagaatgggagtgtcagtgggggagtgtgaccgtgacggcagaggcaaggtcaga

SEQ ID NO: 129 - DNA, 4603 bp, Homo sapiens
cctaggttgctctgagattagaagtcctctagatctagtagttttcatctaggacaatctgtagttgtgaagatcattcaagatatttttttacttgtctcttatttataatgtaaaatattattatcctttccttcattcattcaattttttttttttagcatattctaggccctggggatgtagctatgaacaaagcacaacaaccatgtccttagagcttatattctcatgcttaagcatatgccagctttattcataaataattatggtatttttcatagattatgaatattatggaaaaaacaaagctaggtgatgagacagagaatagctggggtttgggtggaataggggtcatttaagtagggcagtcaacgaaacccactttgagatgttgtgctgtgtgaattaagatctgaattgatgagaaagaagcagctgtgtgagtatctaaggtaagagcattttgagtaaagggaaaagctaatgaccaaaagtgtagctggtagtagtcaaataacagacggaaagatatgacataataagaaaggaggagaatgatataaaatgagatcagagatgtgggcaggagctggatcaggtaagaaggctctttaggcccatagtaagaaatttgaatattatttgaattataatgagaaggctttatataattctaagtagaaaagtggtttgatccgatttacttgtaaaagctagaaaattactaagctattatggttaagggcaactttaaagaagctcaaaggaaatggttagtttgctgccattttaatttgaaggaacctaatttttgtctttgcataggttttatatacgatataacaatttggtgattttttttctattaaagaatcttctgaatttgaaattgctttttgagaaaggcagtattgggaccaggaataataaactcatctctctaattctccatagcccttctttctctgccctgcccccttctccaccaagggaaaacatgttaaagatttgtcatagtggtaaaggaagataagaataaattggctgaggtgctgtccaccagtttggtgctgatagcttcaaatatatttgagttctgcaccttgcttttgccagtggcatgggttgatggtgatagttgtctgtcttcatcttaactttgactgcacttcctcttgttctgcctctcctttcccccctcttactctctgcttcttgaaatctctcttcacagtttgtatggcttttcccctctgtcttttgacactctgtcttttgctgactatgtagctgtaggtcatctctctctccctttctggctacatgtgttttcctgataccaccttattcccttccatttttttcatttttcctgccttcccttctgtctctctctagttttggctttctgagtcattctttggccgtcattttttcccccactcccctgtctcttctaccgcccgttttcttcttccttccattctttttattccgtacttctgttccttttatctttcttcttctttctctcactttcccaaaatgactaaggagcaacatcaaaactagtgggagagacaaaaggtgccccaccctctaagcacttttttaaaaattgtcatatttcctcttttgtaaatatataggacttttagaaacatttaataactgaaaaatggtttatacattattacattatttgaaatgttcactctagtgagatacatgggataatggcaagatcatggactaattataaatatagccttagatctttagtcatctcttcttttagctgtataacctgaagcaagttatttaacctctgtgagtgtcctcatcttataaaatgaatatacctttttatatttgttttgaaagttaattgagaataccaacactaaacaagaggagagcctggatgcagtggctcacaactgtaaccccagcactttaggaggcctagttgtgaggatcacttgagcctaggagtttgagaccagcccaggcaaatggggaaacctcgtctcttccaaaaaaaaattagccgagggtagtggcgcgtgcctgtggtcctagctacctgggagactgaggcaggagctgaactattaatactcaggagattgaggttgcagtgaggcgtgatcatgccactgcactctagcctgggtgacggagtgagaccctgtctccaaaataaataaataaataacgcattatgttcattattcactaaaaagtgtttttcttcctttttttgctacttggagttgttagcctggagagagaagcaagctggaattataattattattcttaatcagttttgaattattatggagcccattcttgtgaatcaaatctgcagtgcaggtactaagttctagggcaccctggagcacaatattggcttcacagtggtcctgtgttagtcatgtgtgtatacgtatgtacatgtatagttggtaatgatttttgtcatgtaacttgccttttctaacagcctgtggcactaatatcatctgtgatattatctctcaatatacagtttctgacaatcaactatgtaattctttaattggtagataggtgtattgctatataattatccttccagtgagaaatttctttattctttttaatggtggaaatttgtaactgtattacttcaaggaagtttccaaagtacttattcctattattatatttggtcattaaaccctgtgtaattaaaaaattactggttttaggctgggcacagtggctcaaacctgtaatcctagcactttgggaggctgaggtgggtggattgcctgagctcaggagttcaagaccagcctgggcaacatggtgaaaccccgtccctactaaaatacaaaacattagctggtcgtggggtcacgtgtctgtagtcacagctactcaggcggctgagacatgaaaattgcttgaacccgggaggcggaggttgcagtgagctaagatcgcgccactctactccagcttgggcaaccgagtgagactgtctccaaaataataataataataataataataattactggttttaatagtaaggcatagacatatcaaaaatcacattagaggccgggcacggtggctcacacctgtaatcccagcactttgggaggccgaggcaggtggatcaggagttcaagaccagcttggccaacatagtgaaaccccttttctgctaaaaatttaaaaaaaaaaaaaaaaaattagccgggtgtggtggcgggtgcttgtggtggcgggtgcttgtagtcccagctacttgggaggctgaggcagaatcgcttgaacccagaaggcggaggttgcagtgagccaagatggcgccactgcactccagcctgggtgacacagcaagactctgtctcaaaaaaaaaaaaaaaaaaaaaacacattatacatcataaatatatcaaattttactaccaataaaaaagatacatattttttaaaaacatagtaatatgtacatgttgtggaaacattaatttggaaatgaagaaagcataatgaagaaaattaaaatcaccttaatctcagtcttggtgaatttacttcttttttatatgaatatttaaacacactaatatctaatgtatttatatgtaagacaaattgttttacagttttttatcctgtttttcactttattataatgtgactatatttctttaaaattattcaaaagcataattataaacgaatgtataatctttcattgtatggctgtaccataataccttagccatcatgcagtttttgtactgcaggttgtttacaattttttgcaactatacgcaatgctagaatgaacatctttatacctaagtctaatctttgatgacatctttattttagtatcaattctttgaagtggaattactaaattgaagggtttagtatcaacattttaggccaggcgcagtggcaaggtgggaggattgcctgagcccaggagttcaagaccagcctgggcaacatcgcaagaccccatctcaaaaaatgtaaaaaaaaaaaagtatcaacattttaaatattttttgatacctagagataattgatacagaatgcttttagagaagattttaccaatgtaactttagagatatggctttatttttaatatacatggcctagttctgtggatacttttcagactctgacacagggggcatgtagcaaattctacctaatagataaataccatatatctaagaattagagtataataaaaatacttaatacattaatgatgcaacattgatttagaagtacttcaaggcttagtatatatatcctaaggatcaacttacaaatttatgtatcattgtactataaattggtggatattgctggttgatgagatttctatcacaaatctctgtatactaggccaatgcatagcagttagtgctacagaagcattaactattgctgctgctgctacattagtaccactgttactattattttataaagcattataacagagtttgtggcataatgtatctgaggaagttatgaaactttctacctattcttacattcagtctat

SEQ ID NO: 130 - DNA, 187736 bp, Homo sapiens
cagggttataaattaatgcaaaacagacacgttcatgtatccagatcatgtcatccaagaattacattacaacatgggtggagagttggcagtgctcacccaattttgacattcttgagccctgagggtgagagtgagtgtttataggagcttatagaaacttctatgacatccttagtttaaaaaaaaaaaactaaactaaacttcctgtgtgcatgcaaaggacattttatgaccaaagctggaaatcattctttatttttaatactgaggagagtatcttttattattataagaccctgtgtgtttttttattaaactataaatttaaccaattttatgagagacatcaaggtattaaattcttttcagatcgttcccgttgcataagtcaccaactgtttacagtattctgagttattcagtggtataaatttacagcaatttattttattttattttatttttgatatggagttttgctcttgttgcccaggctggagttcaatggtgcgatctcagctcaccacaacctccgcctcccaggttcaagcaatactcctccaagtagctgggattacaggcatgcgccaccacacgcggctaattttgtatttttagtagagacggggtttctccatgttggtcaggctggtctcgaactcctcccgacctcaggtgatccgcctgcctcggcctcccaaagtgctgggattacaggcatgagccaccacacccggactttacagacaatttttaatgggatcttgtggttgaaacagaacttcatagtcatctggcccaagctacccacaagtgcccaagtcctctctactgtgccttctgggtgctgggtcaggataaacagtttctgcctcagctctcctggggctgatccctaagtgacagcaactgctccttctttagtgaccactcatttctttctttttttttttctttagagacagggtctctctccgtcacccaggctggaatgcagcagtgtgatcatagctcactatagcctcaaactcctgggcttaagcaatcctcccaccttagcctcctgagtagctgggaccacaggcacatgccaccacacccagctaattattttattttattttttatttttgtagagacagggtctcactatgtggccaaggctgttcttgaactcctgggctcagccccacaaagtgctgggattatagacgtgacccatcatacccagcccactcattttttttactccggttaaaaagcacttctagcttgagaaaaaactggcttccatgcagttgtcctgggttctggcttctgggatcattctcaaccactgagtctcagcagatggcatgctgggcccttgtatctagggagggcttgcgtcatgtacacatgacatgtgctgggggaggacataaatttcaggatccttaatgaagaaagagtggagggggtgcagctttacaactctacgcccttcacacattctgagattccactcacctcccgaccccaggatcacagcatctgtgccactattgctggtgacagtgtcacatctttcagcaataccgggactaaactaatacctaagcctttcttccctgaggctagtcttcagagactcaaagacaactattatgccctgtctctacctctcctattttctagaccaaaaagcccaggcctttagccattcccctggggtcctggctccagggcccttcactggtggatctcctcaggcatcactcaggttactcactgtccctctcagagtctggcactggaaatgagacacagaactccagtgtgatctatagaacgaggaaagcaaaactatcacctctttttgtttttattctgctttgttttttaagaacgcaggacttctaaatctaatcagtaggacctcatcattttatgtgggttgttttgtatgtcactggttttgtgagagacctgcaccatacatcaaagttatcagactgaggctgaatgaaatccaccagtccaccttaaagacagctatcctgggaatgtgggcaacgtcccacttgcccactgctatagcttatagcaccttacactcacctcttcctacagattatttttgagtaacagcgtgaccatgttgtgcatttagccaagcaaacctttctagcttaggtgaatgagagggagcggccaacgtataaaacaaaatagtaagttcataaaaattacagtgcacaatagtctcagataaaatattaattgttaaacagaattccctgtatgtgacatgttctctttcctaataattttcagttatttcaaactttttactcaagttttttcaagcctccaattaaaggtgctgagctgcaccagtctctgtgacccccagctccaaccttcttcactacaattttgggggtactagcacatgccaggtacagtactcaattataaatatatgatttgtgtatatcgtgtgtgtgtaaaacacttcattttccccatggaaaaatttatccctcaccaccaccctataaagtagagtttgttacctccactttatagatgaaacaacaaggttccaagaagatgttgcataatattctacagatgaaataattaggaaatcaggccgggtgaggtggctcacgcctgtaatcccagcactttgggaggccaaggtgggcggatcactaggtcaggagttcaagaccatcctggctaacacagtgaaaccccatctctactaaaaatacaaaaaattagccaggcgtgatggcaggcagctgtagtcccagctactcgggaggctgaggcaggagaatctcatgtacgtgggaggcagaggttgcggtgagctgagatcttgccactgcactccagcctgggcaacagagtgagactccatctaaaaaaaaaaaaaataggaaatcagatgatttgacccaatgtgtctgtctctaaaggctgaatataatattgctttccccacatatatcatagtgctgctgtcacaggttgagttagctggctctgattttaaatagctaccatttaaatagctaccatttgctgaacatattgttaccacccagccacagtgatattgtttggaaaaaaacatttacaagttcaaggccatgttcaagttgttctttttggcttcagatctaatataccacagcacatcccctcatccctgtgcacttggagggcaggagggtgtcttagtcagtgttgcttccttccaagtcccgagcacagtgctgtgatgtagtcaggactcaatcttgataaacattggtgtaattaacaggtttcaggtccaccaaagaagtatatgctatgctgatcattgcagaagaatcccaaacataatgcaccccattttccagacacaagtgattgggagaaataacgaacttatgttgcgactcatggggagaggttacaaattgatgccaaaatctagtctcacacctgcttttttgctccccccagtaagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaattgtggtggtacatcgattccagtgatttatggtctttccatttcttcttttattaaaaataacccaaatactcctcatttgagatattcagaaatcctaaataaactgaatttcatgatggataaaaatgggaaaaacttcaatagcagcttctgctgaactcatccaaagactttcccaaatgtcctggtatattagtcagctttcactatgttatgctatggtaacaaacaatcccaacatcataggagctttcaccaacatagttttacgtctccctcacatgtggggaccagctgcagctctgctccaagagtcttcttcattctggggtccagagcagcccctatgtgggacaggcaactttcatggcagagaaaaagagcaatggtggaaccaatgagagctcacaaagcttctgtctcagtgcagctgacagcatttctacttgcattccatccaccaacatgagtgacattgacaggtctggagtcaaaggtgtgggatgtacacttctcacatgggaatggactcagcaatgaatattttaattaattaatacagtttacaccacctggtaagtgtccctagcaacagagacataagaggttgagagaaaaatcattagaaagcaaaatgatcaaggctgcagaaagatattcctgatgagtaagatgctcagtgttaaatacttcgagttaaaacaagctgattcttgtaagcaagcatgctgtaaacttttgtaaatgtagcccagagccatagttactcagcataagtagcagtttcacctgcagagtcagtgctggaaagctaggatgtcttacatcctaggttaggatgtcaacagggaattctgcagaagtggatgattgaggatcctctgcctctctctagtattcatatgtgctaccactctcccttactacatgggttttcataggtgaatcccactcttcccccctcccatttgtaaatctacccatttaagcagggttcttagcctaggacccactgatttctagaagagtcatagataaatgttaatagggccatgaaatcatatacacaagttgggtatgcttttgtgtatatggggtgttttttttttcatgaagagaaagactatactttttatcaaattcacagtgacctggacccaagaaatgttaagaacctttattttaagacctaactcaaaagccgtttcaataccatgaggctgtgatcctcaaaactctatccccacttgaatcacccgtggcctgcctgtgttgtctcacctgtctcaaaaaacctcaacattttcaaccgttttttaatgactgaggtataacttacatatgctagagtgcacagctatgaattgtatagtccagtgaatttttacatatgtgtagacccatgtgcccagcacctaaagcgcatagaaaacatttgcagctaacctactggctttttttttttttttttttttgagacagagtctcgctctgtcgcccaggctggagtgcggtggtgcagtctcagctcactgcaacctctgcatcccgggtttaagcaattcccctgcctcagcctcccgagtagctgggattacaggcagctgccaccatgcctggctaattttttgtgtttttaatagagacagggtttcaccatgttggccaggctggtcttgaactcctgacctcgtaatccgcccgccttggcctcccaaagtgctgggattacaggcgtgagccaccgtgcctggccacctgctggctctttcatgtcccctctccaccaatgccatcctcaaaggtcactattatgacttccagcatcatagattagttttgccagttcttttttaacaaaactttattggtaatagttggttttttgttttgttgtattgagacagagtctcactctgtcacccaggctggagtgcagtgatgcgatctcggctcactgcaacctctgcctcccaggttcaagcgattctcctgcctcagtctcccaagtagctgggattacaggtgcatgccactacgcccagctatttttgtattttttagtagagacgaggttttgcaatgttagccaggctgttctcaaactcctgacatcaagtgatccacttgccttggcctcccaaagtgctgggattacagcacccggccttattggtaatagttttgacatatgtttacaacagcacactgttcaagaggaaatctcatcttttcacagcaagcaggttgaatcaccctgagcccacctggggacccaccccaggcctgagagctcctcctgggatggggagaagtgatgagagggggaaatatgaagatgaatgaggtggcttgccagcagctcctcacttttctattaagaaagaaaacagaccagggacggtggctcactcctataatcccagcactttgggaggccaaggcagctggatcacctgaggtcaggagttcaaggccagcctggccaatgtggcaaaacctcgtctctactaaaaatacaataattagccggggatggtagtgggcccctgtaatcccagctactcgggaggctgaggcaggagagtcgcttgaacccgggaggcggaggttgcagtgagctgagattgtaccactgcactccagcctgggtgacagagtgagacttcatgtcaaaaaaaaaaaaaaattgaaaacagcacggggtggcaggggagaagaggtgaaggatggctgacagctaagctggagaggggcacccaggatgggagaaggcagaagctgctgggtgaataaaacaggcagcccctccccagcaaccctagccttgaaccctgggcgatgaggtgggggtggaggggctgggcctcttccatgtccttttgcaggactgccttcccataaggagaggctgggcatcacaatctggctgagaataaaattaaggagtttcggggaaatgctgctgtgaagaaagacttgggcttggaactcccactctgtctttttgggggacaactcctctttggcagggagtagggcagctgcttttctggctcccaaagcccaagggtgaagaaaagtctgctggggaagaagagagtggagcttcctaaaagaactgagacctttgcaagagtgatagaggatgcccctggggaggggggagggggaaatcagcagttcatgggggaagttcaaaccccagagcctccttccaaagtcagtcggcttcctggatttgttaaaatggaatggggagacacggtaaggtgggaagggtgggaggggtggaagtagaggaaggaggaaaggggacactggtggaacttaaataagattttaattgttttttgttttaattttttattctagcaaacagcccactgaacatggcactaaacctctctccttcccaggcaggattacgccaaagggtaggtgtgcttttcattcatcctctcttagtaagtggtgcctgttcagggctggagttaagtttgagcccctctttccacaccgtgtcccttgatacaacagcaagacctggcctgaatagagctgagaaactcgtttaaaacaggcagaagggggctggggcaagggggaccctgtgggaggagaaagagagaagcacagagggaccaggaaggcatgggggggggtgagggagcagctggtgtttctgttcctccaaatatctgggcttcctgctcccccaaccctggagggtggggtgaggatgaaattagatacaaggaactctggggccctctggctgttcaatccaaccctcccatcccccaaaccaccaaaaacaaaaaggaaagaaaacccacaggggcacaagcacacccctaaaactcagaaaactccttggcacacttctcattgatggagatccggagctcttcctcctcgtagtcgtcaaagttactggcatccccagggcctgtgtacttcgggatgaagggagcttccaccttcttctcatagatggcgatccagctggttgtggcgaaccacttgtggttcttgatgtcgccaaccccgttcctgaggtttccgaagcgcttggtgaggtccacctgcagcaggctccgcagcagatgcttgaggtcagagctgagtttggagggaaaccgcaccctcccagagacgatcttctcgtagatctggatgggctggtcggcgtagaagggtgggaagcccacggccatctcatagatgagcacccctagggcccaccagtccacggccttgttgtagcctttgctcaggatgatctcgggggccaggtactctggggtcccgcacaaggtccaagtgcggcccttcacgcgcttggcgaaaccgaagtccgtcacctgcaggtagccctgctggtcgatgaggagattctcgggcttcaggtcgcggtggatgaggtcgagcgagtgtaggtactggacggccaggacgacctgggcggcatagaaacaggcatggggctcgctaaaccttccgacgcgctgtaggcgggagaacatctccccacccggcacgtactccatcaccaggtacaggtaggagttgtccttaaaggagaactggagcttgacgaggaacggaaagtcgatcgcctgcaggatgcgcttctcgttcagtatgtgctcgacctgcttcatcttcaccaccttctgcttgttgaggatcttcatggcgtagtggccgccggtctcctggtgcctcaccagcatcacccgcccgaaggagcccatgcccagcgtcctgagccgttcgaactgatccgagctggcggtgttttgagcggggtttccccatctgtagaggaaatctcctctggctttggctaggaactcgttcacgctctcctcctgctcggtgtccttcttggcgggggcgttgcccatggcggtggcggcggcaggggcgggggtctcgcggcggcggcggcggcggcggcagcggcggagatggcgccccctggggctggctgcgctggctgcggcgctgcgacccccgcccggcctccgcttatattcccagctacatgggaggctgagatgggaggatttcttgagcctgggaggtcaaggcttcagtgagccaagatcacgccgctgcactcaacaatatggataaatccaaaaggcattatgcaagtgagagaagccaactctaaaggagacttactgtatgaatccatttctatgacattccagaaaaggcaaaactatagtgtgagagaacagatcagtgattgccagggcttggggttaggggacggttggactatgaagggacagcctgagggaatgtgggaagtggtgggacatgtttgtatcctgattgtgctggtggttacaatgtattgggtggtggtctacatttgttttaaaactcatagaactggccgggcgcagtggctaaagcctgtaatcccaacactttgggaggccgaggcgggcggatcacaaggtcaggagttcgaaaccagcctgaccaccatagtgaaaccccgtctctactaaaaatacaaaaaaattagccaggcgtggtggcgcatgcctgtaatcccagctactcgggaggctgaggcaggagaattgcttgaacctgggaggcagaggttgcagtgagcagagatcgtgccactgcacaccagcctgggcaataagagtgaaactccatctcaaaaacaaacaaacaaacaaacaaacacctcaaagaactgtatacttccccccaaaattcagttttactgcatgtaatgttttattttaacacatacatatgatttcctttcttctgtttgctttgggtttaattgctcttatttcctaaggtgggaactaaggtcactgatttgaaatctttcttctattacaatcacttagtgctataaatttcctcctaagtattattttttgcagcatcccacaaattttggtatgttgtattttccttttcatccagctcaaaatattttctaagctcccttttcatcttctttgacagataagctatttaaaagtatattatttcgtttccaaatacttggggatttttcaagaattttcctattgatttctgatttaattccattgttagaaaacatactctgtgtgacctaaaatgttttacacttcttggggctcattttatggcccagaatatgatctatcttggtagatggcccatatgcacttgagaagaatgtatattctggtgtattctgctgtttgaggatacagtgttctacaaatgtcacttaggtcaagttggctagtagtagtgttcaggtcttctatattcttattgactttctgtttacttattctatcaattattaaaaacatgccacaggagtttatgagaagtcaaagtacatagatgatgggccttccatcactcccccaggccaccatgtcagccgccccacacaccctccagaagactgccagcactcagccatcacagggtgggttctgagctgctctccccagtcaattctgtacaaagattctgtcctacatcataaacactgagctacaggaatacccatttatcctcctattttctctccatcttgccctttaagtttgacagctaattctgcctacccaccctggctacaccgcctgtagctagtgcaagtaaacaacacactttcacctagccctgcaggctgaaaccaagcaaattggagaggaatccctgattacttgactccaagtagaaggtttctattgtgactgtgaattcttgccgctcagttcagcagatgttggtcaagcaggtgtctattgtgtgcaaggcctggttccgagtttacggtttaatctggggccagtacttgggtactgactgtatattcagagacggtcaggttagagaggaagaagaggaaaggagaaaaatctactgttgatcatctgaacttccacaaaagggaaacccacattccctcaagaacatagcaggggggtcaattgccccttgtgctttgggtcaaggcaaatccctggcagatggaaattccacgtctcccccataatctcagtgatttcctcttcattttcatcacagtagatctgctaaaattctgcccatttctgacttacctccagattattcagtagaaatttatacacaaagagcaattagtgggaagccattctcttggaccgacgccttggaagtgggacagtttgtttagaagcaggctgtgccattccatgacaaattcttgtggcattaatctctgaagttcaattaggaagacacaggggtctagagggaacatatgctgcacactagaaatgtccccatgcttcgtttacaggtcagaacatcaagtatttatcccagaacaagctgcagaataattacatttgttatttctctccactttccgttctgcttttctccatggccttggggagcaagggagtccttagcatgccaaggaaacaggaatccttttgcattcagataaaccctttcagaaggaaaagatttgtgtagcaagatacaatacctctgcatgatctgcttggagcttgcctagggggccaaatgaagaggtgaaagccaactctgctttcctgtatgcccaatgaaaggcaatcaagaccattcttctcccaaaaaactgctcactggcagtcatgccagctgattctcctctttactgtttatatagcagtttccaaatggctaattgcataaggcttggatcattcaattctaacttcctctctatctccaaaatattgatgggagcaaagaaaagaacaaactccaccaggattcaaataagaaataaactacaaatctctatcactcagggaattatttacataacactgcatgttctggtccagaaatacttatcatacctggattttgacaagccagcttctattaatagtttgttttctccttattagcagaatattgtaaaagaacatttttgaacacaaagtttctatgtcagatttatgatctataaaatgctgatttaaaaattggcgtggcctttgttatatgaaagatgaaaaattatgggagtcaggaagttcagaaataacttaatgacaataatttataaagtactacatttatttaaagtttgggcaatcattcatcccttggtaccactaattttgccacaattttttttttctttttttttgagaccgagttttgctcttgttgcccgggctagaatgcaatggcacgatctcggctcaccgcaacctccacctcccgggttcaagcaattctcctgcctcagcctcccgagtagctgggattacaggcatgtgccaccatgcccagctaattttgtatttttagtagagacggggtttctccatgttggccaggctggtctcgaactcgcggcctcaggtgatctgcctgcctcggcctcccaaagtgctaggattacaggcgtgagccaccgtgcccggccaccataatatttatagaagtggcttgacacacatgataatgagcattgtaatgtttttgggacctgaaaagaaagtagtcctagaaataggcccaacttgcttacctaaaaatatatcttctgacatataagaactgccaaaagtgattacccctagggaatagcactaggaacttagagaagcataaattaaaggaaggaaaatttttacttctcactttataagcttctgaattgctaaaattaattttgagcatgaattactttacttattaaaataaaaatgaggtaaaacattggtttctcacaaatgcatttacttatattttatatgtcacttttatatactgtttaaatccacaaaagggagacaatttttataaaattattttccccatattttgtagttctccttcgtttcctggcaatagcactctgttttatctttgagggattacttctacctcatttcatctgattctgttgggttcccaatctaacccactcacctgagtcaaagtcagggatggccacaggacccaagatagatcgatcagtttatgtctctcaggaattgaatcttgagcagagacacagggggatttgaggcatttgtaaaggagccatccaaatacagcatcttagaaggctgtccatgtttctacagctgttggccaataagttccttgccttctgtcctgagccctggtttttcagttcttcctttatgtgtctttccacataaaggaagcaaagctttttttttaagcaaagcaaatgggacaaggcgggggtggggaagagaaagaaagaaacaaatttattgaagacaataatgaattcaggattgaacacattgagttcataggtccttaagacattcaggtagagatgtctaattagccaatggaaatctgggattgaacttagtagacagataagcactggcagcacagatttaagtggtatgagagtgttagccaaggaacgtgagccgagagagaacagagtcaaggagggggattgtgggaaactccactatctgaggatgggggtaggaatgtcaggcactgctatttgcccaccatggctgtgtcttgtgaggcctgccgtactcagtccttctgagaccttgaagagaatttcttgtgcacacctacacaagaagtgggcattgtcacatggttgcaatgtgactgcacatgtataatgcctagtaattatcatgcaacatacagacagtacagccgagtggctgaatgggaaactgtacccaggacaagatgttagatacagataatatggactgcgacaggagcttcggcactcatgtaaagtataatggcatatgagtttcttggtgacctcttctgctatcactgtaacagcctacatttcatgatgaagagttgaggccctcaagagaaacagaacaggagagcgcttgatgatttcctctgaaatctcatctgcagcacttaacatgtgtgatacagcacacctgccaattaacagaaggccctaggtggagcagaacattcacaacatccttctgccaaaatatgccctataatcagagctcacaaaccgatgcacatcaaaagcagtggttcttaattttaactgcacattgaaatcacctgagacattaaaaaaaaaagaatactgggttgggcatggtggctcacgcctgtattcccaacactttgggaggccgaggcagggagctcacttgaggtcaggagttcgagaccagcctggccaaaatggtgaaaccccgtctctactaaaaatacaaaagttagccgggtgtggcggcaggcacctgtaatcccagctacttaggagactgaggcaggagaatcacttgaacccgggagccggaggttgcagtgagccaaaattgcgccactgcactccagcctgggtgacagagcaagactctgtctaaaaaaaaaaaaaaaaaaaaaaaaaaaaatactgatgactgaatctgcctccagagattgacttaactgcccaggcatgtgacttgaacgttgggacttttaaaagctccccaggtgattctaatgcacagccgagttttagaaccattggatgagcccatgaacacattttgtttaacccaatatagttataggcctaacagagtatttcaaattttaataattgttttctcaatgtaaagagtcgtcagtttcatataccccagatcatccagatttcagtctcctgttgtaatatttgtgcacagtaggcctacgtttccacaggacaccattcagctatgctgagttgctactgcacctatgtaagcattttctctgcacttcacagcccttcctgccccacccaactatcaccactgcacagagctaatgacagttgctgcttatcatcctgttggctctgtgggtttttttttttttttttacattagcgttaaaagtaaaatagtgcttatgccatgtctccagcagagcaagaaagaaaaaggcagcccaggaaggctaagtgttccatagggcactcatttctggcacctgcctggcccctgcagcatttgggtgcatgcccttgatttaaatcgattaatgttttcccagaaggagccccaaaatgctttatagcctatagaacaaagagctgagaagtgagaggtcccaattcaattatcttaataattagagagctcttgaagacaaaagaaagctatacaaatacagcaaggaaaagggggtatccagtgaccagttccataattcaggaaatgcaggagatttgaagagtttgtatgcattataagggacaaagagggctggagctgaacctgaactgtgagggatggaagtgcctaacctggagttaaaaaagaataagaagattgcaaccctaggggtaaactgcagacctttcagaactgcagaaccccaggagctagggcccaatgcatccaagcttgagtctgtttgagaatctccctttttcagcctctccaacactgtactagatgaggacatctggcctctgggtctgtacatactgtcccctctgctatgctctttcctccttgccctctttcacctggccaactcttcatctctctgatctcagaaactcatgctgtcaccacccccaccaagtcaagaccaggccactctcatatgctcctgtagtatcctataattaccccatctagcacttatgtgactttgtaaatacttttacgttatcatctctctccgcaagactgtgagctccatgagaacatgttgattatcaatctttgttaccactatatcatcagcaaccacagtgcctggaactgtggacgctcaacaaacaatgatggatggatgccgggcgcggtggtggctcatgcctgtaattccagcactttgggaggctgaggcgggcagatcatgaggtcaagagatcgagaccatcctggccaacatggtgaaaccccatctctactaaaaatacaaaaattagccgggcgtggtggtgcacgtctgtagtcccagctactgcggaggctaaggcaggagaattgcttgaatccaggaggtggaggttgcagtgagccaagatcgcgccactgcactccagcctggaaacagagcaagactccgtctcacaacaacaacaacaacaacaaaaacaatgatggatgggtttgtaaaccaaaactaaaattcaaagccccccaactgactaaatggacccccctcttagccaaggggagtccaaagaaacctgcaaaactagttcaggccactccaggaaggggtaggggtcagacatgcctcattataccctctcccttttgtagtttgtaaccgcccaatgggatcaccttgcccaatgcctagacagagccgatttatcaagacaggggaatcgcaatagagaaagagtaattcacacagagccagatgtatgggagactagagttttattagtactcaaatcagtctccctaagaatcggggatcagagtatttaaggataatttggtgggcacaggccagtgagtcgggagtgctgattggtcaggtcagagatgaaatcagggaatcaaaggtgtcctcttgtgcggagtcagttcctgctggggggtacacaagatcagatgagccagttgattggtctgggtggtgccagctgatccactgagtgcagggtctgcaaaatatctcaagccctgatcttagattttacaatagtgatgttatccccaggagcaatttggggaggttcagaatctggccgccttcagttgcatgactcctaaaccataatttctaatcttgtggctaatgtgttggttctgtaaaggcagtctagtccccaggcaggaagggggtttgttttgggaaagggctgttatcgtccttgtttcaaagttaaactataaactaagttcctcccaaagttagttccagaatatgtttccttgctatattttgaaatggccctgcaaagctttcttttgtgggggagaatttacatctgtaaaaaaatcttttttttttttttttgagacagagtctcactttgtcgcccaggttggagtgcagtggcgcaatctcggctcactgcaacctctgcctcccaggttcaagcgcttctcctgcctcagcctcccgagtaggtgggactacaggtgcatgccaccacgcccggctaatttttttttcttttttgtatttttagtagaggcgggttttcaccctgttagccaggatggtcttgatctcctgaccttgtgatccaccttcctcggcctcccaaagtgctgggattacaggcatgagccactgtgcccggcccaaaaatctcttttaacataagtggatctttccttttccaggccctccaaatccctgaagagattaactgagagtctaatacctaccttttaaaggtctgcataggaaatatttgcatctataatctctaagctacctatgagacttgatctatacaataagaaccttggtctccacaaccccttatcttaacccagacactcctttctattgcttccaggtcttcagataataacttaactctcaaccaattgccaatcaggaaattgttgaatccacctatgacctgcaagcactctgcccttcaagttgtcacacctttctggaccaaaccaatgtacacctcacatgtatacatgtattgattgatgtcttaatgtctccctaaaacatataaaaccaagctgtggccaggcgtagtggctcacgcctgtaatcccagcactttgggaggctgaggtgggtggatcacaggttcaggagatcgagaccatcctggctaacacggtgaaaccccgtttctacgaaaaatacaaaaacaaaacaaaacaaaaaaaacttagccaggcgtggtggcggtccactcccagctacttaggaggctgaggcaggagaatggcgtgaacccgggaggcagagcttgcagtgagccagtgagccgagatggcgccactgcactccagcctgggcaacagagcgagactctgtctcaaaaaaaaaaaaacaagctgtaacccaaccatcttgggcacatattctcaggaccttttgagactgtgccttcgggccatgttcactcatatttgcctcagaataaaactctttaaatattttatagagtttggcttttttccttgacaggttgatgagtaagtgggtggaagaacagagtgggtgaacagagcaaacatgataaatggaagaaaggacctgaggttaaggaactggagattgtaatcagaaagcaggatcctatagttgaagatatctgagaaagaacaatttaaaatggcaataaagtccaaagtacagatacgaatatcagctggggtccagcctcacaaacaaaacctaggtccggcaattcacagagataatctaatgcagggaatttgttgcaaaggtgatggaaggactgaaagagctaccagggagaattagacaaactcaaaattaagaaatgcagaaaagttgcatttaccataactacgcatagaggaacagaaggaaaaaggtgttaacacagccccggagctgagactgaaaccacagtggtctgtccagcaagaggcggagccatggaggaaacccaatcactgctggaaatggtgcctgaagggaatggcgggaggagaaaaggagggcagaaatacctgcctcctctctgccacccacctgccagtctcccacaggcgcctctcgttggctgaacctctcttgaaacaaattggcaaagcagtttaggaaacgtaatttgcatggatcaggtttccttgaaagaaacagatgaggagaagagaatggatgtaacagcaaataggcaaacaagcaacccaagatgagaatggcttgctgaagctttatgagaagtgaaaagtggattccaggaactgtgaaatggtgaaatggcatatgccatccctgtggatactgtaatcactatttgatgccccagaggggaaagggagaaaggactgtggccagagccaaggaactcaatgaatgtcaatgtttaggaatgactgaaggacaagagatgaaatgaaaggaaaagggtgttagtgttatgtcccaagcctggtctggaaagagcaagggagaggtagaatagcagcacagttaaaaggcccaagtttgagtcccagcttggacacttattagctggaggatttggaaaggtgaattagcctctgagccttggtgtataaaatggagataataatagtaccctcagtaaggctattagagttaaacaagagtgtatataaagcacttcccacagtgcctaacaacagcaatcatagcagagcacattcaatctacattctcaactctagggcatgagaaaaaggctttctccaaggttctcgctcagggttcctcgtgaggttgtagtcagctgtcagtcagagctgcagtcatctgaggcaagaggacccacttccagctcactcatgtggttgctggcaagcctcacgtccttgctggctttgggctgtgtactggaggtcctcaccaggggcctctccatagattctgacagcatggcaaccagctcccacatagcaagtgatctgagagagagagagagagagccgcagtcatctataacctgatcttagacaggagagactatcagctgggtcatctactactggtcacacagaccaaccctggtacactgtgggagggactacacaagggatggaatcccaagaggtgagggaccttttggaagctggctactacacctcttctccctcttccttgttttttctccataccgctgatgaccagctaacacattgttttttgagacacggcctcactctgttgtccaggctggagtagcagtggcaccatcacagttcatcatagccttgacctcccaggctcaagtgatcctcccacctcagcctcctgagtagctgggactacaggcacatgccactaagcctggctaattttttattttttatagagatatatgttgcccaggctggtcttgaactcctgagctcaagtgatccttctgcctcagcctcccaaagtgctgagattgcaggtgtgaggcacccggcttctaacacattgtttaccttattttgttatcatcagtgtccctacaatagaacataagaagcaagggatgtttgcctgtcttgttcactgctgtataatcggcacctagaacagtgcctgacacacagtagggcttcattaatatttgttaaatggtgagtgatgtgccaccataagaaattagcctgggccaggtgtgatgtctcacgcctgtaatcctaacactttaggaggctgaggtgggtggatcacctgaggtcaggagttcgagaccagcctggctaatatggtgaaaccctgtctctactaaaaatacaaaaaattagctgggtgtggtagcgggcacccatagtctcagctactcgggaggctgaggcaggagactcgcttgaacccgggagatggaggttgccatgagctgagatcgcaccattgcactccagcctgggcaacaagagtgaaacttcatctcaaaaaaaaaaaaaaaattagcctgagttctctcagaatatcatagcataagtcctgttcccactttctaaaaacgtttgtacttgattctcacaatctaggaggaaaacatggcagtgtttgtatccccatttcatccatgaggaaactaaaatccagggaagttcaggtcttcttgcccagggtcgaccaatggtatggtgggtctaggacaggtggccctttcttttgcatacagcctccccctgatgccccataactcccacctcatcccaccgggtgccctgctgcctggtgcagcatttagcattactggcaagtcacaatcatcacagatgagcgaagttcatagagctttcattcagcgaagccaggcaggatgggatgaaagaggggagccaagaagcctggagagaagacaccatgtgaatgctctggcctgattctcctttccctgcaaccagtgactctccactatgcaacagtgtcaggctcagagactcaagcccagtctgcctgttagtgttctataataagcagggaatgggtcaggcatggtggctcacacctgtaatcctatcactttgggaggctgaggtgggtggatctcctgaggtccggagttcgagaccaggctggcgaacatggcaaaaccctgtctcttctaaaaattcaaaaatcagccaggcgtggtggcgtgcacctgtaatcccagctactcaggaggctgaggcaagagaattgcttgaacctagggggcggaggttgcagtgagccaagatcgcaccacttcactccagcctaggtgaaacagcaaaactccaactcaaaaaaaaaaaaaaaagcagggaatggagagcaagcaattatcccccacagatgggagacggctgtgcccccgccttagactgaatcactctgaaaccccaaaataaccctttccagagtcccaggcccccagacatagacgttctctgttggacaatgcagtcccacagacggatctaggctgttcttaaagtggttttccaagtaaaggcacttgtctccccgtgaggcgagggccatcaaagctccttttccctcaacgcctaccaagccacaacctattttaacaacacacacataaattagctcagttcatcaacaagatcacctctgaatagtagatgtagaaggttgaaggatagcaacaaagatgctagttatactttcacgtggaattcctgaccctatattctggtaccatattgcctaaggcaagagacaaggcaagacgggttcctccagcaaggggcacatcaggtccctgagcactggaagaaagtagtgatggtgttgatacttgcatcaggtcagaggcagagaagagaactggcctgcagtgatggccaagggtgaaggtaggggtactggctcccctcttctcccctaactcttgtcaaggccacccactcctctgtcctgcctagaatgtgaagggaggcacccagctcagctgcagggtcctgacttcccggtgatctgcactagcctgcagtcccctgaaagcccagacctggatgtgtgtgcctggccaccaaagtggccccggggtgccctctgtgaccacaggtgtataaacatgcctcttaaaagacaccatgaccaaccatgaggccaagtgtggggctagcattcgctgatgtctgtgttttgcacatactaattcacttcatcctcatggaaatctctgaggtaaagaagtatttgctttaatttacagatgaagaaactgaaactcaggttaaaaatagaccaaggacacacaggtagttgaggggcagagcagggatttgaacactgttatgaaaattatctaaaacttggaagtaaggcaaaaagattgctttgaatatttaattcaaagttagaccagaatagtggttctcaaccaggggcaattttactccttaggggaccttttcacaatgtctggagacatttttgattgtcactattgaatgggagagcagatactactgccatctagtgggtggagaccaagaatgctgctaaaccaccttacaatgcatgggacaaccaccacgacagagttagccatgtgttgcttaacaacagggatacattctgggaaatgcatcattaggtgattttgtgatcttgcgaacatcatagagtgtacttacacaaagctagatggtctagcctactatacgcctaggctatacagtctagcctactgctcctaggctataaacctgtacagcatgttaccatactgaatactatagtcaattgtactacagtagttaagtatttatgtatctaacatatctaagcacagagaaagtacagtaaaaaaatataatcttaggggaccattatcacatatgtggtccatcactgactgaaacagcattatgcagcacatgactataatcagtagaaacatcagtaaatagtcaccattgagaaactctgttccagcacagtgtgactatgctcgacttattatttgccattaattaggtctcaaggatgtcaatttttagaagacaataaacaaaaaaattaaaataaaaaaataaacagcaagcacagtagctgatgcttttaatcccaaaactttgggaggccaaggcagcctggccaacatgatgaaacctcgtctctactaaaaatacaaatattagccaggcttggtggcacatgcctgtaatctcagctactcaggaggctaaggcagaagaattgcttgaacctgggaggcggaggttgcagtgagccgagatcacgccattgcactccagcctgggtgacaaaactccgtctcaaaataaataaataaacaaaagagaaaagaatgtcagcttgtagaaaactggtaagatgcaaatgactcttgtctaagaaagtaaccccaaagactatagttttatagacctgaaggacactacccagttgtgtatctcacttagcaatcttacgccagaatgctctttttatcactgactattatagatcagtttcttccagcttcctttaaaccagtttgccttcctgctggctccctcttgtattttgctagggctgccataacaaaataccacagactggctggcttaaaccacagaaatctattttctcagagttctggataatggaagttcaagatcaaggtgctggcagggttggtttcctctgaggcctctccctgtggcttgcagggggccgccctcttgctgcctcttcctgtggtcttttctctgtgcacatgtgttcctggtgtttctttctcattttataaagacaccactcctttcacattaggacctacacttgagacctcatttaaccttaattactttttttttttttgagacggagtcttgctctgtcgccagactggagtgcagtggcgcgatctcagctcactgcaacctccgcctcctgggttcaagtgattctactgcctcagcctcctgagtagctgggattacaggcatccgccaccatgcccagctaattttttttttctttgtatttttagttgagacggggtttcaccatgttggccaggctggtctcgaactcctgacctcaagtgatccacctgcctcggcctcccaaagtgctgggattacaggcatgagccaccatgcctggccaaccttaattacttctttaaaggctttatctccaaatatagtcatattctgagtgtcctggcagttaaaatttcaacctatggactttgggagaacacacttcagtacctaaaactccactaattatttaatctttgatgcatgctcactacaaatttgcatgagaattgtttttaactttttgaaaattatgctttgcaaatacatttgtctaagcccacaaagtctacttgtttctactatactatacttcttgcatgctggacagatagagccaattcactgagacagcagtattgcagtaaagaaacagtttaattaaggcaagggctggccacatgaaagacaagagttcattattcaaatcagtttctctgagaactcagaggctagggtttttatggataagttggcaggcagggagttagggaatgggtgctgctgattggggataaaagcatggcaaacaatcctcatgtgctgagtccaccatagggtgggggccacaggactggctgagtcatgagtcgtgagtccaagtgaagtcagttggtgcccagaatgcacagttctgaaaatcatctcaaaagacgaatcttgggttctacaatagtgatgttatttacaagagcaaacggggaagtcacaaatcttgtgacctccagcatagattatagaaaggcaagctattcctacatcttagcagaattcagacccctcccataatcctaatcttgtggcctttcattagttttacaaaggcagtttcagtccccgaaaaaggaggggctcagttttagggagggactattatcattcttgcttcaaagtgaaactatacactaaattcctcccacagttagcttggcgtggcctttgttatatgcccaggaataagtgaggacagccagcctatgagactagaagcaagatggagtcagccaagctaaatttctctcactgtcataacctttacaaaggtggtttcattaggcatattaatgcaaattccttagttaaaacaagaatgactctctaaaggctatatttcagatacatcacatgcttctttcctcttgtcccctcaacagtaagcaagaagagtatttttgtacaagagagaggcctctgcctgaagctcccttaatctgtcagatcacagatcaaaagctatcacacactgcccaagggaccctaaagggagccactctcagaaaataaatccaaacctccttttttctggccactgaaacgttcaataattagttcattatctacatcattcacatgtttaatatttattgactttggaattattgattactttgctgagtatcttatgaatttaatctatattaatattaaggtgatgtatcaaattgcattccagagtgtggatttgactctagtgccataatcagtctcctgggacaaacagctgtttctcttccctcattatagaaaaaaattgcccttggcaaatgtcaaagaacatccttttatcaatctctcttaccaatcaatccaagcaaatgcagtgggatttcttttccccagagttgaagtcacctcctgacaggaagttaagtctttaggcactgaatcatagcactgagctgaagcccaggactaagcaagaatgagtgagaatttggagacttaaggtttggtcatctgtagaggattgggttttgtcttgttttgtttttgttttggtgtcctgcaaggtttctcactgcccttcatcaggtaatatgccctgtccctgaactggccaattgtgttaccccattcccttagcaacagtgattgctactgaagaaacaggaggccaacaaagaatatcactcattcaccagtagagtgtctatgtcagagatattagataaacaggaaaactaacaattacattgcaggctgtggaaacagagagaggtacctaaggcacacctgtgggaatatgaaagtttggtttcataaaaggattctggaggaagtcacctctgacatttgagttgagtcctacaggatatgaagaaagtagccccatgttccggttactatggctgtgtaataaattacctaaaacatactggattaaagctatgaaaacatcttttctgcccagagattctgtgggcctgaaattcacatggaacacataaggcataccttgtttctgctccatgatgtctaaggattcagctggaagactgggaggctgggggctggaatttatctgaagaatgactcatttacatgtctactggttgaccctggctgttggctgagggggcctcagctctctctacattgtttctctactttggctagtttggatttcctcaaaacatgatggctggtcctcagtgtcagcatcccaaaaagagaatgccggacacagtggctcacacctgtaacctcagcaatttgggaggctgaggtgggaggttgcttgagttcaggagttcaagaccagcctgggcaacatagtgagactctgtctctaccaaaaatttttaaaattttaaaaatcagccaggtgtggttatgcacacctatagtcccagttacttaggaggctgaggcaggaggatcacttgattccaggaggtcaaggctgctgtgagctatgaccacaccactgcatttcagcctgggtaacagaatgagactctgtttcaaacaaacaaaaacccaaaaaaaaaaaaaagagagagagagggagttagaaggaagatgcatcatttttatgacctggacttggaagtcaccaagcagcacttctgcagtaccctgttggttggaatagttgtagcccaaacccgaattcgaagggaggagaatagataacatccctgggtgacaggaatgtcaaagtcccaaacagcatatgacatgtgacaaatattggtgtggccttctttggaagatccaatcttccataccaggcaaagggatggaagactaaggaacaacatgagggatagccagagagggaaaaagcatcacttgttctaggaactacaaatagcttgaagaagcaaagatgtctagatgcctcccaatatgcagagtggggtgtacagaagagagtggtaagggcgctgggagagctaaggtgggcaagagagcttcctctgtcatgctaagaaagttggaatttatcttgatggtggtgaaagcagagggctatggttagattcacatttgagatttagatttttagatttaaaatgatcaccctggtgacactggcttaactcacaattttgcccaaggcctatgctaccacagtgcttctgaaactttaaagcacattagaatcacctggaggtcttgttaaaccatggattgctgggccttgaaaccccagagattctgattcagtagatcgagaatagggcctgagaatttgtatttctaacaagtttccaggtgatgctgaggctgctggcccagcgaccacatttgataatcatagccctctgataaatcctatcaaaatatcctaatggcagagcaagggaattctggtgatatcctcccctacccataacctgacagctattaggatctgcctacttgaggctaaaagcaaccaagagaggaacagctacagtgtaccacagagtccctcaacatctttgcccacgccacggtgccccagcttcttaccaagtgtgcctgattcctcttgactacctccaaggaagtggagaaagacaagttcttgcgaagccttcgtcttctctgatatgctattctatgtctatttctttggccaaaaagatggggcaatgatatcaactttgcagggagctggagcatttgctagtgacctttctatgccagaacttgctaagcatgctagctaataatgatgtagcacagggtgcggtggctcacgcctgtaatctcagcactttgggcggccgaggcgggcggatcacctgaggtcaggagttcgagaccagcctggccaacatgatgaaaccccatctctactaaaaatacaaaaattagccaggcgtggtggtgggcacctgcaatcccagctactctggaggctgagacagaatctcttgaacccaggaggtggagattgcagtgagcagagatggcaccactgcattccagcctgggcaacaaagcaagactctgtctcaaataataataataataataactaatgatgcagctttctctctctgagtatataatgcagttctgatgatgtgaggaagggcctcactgttggtgtggcagagtctgagaccatggctggcaatgaaaacactaccctttgatgcctatgggctctccctttatggtttcaaggagggcttctcaatcttggcagaattttggactggatagttctttgttgcacaggtggggggctgtcctgcacatcacaggatgtttcatccctggcctctacctactagatgccagtagaacatacccaccccacagctgcctgttgtgacaatcaaaagcatctccagatactttgcagggggaaaatgatttctccaggcctggcatatacataacagtatttaagcagctgcctagaattaattaaacacagaaggatgtctctcatccagaatgccctggaccacctctttgataggcaatcagatcccacctcctccaccctatttttgaaggccctgtgccaacaccacttcttccatgaatacttccttgattcccccatccctagctctatataaatctcccactcaacactcacacctgttagtttacattcctcttgacacttgtcatttagcatcctaagtatgtaaacatgtctctcttcacgattcacaaagtggctttggaagaactttagtaccttcccatcttctctgccatggaaagtgtacacaactgacattttctttttttttaagacagtatcttgctatgatggccgggctggaatgctgtggctattcacaggcacaatcatagctcactgcagccttgagctcccaggctcaagtgatcctcccgcctcagcctcctgagtagctgagatcacaggcatgcactaccacactcggctcacatttgacatcctctaaagcatatataaaatgtgaagaaaactttcacaatttgcatccctttgtaatatgtaacagaaataaaattctcttttaaaatctatcaacaataggcaaggcacggtggctcacgcctgtcgtctcagcactttgtgaggcccaggcgggcagatcgtttgagcctagaagttcaagaccaccctgggcaacatagcgaaaccccctttctacaaaaaatacaaaaactagctgggtgtggtggtgcacacctgtagtcccagctacttggaaggctgaaatgggaagactgcttgagcccgggagggagaagttgcagtaagccaggaccacaccactgcactccagcctgggcaacagagtgagactctgtctcaaacaaacaaataaatgaggcgggtggatcacgaggtcagtagatcgagaccatcctggctaacacggtgaaacccgtctctactaaaaaaaaaaaaaaatacaaaaaattagccaggcatggtggcgggcgcctgtagtcccagttactcgggaggctgaggcaggagaatggcgtgaaaccgggaggcagagcttgcagtgagccgagatcgcaccactgccctccagcctgggcgacagagcgagactccgtctcaatcaatcaatcaatcaataaaatctattaacaatatttattgtgcacttaacaggaacatgccctgtccaaaaaaaactttacagggcttaactcattttatccttaccacaatcctatgaagtaggaacttttataaaacgcattttataaacaaggcacagagaggttaattaacttgccctctggtcacacagctaggaagtgggcagagtacagatttacacaaggcatccgtctcctggccccacatacccaactgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcagtaagtatccgcgccgggaacagccgcgggccgcacgccgcgggccgcacgccgcacgcctgcgcagggaggcgccgcgcacgccggggtcgctccgggtacgcgcgctggactagctcaccccgctccttctcagggcggcccggcggaagcggccttgcaactcccttctctggttctcccggttgcatttacactggcttctgctttccgaaggaaaaggggacattttgtcctgcggtgcgactgcgggtcaaggcacgggcgaaggcagggcaggctggtggaggggaccggttccgaggggtgtgcggctgtctccatgcttgtcacttctctgcgataacttgtttcagtaatattaatagatggtatctgctagtatatacatacacataatgtgtgtgtctgtgtgtatctgtatatagcgtgtgtgttgtgtgtgtgtgtttgcgcgcacgggcgcgcgcacacctaatattttcaaggctggatttttttgaacgaaatgctttcctggaacgaggtgaaactttcagagctgcagaatagctagagcagcaggggccctggcttttggaaactgacccgacctttattccagattctgccccactccgcagagctgtgtgaccttgggggattcccctaacctctctgagacgtggctttgttttctgtagggagaagataaaggtgacgcccattttgcggacctggtgtgaggattaaatgggaataacatagataaagtcttcagaacttcaaattagttcccctttcttcctttggggggtacaaagaaatatctgacccagttacgccacggcttgaaaggaggaaacccaaagaatggctgtggggatgaggaagattcctcaaggggaggacatggtatttaatgagggtcttgaagatgccaaggaagtggtagagggtgtttcacgaggagggaaccgtctgggcaaaggccaggaaggcggaaggggatcccttcagagtggctggtacgccgcatgtattaggggagatgaaagaggcaggccacgtccaagccatatttgtgttgctctccggagtttgtactttaggcttgaacttcccacacgtgttatttggcccacattgtgtttgaagaaactttgggattggttgccagtgcttaaaagttaggacttagaaaatggatttcctggcaggacgcggtggctcatgcccataatctcagcactttgggaggcctaggaaggtggatcacctgaggtccggagttcaagactaacctggccaacatggtgaaacccagtatctactaaaaaatacaaaaaaaaaaaaaaaagaagaagaagaagaagaaaataaagaaaagttagccgggcgtggtgtcgcgcgcctgtaatcccagctactccagaggctgcggcaggagaatcgcttgagcccgggaggcagaggttgcattaagccaagatcgcccaatgcactccggcctgggcgacagagcaagactccgtctcaaaaaataataataataaataaaaataaaaaataaaatggatttcccagcatctctggaaaaataggcaagtgtggccatgatggtccttagatctcctctaggaaagcagacatttattacttggcttctgtgcactatctgagctgccacgtattgggcttccacccctgcctgtgtggacagcatgggttgtcagcagagttgtgttttgttttgtttttttgagacagagtttccctcttgttgcccaggctggagtgcagtggctcagtctcagctcactgcaacctctgcctcctgggttcaagtgattctcctgcctcagcctcccgagtagctgggattatcggctaattttgtatttttagtagagacagatttctccatgttggtcaggctggtctcgaactcccaacctcaggtgatccgcccacctcgccctcccaaagtgctggaattacaggcgtgagccaccgcgtctggccatcagcagagtttttaatttaggagaatgacaagaggtggtacagttttttagatggtacctggtggctgttaagggctattgactgacaaacacacccaacttggcgctgccgcccaggaggtggacactgggtttctggatagatggttagcaacctctgtcaccagctgggcctctttttttctatactgaattaatcacatttgtttaacctgtctgttccatagttcccttgcacatcttgggtatttgaggagttgggtgggtggcagtggcaactggggccaccatcctgtttaattattttaaagccctgactgtcctggattgaccctaagctccccctggtctccaaaattcatcagaaactgagttcacttgaaggcctcttccccacccttttctccaccccttgcatctacttctaaagcagctgttcaacagaaacagaatgggagccacacacataattctacattttctagttaaaaagaaaaaaaaatcattttcaacaatatatttattcaacctagtacatacaaaatattatcattccaacatgtaatcagtattttaaaaatcagtaatgagaccaggcacggtggctcacgactgtaatcccaggactttgggaggccgaggcgagtggatcatctgagatcaggagttcaagaccagcctggccaacatggtgaaaccccatctctactaaaaactagctcagcatggtggtgggtgcctgtagtcccagctactcgggaggctgaggcatgagaatcacttgagcccaggaggcagaggttgcagtgagccaagattttgggggattctgtgacatacaaaaaaaatcagtaataagatatcttgcatactcttttcgtactcatatacttccagcatatctcaattcacaatttctaagtaaatgctctatctgtatttacttttataaaattcacaattaaaaatgaaggttcacatagtcaagttgttccaaacacacttaaatgtctcctaggctgggtgtggttgctcacacctgtaatcccagcactttgggaggctgagatgggcggatcacctgaggtcaggagtttgagaccagcctggccaacatggtgaaaccccgtctctactaaaaatacaaaaattagctggatgtggtggcactcacctgtaatcccagctactcaggaggctgaggcaggataattgcttgaacccgggaggtggtggaggttgcagtgagccgagatcgcaccactgccttccaacctgggcgacagagcgagactccgtctcaaaaaaaaaaaaaaggctcctaataactttattactttattatcacctcaaataattaaaattaaatgaagttgaaaatccaggtcctcagtcccattagccacatttctagtgctcagtagccacgggggctggtgaccaccacatgggacagcatatttagtacctgatcattggttctcagatctggctactcagcagaaccaagaatccacagaaacggcttttaaaagcacagccccacagcccccagccccagccttacctacctggaggctgggaaggactctgattccacgaggcagcctatgttttttgatggagggatgtgacaggggctgcatctttaacgtttcctcttaaatactggagacagcttcgaggaggagataactggatgtgtcttagtccatttgatggagggatgtgacggggctgcgtctttaacgtttcctcttaaataccggagacagcttcgagaaggagataactggatgtttcttagtccattttctgttgcttgtgacagaatacctgaaactgggcaatttatatggtaaaaaattttcttcttactgctctggaggctgagaagtccaaagtcaagtcccttcttgctggtggggactttgcagagtattgaggcggcaccgggcgtcatatggtaaggggctgagtgtgctacctcaggtgtctttttcttttcttataaagcctaactagtttcactcccatgataacccattaatctatgaatggattaatccattattgagggaagaaccttcatgacccagtcaccgcttaaaggccccacctctcaatactgccacatcgggaattaagtttcaacatgagtttcggaggtgacaaacattcaaaccatagcatgctgtctcttaaatgactcaataagctcctgtggcatccacttctgcatgccttgggcagcttttagacatctgtccattttcctagagggacaagaccaccacctgtgatcctatgaccttttggctttaggcctaacaagcaggttataccctcactcactttcaaatcatttttattgtcttgcagacaatttacacaagtttacacatagaaaaggatatgtaaatatttatacgctgccgggcgcggtggctcacgcctgtaatcccagcactttgggaggccgaggcaggtggatcacgagttcaggagatggagaccatcctggctaatacgatgaaaccccatctctactaaaaatacaaaaaattagccgggcgtggtgacgggtgcctgtagtccccactactcgggacgctgaggcaggagaatggcgtgaacccgggaggcagagcttgcagtgatccgagatcgtgccactgcactccagcctgggtgacagagcgagactgcatctcaaagaaaaaaataaataaataaataaatatttatactgcttataaactaataataaatgctatggtctgcatgtttgtgtcaccccaccattcatatgttaaaacctaatcaccaaagtgatattaggaggtggggcccttgggaggtgatgaggtatgagggtggagcccatatgattgggattagtgcccttctaaaatagcccaacggagcccagtgacaaggcatcatctatgaaccaggaaactggccctcaccagacaccaaagctgttggtgcattgatcttggatttcccaccctccaggactctaagaaacacatttctattgtttataagccacccagtggctggtattttgttataacatcccagactaagacaaataacaaatacttgtatccctgacaccaggttaagagatagaatttgtttgttcctctggaggcccttgtcttcaccccatcactgccctgtcctccctggaggaatctgccagcccgaattctgttcatcgtaccctccttttcttagagtttgacctcctctgtatctcccccaatccatgtattgcttatatacaaggtattctgctgtatctgttctgctatggcttgccccttttgttcaacactgtttttgtgcgtcatctgcattgatgcatgcagttgtcctttatttgttctcactgctggatagtatctggttgggtaaatatatcacactgtaaatcacactatccaggttcctttaggtgacatttggttgattgcagtgttctgttgttacgatggtgctgctgtgactgttcttgtgcatggacagaagttcctttcaggtgaatttctcagaatggaattgctgggcaaaggggcagccaataatcaactcatttgatgccaaaagtggtggtgccagttcatcctcccctgcgaggtatgggtcctgattcactcttcaagtgctgtggtttgacagggccgggggtgacaaggggacacctgggaaggaaagctgggctccctgctggccatccaggccagtccttaccagggggtaggcaatgattgggtcaagtggttcctgaccactgggcctgagacttcaggcccagaaactatctaatatttcctcaaatgcatcccatgagcaggcactgtgtgagtgagcacacacatctgaagcctcaagctaggcaagcctaccatgacttgtggtccaagggctcacgggtgacctggagttagagggagacatggctgccaggtggctttagaaagaacactcatcatggccaggtgcggtggcttacgcctgtaatcccagcactttgggaggccaaggtgggtggatcatgaggtcaggagtgagaccagcctgaccaacatgctgaaacctgtctctcctaaaaacacaaaaattagctgggcatggaggtgcacgcctgtaatcccagctactcaggaggctgaggcaggagaatcacttgaacccgggaggcggaggttgcaataagcctagattgtgccactgcattccagcctgggcaacagagcaagactccgtctcagaaaaaaaaaaaaaaaggaagaacactcatcctatgaccttgacctccaagctttgcctccctcaagcagaacagaatggagcctcccttaggcagaggcggaagtttgcctctcacctagttctccattcttttgttcagagcctgaataccctcaggctctgtacttggggtatttctgttctcttgttttatgctcacggttgtgaggtttgttgtgagtaccacgatcccttccttcagaggagtaaactgaggttccaaaaggtttagcagttgcccgaggaatattaaattggcaaaagcaggtagaatataaagcaaggagtatttggcaacggttcttttttatgattaaaaacagccgaagaaagacttctacttgtgcctttgaaggagtaactgcatttgaccttcccaccagtaacaaccatcaaatctctattaaattaaacacacacacacacaaacaaaaacagctattgtgaaggtatcagcgactaagacaactaaggtttgaggggccaggatcctggagagatggaaacttccctgaggtgagccccacattctcagacacttttccttggatgttttgagcactgctttaattcctgggaaaacaattccttccactgtgcacagactctggggccagacagcttgggttcaatcccagctctgccacttaatgtctgtgtatctgtgtaggcaagttaccctttggtgcgtcagtttcctcatctgtaaaacacaactatagttgatcctcattcgttaagagtctgtacttgttaatttgctcacttgctaaaatttgttaccccaaaatcagtacccctagccttttggggtcgtttcaaagatgtgtgcagagcggcaaaaaaatgtgagctcctccaggctcatgttcccagccaaggtccaacaaagtgctgccctgccttcttatttcagctgtcatagtgtaaactgtgtccttttcacagtctgattagtgccatgtttttcagatttttatgcttttttcttggttatttctctgttaaaattgtctccaagtgtagtgcaaagtttagcacgaggaggctgtgatgttccttacagagaaaatgcatgtgttagagaagctttgtcaggcatgagttaaggtgctgttgtcctgagatcaattaatttgttgttgttgttgtttgagacagggtctccctctgttgcccaggctgctggagtgcaatggtgtaatcatagctcactgcagcctctacctctctggctcaagcaatcctcccacctcggcctcctgagtagctgggactacaggtacaccccaccacacccagataatgtttttgatatttttttaggtggaattttgctcatcacccaggctggagtgcaatggtgcgatcctggctcactgcaacctccacctcccggattcaagcaattcttctgcctcagcctcctgagtagcacagattacaggcacatgtcatcacgccttgctaatttttgtgtttttagtagaggcggggtttcaccatgttggccaggctagtcttgaactcctgacctcaggtgatccacccgcctccgcctcccaaactgcagagattataggcacgaaccacaatgcccggcctcatgttttttatttttcaagttgaaatgaggtctctctatgttgcccaggttggtctcaaactcttgagctcaagtaatcctcccaccttggcctcccaaagtgcggggattacaggtgtgagctaccatgcccagccaagatcagtgttaatgaatcaactatatatattacataaggtgtctttaaacagaaataaggttatatattgatcgattggtaacaatgttgtgaccagcagcttacagggtacctagccttgtatttctcctataaataatttgctcgttgagtgtttgtggcaactttgtagcacataactaccaagaataaggactgtaataagagtacgtccctcacaggattgtaatgaagactgagtccatttacataaaggctgagagcagtgtcaagcagatggagaacactgtagaatgtgcgatagctctaacagtggttatcatggctgccctctcacttcttcagagacatgtgtttctaaggtctgcactctgccccaccctccccatccactgtcccccagcccgtttcctcctccacttacttcccagccctgtgccttctgccttctcttttctgagtttgctaagggcactgctggctcaagagcagtaactaacagtctctcgcctcttctctccatggcaaccagtgacctttggagaatgtaaaccttatcaccaatctcttaaagcccttcggtgccttcccaggatgacgtccagctgaggtccttggcaagacccagggcgccccctcctcgctccatcacctcccctgtcacctcccctgcatctccctactccagctgcaccactcttgtgccccagtggctcttgtctgattatttccttcatctccccagctggtcagcagagctggtggtaatcaactcagaccctgtcacctggatgtccagcagttagggactaaaaaaaatcaacaggtcacattctgtcctgcagatcatgataataagatctgtcagacagcagtcagcagtcagagccaaatcttctggacttcagcaggattctgcctcttgctatttcctgttgcctctcttagtgaccttttaagagcattgtggatgcctcccagcctcctgctaaccaccctgtaacctgaacagcctgcagcagccctgcccagtagaacttcctgatgtgatggaaatgctgtgtctgcaccactagccacatgtggccacaggattctcgaaactggtggtgcagttgaggagctgactttatattttatctcattaaatttaaatgtaaatagctacgtgtggcttgttggctagcctattggaaaacacgggcttagagagacacagggagaatcactgtaatgcactaaaagaaggtaaaaaaaaaaaaatcctaagaaatattcctaaaatactttaatatagggctgggtgcggtggctcacatccagcattttgggaagctgaggagggcagatcacttgaggccaggagttcaagaccagcctggccaacatggtgaaaccccgtctctactaaaaatacaaaaaatcgggtgcggtggcgggtgcctgtaatcccagctacgcgggaggctgaggcacgagaatcactcgaacccgggaggcgggggttgcagtgagccgagatcgtgccactgcactccagcctgggcgacagagcgagacttcatctcaaaaacaaaaaacaaaaaccaaaaaaaaaaacttcagcatgattatttaaccaaaatgcaggttagttgttcaccggatgcagagtccaattaacaagagcaaggcctggtaccaaaaaaagtgaatttactccgaaactagcttgggtgaggggtacaaagcatcctgcctttctttaaaagtgctgcttccccttggaagtagaaagtggacacttttataaggtaaggggggaagtgtgcaagggcaagtgggggggtccctctgctagttccgtgcatactctacaggacagttgacttggcaccttcctggttagtaataagctgtagcagtggccaagtgggcatgctttcagtatgccctcccagtgaatgaaagtcctgaggcaacccccaagggtggaagtgccaggccaccacccactggaggtgaaagttccgtgatgggtttgctttggtctgcgaatctactgtcatgtggagagatctgtgctctggaagagcatacagttagaaaagcttgccctgaagggaatgtatggtgaaggggaggtgaaaggttatatttgcatttctgaagggctaagtaggaaaccgggaaccaggggagaggagaagagaagagaggataattttttttaagaaaagcaacatattccctttttcttagaaaaaatggagcactcggttacaggcactcgaatgtagaagtagcaatatataaattatgcattaatgggttataattcactgaaaaatagtaacgtacttcttaactttggctttcagagttcgaaccaacgtggcctcaaccagatttggaatgtcaaaaagcagagtgtctatttgatgaatttgaggaaatctggaactttgggccacccagggtaagataaaacaccttccacgtcataggtatcttcctctctccttccctgcctctcccattagaacctggttttcttcctgagcagcaacaatcttaggcatctttccatgtgactgagtatccaccacattatttttaatgaaatagtattagattgcatggatgtgacataatccatttaacccatcccctactgttggacattcaggttgtttccagagtttcaatattattttatttaataccctaatagttagagcaggccatgctgctatcacaaatagacccaaatatttaatagctcaaaccaataacgtttgtgtcctcctctctgggcagtacagggttggcatacctcctgaagtgaattaggaactacactcattccagcttccagtttggtctttatctgtcagtgccttactgtcctctgcattgttgagtctcagtcaccttgtccaagttccattggccagaaagggctagaagcacagaagggctggaagtggcatttgttcctcactcacattctggtgggaagaacttagtggtgtggccttagctgactgtaagggaggctgggaaatatagtctagcgagtgccctggaaaaagccggcacggcattccccatggaaagctgtcaggcacggctacagtctaccccctgccaaccagtatctgcatggaccctccttccacactcagatgcatttacccccagccccaagagagccaaccgatgcccatgtggtcaccacagccacctccgagtccaagatttccaggtgacatgcagtctcctctctcccagctttaggaatggcttcttctgatctacacacagacacagacacacacacacagacacacacacacacacacacacacacacacgatggagaggggcaggataactgcaactgtaactccattcagaaaagaggcacagcactagctgcccgcagcactggagccctgctgggcagcactggatcaacctctgccctggcagaggagcatgttcctccacaaatccctgcttcagcctctcgagaggctcctccttgtctgttattttccttggccacaaggcaggcaggcagtgggaagtgtgccctcctccggggcaaggagccttcacagcccacttcctgctaataacagtttggggttccacagggtgttttaagactccagtcagctattttaggccagactcatttctctctctctctctctttttttttcttttatgaaatcacaccctgagacccaggctggagtgcagtggtgcgatctcggctcactgcagcctccgcctcccgggttcaagcaatcctcctgcctcagcctcctgagtagctgggactataggcgtgcagtgccacacctagctaatttttgtatttttagtaaagacggggtttcaccatgttggccaggctggtcttgaactcctgacctcagatgatccgcccgcctcggcctcccaaagtgctgggattactggcatgagccactgcgcccagcccagactcatttttctttgagagtaggcttttcccaaaagtaggcttctgagctattcactttcaggcagtcccatgtgccaggaaccacatccaaatttcctccgtggatgggagtctcaggctgccttatctccttgcatgtccccatgcccagctgtctcagcctaagggcaggtaccttgaagtcaagttaaacaataagattggagaccagcaatgccctcagcctggtttttgcagcaggactgagtcccttgttttggctcaatgggaagtctttgctgttcaaagccttagcttctctggctgagtgcggtggctcacgcctgtcatcctagctctttgggaggccgaggtgagcagatcactgaggccaggagttcaagaccagcctggccaacatggtgaaaccctgtctctactaaaaatacaaaaagttagccaggcgtggtggcaggcacctgtaatcccagctactcgggagcctgaggcaggagaatcgcttaaacccaggagatggaggctgcagtgagctgagatcatgccattgcactccagcctgggtaacgagcgaaattccatctctaaaaaaaagaaaaaaaaaaggccttagattctccctttgactttccacgtttgtgcagccttttatctccaatgctccatttcattccatctcctggcttattcttttcttgtcacatctactaaaagcaacaagaagccaccggtattcaggaacattctacctgtccccagagctatatgctcagtaggcatacagttggccctccaggttatctgagactcagatttccagagggctttgcatggctcacaaggtctgaagaacctctgagcctcccgcctgcggtgtctgttcattgactttgccacagtctcaaagaggcactgcatgctgcatgtttgaggtttttgctttggtggcatccatttccagcctcggcttccggcattcctcccccagcagactctctgctgctttccccttactccttctggcagttctgggaggttgcatagggcccttgcaggatgccccaagtccagctgcctctggcctctgggaagcacacccttgacctgccatgtgtaggaagacagcccgcttctgccagggcccaactctgccggcaggtagcaccttccaacctcttcactttggactttataactgtcaggtataaagtcggttgtgtccttacgtttctcaaattcttcaagacacgtcaaccagcctctcctacgcattctctccagctcagtctcaaaacacaccctttctctccagctcactctcaaaacacaccctatcaggccaaccactctttttaaaggacagctcctcaccaatccagtcaggtagccttccccacattgtatcctggaagtgggtgatggactgggtggggaagagggtcatatggcaaatctgtatgtcttacagtaattgtctagcagcccctggtgtcttactttaggccccctggaaactttcagatagtggagttgtctgatacatatcttataacctacagatattaatatatcctcacaggggcacaaaagctcttacaaggatgtttattataataatatttttattgttataatttacatgccataaaactaaccattttaaaatgtataatgcaagggtttttagtatattcacaagattgtgcagctgtcactactaattccagaacattttcattattccagaaggaaaccctattcatattagcaatcactcccccattccgcctttccctaaaacccagcaatcactaatctactttctgtctctgtggatttaaagtaattttaaatttgaaaaatagtatctataaggaaatgtatctagtcacaagcatacagcttgatgaatttgtaaaaattgaacagtcctatgaacataccctgtaagctcaagacatagaatgttaccagcccctgcaagcaagctgcctgctcacttctagtcattaacccctccctcttttccttctagtcattaacccttcagagtaactattctgattaccaatagcatagattagttctgcctgttgttttactttatataaactgtctcattaagtataaacatgtttgtgtatacttgtgtatttctttctatcacaatgatgtttgtgagattcatccatgctgttcctatagacaattctattttgcagcgtagtattccattgcatgactataccacaatttatctgtgatattacaaaggaatacttgggcagtttccagtttggggctataggatagttgtgatacaaatattttagtatagtacatgtcttttggtgaacctgggtacacatttctgttgtgtataccccttaagagtggagctgatgatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcttgcagtgagccgagatcgcgccactgcactccagcctgggcgacagagcgagactccgtctcaaaaaaaaaaaaaaaaaaagagtggagctgatgggtcatagcatgtaaatgcattcaactttagtagatactgtccaacagttttccaaagtgattgtccaacttacttgcctatcagcagtatctgaaaagtctagttgcttcttttcttggccaactctttttttttttttgagatggagttttgctcttgttgcccaggctggagcgcaatggcacgtcctctgctcactgcaacctccgcctcctgggttcaagcaattctcctgcctcagcctcccgagtagctgggattacaggcatgcgccactatgcccggctaattttgtatttttagtagagacagggtttctccatgttggtcaagctggtctcgaactcctaacctcaggtgatccgcccgcctcggcctcccgaagtgctgggattacaggcatgagccaccgcgccaggccggccaactcttttttattttattttattttactttaaagacagggtttcactttgtcacccaggatggaatgcaatggcacgatcacagctcactgcagccttgacctccctggctcgggtgatccctcccacctcaggctcctgaggagctagaactacaggcatgggccatgcccagctaattttttaatttttggtagagacggggtctctgttgtctcagattcctgggttcaagtgatccttctcccttggcctcccaaagttctggtattacaggcatgagccactgcacccagcccatggccagctcttgatacgatctgtctctttcttttctttttttttttttaatttgagaagtgttaaataatctttctttgatattatacataaaccacaccaaaatgtctttcagtaagtaaaatgaaccattttagatacagaaaattctaattagattggcatagttaaggccaaaaatataaagttgacattgctaccttatcttcagcccttgcctttaagaggcaaatgaacacaaaatacaggtgaatcttgcttggttctgagacagtgaaggactttcccccagtatttaaatatatttacataaccagttacataaatctaaatattaaaaaaatctccaatagattttagatggcattcaccatctttgtgaaaagttgaacattactaatgaaatctgatcatatctttagaaggataaacagtgatagcatttactgaatcagaataactgttttttggggttttctttgagacggagttttgctcttgttgcccaggctggagtgcagtggtgccacctcagctcactgcaacctccgccccctggattcaagagattatcctgcctcagcctcccgagtagctgggattacaggctcgccccaccatgcccagctaatttttgtatttttagtagaggcgaggtttcaccatgtcagccaggctggtcttgaactcctgacctcaggtgatccacccgcctcagcctcccaaaatgctaggattacaggcgtgagccaccaggcccagcctattttttttttttttctttttttgagacggagtctcactctgtcacccaggctggagtgcagtggcacaatgtcagctcattgcaacctccacctccggggtttcagtgattctcctgtctcagcctcccaagtagctgggaactacaggcgtgcaccacaagcccagctaatttttgtatttttagtagagacagggttttgccatattggcctggctagtttcaaactcctgacctcaggtgagccacctacctcggcctccgaaagtcctgggattacagacgtgagccactgcactgcctggcccagaaaggactattaattgtagttgcctctgggaatgggggctgcctgcttctttctgtaaccccttctgtgctgtttaaatttttttttttttttttttttttgagacagagtctcgctctgtcgcccaggctggagtgcagtggcgcaatctcggctcactgcaagctccgcctcccaggttcacgccattctcctgcctcagcctcctgagtagctgggactacaggcacccgtcaccacgcccggctaattttttgtattttcagtagagacggggtttcaccatgttagccaggatggtctcgatctcctgaccgtgttatctgcctgcctcggcctcccagagtgctgggattacaggcatgagctaccacgcccggcctttaaatttttactttgggccgggcacggtgccttacgcctgtaatcctaacatttcgagaagctgaggcacgtggtggatcacttgatgtcacgagttcagaccagccactgcactccagcctgggtgacagagtgagactctgtctcaaaaaaaaaaaaaaaagaaagaaaaacttttactttttacatgttattttcatcaatttaatgaatttaaataacaaatgtataaatttgatattaataaaatggaagcatttggtaatcatgttttgggttttgtgcttcctctgcagctctctagatgagaccacctatgaaagactagcagaggaaacgctggactctttagcagagttttttgaagaccttgcagacaagccatacacgtttgaggactatgatgtctcctttggggtacctcttgacttcttttatttttctgtttccccctctaagaattttagttcactaaaatgaagaatttccctccagcagagctaagcatcaagtagcatgtagttgtaggtaggattaaaagactagggttccgggaggtgaaggttgcagtgagccaaaatcacgccactgcactccagcctgggtgacagagcgagactctgtcatagatggatggatggatggatggatggatggatggatggatagatagatagatagatagatagatagctggatagatagataagatagataagacaagactaggcttcaagctgcagtccagctctaccaggcttgttgtgactctgggcaagtcactcagcctctctgagcctcattttccagcttcagtggatacccatgaaggcaaatcagagaggggcctgagtgtgtatttgtccagcaggcagatggagggaacaacaaactagacccgtagttcttcagtagggataagataactgcccaaaagttatttagattacaaagacttgagccctgctcctgtgagacagtgatggggtaggtcgggtgcattcctgggaagcatatttttgaaaagctcacctgggattctaatgtgtatccctaggtcttattcctagagattttgattacttggtctggggtgtggcatgacctgggcagggcactgggatttttaagctccacagatgattccaatatgcagctagtatgagaacttgtttttttttgaaggagtctcactctgtcacccaggctggagtgcagtggcgcaatctcggctcactgctccgcttcctgggttcaagcagttctcctgcctcagcctcccgagtagctgggattataggcatctgccaccatgcccagctaatttttgcattttagtaaagacggggtttcaccatgttggttaggctggtctcgatctcctgacctcaaatggtccacccccatcagccttccaaagttttgggataacaggcgtgagccaccaggtccggcctggtgtgagaacttctgagttggatgaaacattagccccagatcctagaagccagggaagtgctggtctttatcgactggccaccaggtggcagatttgggcaagggtctgcctttgggtttagaattattgcttaggccttaaagtagttcttttttgccagtgggagaaaatccctcaaagatggttttctgggttggttggtttgtttgtctgtttgtttgttttttgagacagagtctccctctgttattcagcctggagtgcagtggcatgatctcactgcaacctctgcctctcgggttcaagcagttctcctgcctcaacctcccaagtagctggaattataggcacacgcccccacacccagctaatttttgtatttttagtagagacagtgtttcaccacgttggccaggctggttttgaactcctgaactcaagtaatcctcccacctcagcctcccaaagtgctaggattacaggtgtgagccaccgcgcctggctcctcaaagatgttaatcctcttgatggcaattgactaataccagaaaatgtcacgaagcgtgcattttggattcaatcatggaattgttgaggacaatcagccatcagactaaagcgatagaaatagtattggaaattgcagcgggagcactgaatggagaaggcactccacataatggaggaggcaaccaagtcttagagaaggtatcaagcctgactataaggacagtgagggaattgaaaaaacaaaaaaggagcaatggagcagggaaggattgaatgcctttcaagtagattcagtaattgctgttagcagcaaaaaatgcagtagtgcctgggcagggctttaaagtgcttgcacaggcagccctagagggccgggctgcttgggaactcttacaaactgacctaccaacttgagcatccacagcctgatcagaggtgggggagttaagggccttctctcccctagcctctactagagcctgtaactgcagggaaaccaagttgcaggctaaactctgcccacacatgcagacattgattagcaagctacaaaaacagtcatgaaacctgtttttataggattagtgaagccccagtttgaccagagtactttgcatgaatgttttgttagaagcaaatgtgccaatattctagcagctgcgtttggtttacttcttcttcttctttttttttttttttgagttgaagcctagctctgtcacccaggctggagtgcagttgtgtgatctcagctcactgcaacctctgcctcccaggttcaagcgattctcccgcctcaacctcctgagtagctgggattacagacatgtaccacaatacagggctaagttttgtatttttagtagaaatggggtttcaccatgttggccaggctggtctcaaactcctgatctcaagtgatccacccgcctcagcctcctaaagtgctgggttaacaggcatgagccacggcacctggcaaaagtcatcttttggtttacttctattgaactgaaaaagtcacaaatatatttatatttaattaaatatatttatataaaaatatggtatttagtattattatttttagagacagggcctcgctctgtcacccaggctggagtgcagtggcacaatcatagctcactgcagcctcaagcttctgggctcaagtgatcgttccacctcagcctccctagtagctgggactacaggcacatgccaccatactcggctaattattttattttatttatgggtctcgctatgtttcccaggctggtctcaaactcctggcctcaagcgattctctcacctcggcctcccaaagcaccgggattacaggtgtgtgccagcacacccagccacaaatctataaatttagaaaggaggactatttctaaagagggtcccactacctgtaggcaggaagcagagcctctggccataactgaaaaacaagcacttccaagaaggggcaaagggaacatgaatttatgctgagaggcgtagctaagcatacatattcaacagattatgggaggatctatgaatattcacaaagggaggatctatgaatatgcacacatgtggagtaagctaacgtgtgcagcatgtctcccatgttcaccttaggcagaaacttaacactaacatgtattacagggcaacaaaatgagactgcatatctacataacctagctatttggtaggctgaagcaggagcatcacttaagactgggagttcgaggcagctgtgagccatgatcgcaccactgttctccagccaggatgacagggcaagaccctgtcttagaccactctgtggtcagtggttatcaggaaggaatgctagtcagttgtgctgaaaccactaaaaaggaagggcagaattaggtgatgagttgataccagtggtgaagtgagtcttttttttttttttctttttgagatggagtcttgctctgttgcccaggctggagtgtagtggtgtgatctcagctcatcgcaacctccacctcctgggttcaagtgattctcttgcctcagcctcccgagtagctgggattacaggcgcctgccaccacgcctggctaatttttttatatttttagtagagactgggttttgccatgttgtcaggctagtcttgaactcctgacctcaggtaatccaactgctttggcctcccaaagtgctgggattacaggcagctccaaagtgctgggattacaggcatgagccaccatgcatggcctgaaataatttttttgaaagggctagtttctatttagcccttaggggaaaaaaaactaatggcagttagggagggaatagaacgagtcctgtttgaactcctttcccatcatggccaaaacttaaaattttttttagatatctctgggctccccttggccaaaagatagtttgttgagtcagttgggagcttagaattttgtttttatttctcacatcattgaatcaatttgaaccaggcgacaaaaccttctgctcccagtagtgggtcagagaaccttcctgattcctgccctgagattgtctctctgaagacaacattaggctagtaggctttccagattctgtaacccattctttcaaaggaagagatgcctatatttttctagccaattcatataccttgagtatcactcaagggcaaaattatttctaacaaatcatttactaattagcaaatgcttaagtgtagatttagaaagctaaagctatacagtggctgccatctatagtttggacttgtgattaactacattgaaatgctaactctgtaccctagagtatgaattcctgattagagtccttcaggtgctaactaatttatgtatttcatgtttgataatattattacttgagctttgtgggagagcagtcttttcctcccctgagatatagctagaagttacctcctttgtgaagccttcctagatactccaagcagacacggtccttcctttctcccttgcccagcactctgaggttgactctgtggagcactgatccctctgtgttataattgtctatttacacgtcagctaccacctataacacactgagttcctcaacagcagggacactgtccattctttgatcccagtgtctggaacagtgccaagtacatagtagggacttaataaatattgattcatatgtaaatgagacttttccaaaacatgctttcgttgatgcctctcagcatttatacaccttttaccaactcgctactggccacatagacaaatgaaagcagtaatccagatacacccaagaggacatctgttcttttttctctctgtggagtgggagacttaagtggcttcttaactggtgtgtcgtctgatcaagtggtccaggtaacaggtggatgccaatgtctggcccaggcatcaccccttactggcactggtcattacagaagacactctaccagagctgaaaggacctcttgtcactaggcagctgtggagtccgctctacttgacctagtaaaatctgcctggagactgttagagtcaccccactacctgaagttacctccaggctgacctcttttttttcccaggtggagtcctggcatcttagatattttaataaggatttgcttgttgacatgttctttattcactaaggtgtcagcatattactgtcttagaactgagggttcttcatcttttttggatcaggacctccctctaagaatctgatgactgctctggtccctctcccaataaaaacttccatactcacctgttaaaaaaaaaaaaaactttaaacaaattaacagagttttattcagcaaagaatgattcataaatcgggaaggctgcaaccagaataggttcagagagactccacggtgtgccacgtggttggagaggatttaggatttatgcacagaaaaaggaaagtgacatgcagaaaatgaaagtgagggcctggtgctggtgcggtgcctcacgcctgtaatcccagcactttgggaggccgaggcgggcagatcatgaggtcaggagatcgagaccatcctggctaacacggtgaaaccctgtctctactaaaaatgcaaaaacttagccgggcgtggtggcaggcacctgtagtcccagctacttgggaggctgaggcaggagaatggtgtgaacctgggaggcggagcttgcagtgagccaggatcccgccactgcactccagcctgggcgacagagcgagacttcatcttaaaaaaaaagaaaagaaaaaggaaaatgaaagtgaggtacagaaacagccaggttggttacagcttggtgtttgccttaaacttggtttgaacagttggccgcctttgattagccaaaactcggtgattggtacaagagtagattgcagttcactatgtacagagaagcccttagatccgaactcaaaataggtaaggaggcagttttagctacacttaagttaacatactcaggagtaccattccagcttcaagctggaagtgtctgcagccccctgagaccacttaatcccaagttaaaaacccctgctcagaggcagcatctttttttttttttttttttttttttttgagagagatctcactctgtcacccaggctggagtgcagtggcacgatctcagctcactgcaaccaccacctcctgggctcaagggattctcttgcctcagtctcccgagtaactgggattacaggcgcgtgccactatgtccagctaatttttttttttgtatttttagtagagatggggtttcaccatgttggcctggctggtcttgaactcttgacctcaagtgatccactggcctcagcctcccaaagtgctggcattagaggtgtgagtcactgttcctggcccagtgaggcaccatctcattggatatggagacaaaggatctggcttagcatcctggatttgtattttctttccaagagtccttaagtgatatctaacttttgcgagctgcagtttcctcagctatgagatgagtgacattaacctcctctcttcagatttataagaggatcaattaaaatggcataggtaaaagtgcatcctagcaagttggtatctactttagaaatgaaggaggtcatatgtatgtgaagtctccagacccaacatgccatcttatatgtgtctatttctacaagtgagctagtgacaacagtaattgctatttttgctcctacatgggtagggctgatcttgactaggaggagtcaataagactcaccagccgggcgtggtggctcacgcctgtaatcccagcactttgggaggccaaggcgggcggatcacgaggtcaggagatcgagaccattctggctaacacggtgaaaccccgtctctactaaaaaaatacaaaaaaattagctgggcgtggtggtgggcgcctgtagtcccagctactcgggaagctgaggcaggagaatggcgtgaacccgggaggcagagcttgcagtgaaccaagatcgagccactgcactctagcctgggtgacagagcgagactccatctcaaaaaaaaaaaaaagactcaccagctgtggccactgtctgtgctaattggctagtgcctgcatctcagaaactgctacatattttgactattccccctgcacttaagggcatgcacactcccaaaatagactcagattgtctaaggaataatgatgatgatgaagagaaagccctctttatctggtctatttgtagtcagttccaaaagcattaagaatttctgctgaactaatgcagctagtttctttcctgtcaccactttccttccaaaatagtttcaagatctgtgggggaaaaaatctatttacagtgaacagactggtgggaggaagttgagcattggggttttctgccctgtgtaaccttgccctaagttgggcagatggtatcacactacctggacatcatctgctcattcactatttgaccagttggtcattcattcacaaatgtcctttttgcaggagggatggaggtgctagacctgcagatgctagcatgaaaagacagatctcctgctgctaaggtgcttaaagtagtggaggtcaggggacaagcaagcagtcaggcagctctgaatgcagaggcaggaagcaccacgaggcaatgggacccacagaggggtagcagggtagaggtgagtgggtctcatgtggggagggaggaagttgactgcagagaaggtgccagggggtgaaaatagcttgagagctgtggagctagaagggctctcacatttgcttattaatatgccctttgaaaaagagtggcctgatacctggagtcactcaaaagatttccaattccgataggaaaaagtcaattttggcttcagtggttgcatgtgcaccccctgatttgctgtatgctgaggcattgtggtgatggacgcaagtgcggagaccttgagcacgcatctgcccctagttcttgccctgagtcctcgaaggaggcaggagagacatcaaggcagacaggcgccgctcatcagtgatgagaccagacctggaactcgcgtcttatactcagtcctctgccctttctgctggattgtggccccccagtatagggtgcaacacacaactggagcatttaagggccacaaagagaacaaattaccaatgattgtgtgttgattctttgagctctttttttttattattatactttaagtgttagggtacatgtgcacaatgtgcaggttagttacatatgtatacatgtgccatgctggtgtgctgcacccattaactcgtcatttagcattaggtatagctcctaaagctatccctccccccttccccctccctccaccccacaacagtccccagagtgtgatgttccccttcctgtgaccatgtgttctcattgttcagttcccacctatgagtgagaatatgcagtgtttgattttttgttcttgcgatagtttactgagaatgatgatttccagtttcatccatgtccctacaaaggacatgaactcatcattttttattgctgcatagtattccatggtgtatatgtgccacattttcttaatccagtctatcattgttggatgagctctttatctcatggaaaaataatttataaaactctgtatgagaggagtgggaaatagtattaacgggtgcggggtttctttttgggacaatggaaatagctggaattagatagtggtgatgtttgcacactttgtgaaatactaaaaactcctgaattatacagttttaagaaacttttatttatttgtttttgagagaagttctctgtgtcacccaggctgaagtgtggtggcgtgatcaccggttattgcagcctcaatctctgaggctcaagcgattctcccacctcagcctaccaagtagatgtgactataggtgcgcaccaccacacccagtgaatttgtaattttttgtaaaaacaaggttttaccatgttgcccagtctggtcttgaactcctgggcccaagcgatcctccctccttgggctcccgaagtgccaggatacaagcatgagtcaccacatgcagcctcagttttaagaaacttttaaataaatgaaatatagtcataccaaaacagtaaaaatgggtttcaggaaaaaaaatgtttttttaaacaaacttacgtattgtataatcccagcccttttaaaaaatgctttcaaaaactggcagtcaactcataaaaggacaaatacttatgattccactgatgaagtagtcaaaagtagtcaaaaatcacagaaacaccaccataaatgtataatttttattttcaattaaaaaaacatcttttttttagtcaaaatcatagaaatagaaagtagacaggtggttactaagggctatgggatggggaaattagtgtctaatgggcatagagtttcagtgttacaaggtgaaaagttctagagttatgctgcccagcagtgtgaatatactttattgttctgtacacttaacatggttaatatggtaaatttagcgttatgtgctttttactatagtaaaattaaaaaaaaaaaaaatggggccgagtgcagtagctcacacctgtaacataatcccagcactttgggaggccgaggtaggaggatcacttgaggccagaagtttgaaaccagcctggtcaatatagcgagacctcatctctacaaaagaaaaatgttaaaattagacaggtgtggtgtctgtagtcccagctctctggaggcagggactgagtcagaggatcacttgagcataggggtttgaggctgcagtgagccatgatcctgccactgctgcagcctgagcaacagagcaagaccctgttgtaaaaacaaacaaacaaaaactggcagctgatacctgagagtgaatatcttttatcgctggttaatgggattgagagaatgcttcatcttatagaaagaacagtgtctttggacccacagagacctggatttaagattagctctgccaattactgagtactctttactatgaacctctgttttcctcatctgtgaaactggaataatgaatcctaccgccaacaattgtagtcaagttggaaacaatttacacaaagtgccaaacaccaagcctggcacagtaggaaccgagtaaatagtggttaatatttttatcagtgtctgcattgctgacgtctccatcatttctatacatttgtttttgaatcagaaaaagatgttattttaaaaaaataacccagtagtgccccttgtcccattcctatcagttatattattattgttactaccctctggaatttcaataactctttgttttttgggttttttgttttgttttgctttgcttttgagacaggatctctgtcgcccagtctggtgtgtagtggtgtgatctcagctcactgcagcctcaacctcctgggctcaggtgatcctcccacttcagcctcccaagtagctgggaccacaggcgcatgccaccacacttggctaatttttgcatttttagtagagacagggttttgccatattgcctaggccggtctggaacttctgggctcaagccatctgcctgcctcggcctcccaaagtgctggaatttcaggcatgagccatgcctggcctaaatagctctctgtgtttgcaaaagtgtgttataagaatcattcagagcctctcgattggatggaggctctagaatgcacagaaaaaggctgccaccgtgtatctctgcaagtcatgcacaagatggggaacagcaggcttccccctgcttaccagttcaaatacagagaactagccctgtagctgtttctttcatatctcacccattctaaagagaccacaggccttagaagtaaaggactcttttgttgaaagagtgttttcaaatttaaatgagcatttattggtcaaagatgcaccaactagtcttttgaagaattcaaggctctttagagaaaaataaagccttggaggagtatctgagaagcttgttagatgcgtgggaagagtctggaaataaaaaacttcatctggagtttctgccttctaccaacagagctgaagctaatgctctcctaagacaagcaaagcagatggtttgcatacttccttaccttccttttacttcctctgtaatagacttgtcatgtctgatgtttgagttgacgtggtactctaatagagttagagtctgcattttttttatgtcctctagtatgttctggttgatggttgagggcaacaaaccagcagtcccagatgccagcaccaagacctgagacaggtcacttaactctccgagcttcaccaccattctcaccttgcagacctcacagggaacagggaaagctctatgagatacaacatcattatgattaatcctattctgattctgaaagcaaagctcttcctacacaaactcctatttctaaatactaaaagacatttctttatggtgtattttgtgtacttgtagaaatggaaagtgttgagataaaacatgaagcaatgatgacaaagtgctaactttttcttgttttaatttctttatgctttttttccacctaatcccctagagtggtgtcttaactgtcaaactgggtggagatctaggaacctatgtgatcaacaagcagacgccaaacaagcaaatctggctatcttctccatccaggtatgtaggtatgttcagaagtcaacatatgtaattcttaaagacttccgaaatgtgacattgtggaccatttaagaaatgtcggctgagcacagtggctgacacctgtaatcccaacactttgagaggctgaggtaggaggatcacttgaggacaggagttcagaaccatcctgggcaacatagtgagtccctgtctctgtaaagaaaataaaaataaagtcacagctgggtgcaggcttacacctgtaatcccagcactttgggaggccaaggcctgtggatcacttgagctcaggagtttgagaccagcctgggcaatgtcacaaagccccacctctactaaaaatataaaaattagccaggtgtggtggcacacgcctatagtcccaactacttggaaggctgaggttgagcctcagcctgagcccaggaggtggaggttgcagtgagccaagatcgcgccactgcactccagcctgggcaacagggccagaccctgtcccaaaaaaaaaaaaaaagtcatcgtcttatgttagcatccttgtaagtgagcctttcctgatattttgcagcctgtctcattctcagtagaaaagtttactctagttacataacttctccctgctgacaatttggatactgtaagcaggcatcaggatattaagatctgaagtgagtagcttataacttttccaaatccagcctagacagttttcctctattaaattattgccctgactttaaaagaagctacttttgaccttgtagcgtttgaacaagttgcactttgtcttcaaagcaagttaaagtttgacctctacttgttttgagcctctcaggtaaagggttatttgaattccctttgcaggttggggttgtgtaccctgtggaggtggtagagtgttatatattgctgctccagggcatttaatccctcctgccttttccattgatgtgctttcaatctagaggaataaaagattgtgttggagacacaatgtggcctgcatagcatctgaaagcctgagaacatgcagggagagacatccctcatccctcagcagcctggctgctgttgaagtggttgtaagaaagtaaaagagaaatgcccacaaaacgttctcagatccagtcattcattagcacttccaaagagagcatgttgactgtgaattgggaaagggccagataaaactagcatagaattctttgaaagactaacggtatttgcattttttaaaaattataaccttactctaccccctaacattgacatcatttttaggtaattaatattttcccatttattattctgtgatctctaatgctttgttcagaataaatagtgtgtttcctttccccacactttcatccaagaagtgtgctagagttcaacaaaaacagcactagaaatcactgtcattctaggaaggccctaattcacagattgtattggtttttagacccagttagtgtgctggaggttggaggattttaacctctgtgggccaactagcctctgtggcctcagtcattcttcctgaccctggctgtgcttgagcctgtgtgttcttatccttcatctccgggggaacgaagtggatcagctcggtccagcgatcacttttggggatcagtggctttgtagatatcgggcaggcacttaccccaaaagaactttccccatatctgaagactgaaaacgtccatatcgtatttggacacactgcccagcaatacgctctagctgtgttcagaagcatgggaatttggaaagatctgctgagcatgccgtttactgtcacagatactatcttcctcaaaaaaaaaaaatatatatatatatatgggggacggggcaggttgagactgggtgagactgaagaggtgccttggccagagcaggccacacccagagaccacaggctccccggtccacctcaggcccctccccttcctgcgccgtttccggcagatccagagtggccaccgccggatgggagtcgggggaagggaggcagagaagcgggccctgaggacaagctctcagtgcttctgtgggaagtggcggcaagacggcagctcccagcgggggatggaggccgagtcagtctgctggtcactggaggccaggatgctgcctaacacagccgtcccgctccgggcctcaccaccagggcggctctccccactcccggcctgctgcccacacagactgcggggttccgggggagcaggacccaggccgttctgcgcctgtcttcttggaaggagcaggccggagcgcgggagcgccgtgtagctgtacctgcgaaggcacaggattccgcgggaagatcccgcagtttcgggccgtcgtcattgtttttatacctgtggcaaatggcatgaccagacacacggttatgtctggagaaacccctgtagaggagcaggaggttgtggacatgctgtggcccggacagtggctgccgagcagttggagcctgcacccgcccaacttggctaaagaagtccccatactctctgtggaaaagatttccagaagctgttgtgtcaatatcaaagcctcaaaacaacaacaacaacaacaaaaacatgaaattatcaacaataaagatcatccttgagtctgctttgaaaagtagggtgaaattctgcagaggcattcaactggcaagataccaccctcatagccagatctgcaggtctcagccatcatgccagggaaaatgctccattcaccactcctcagcttctgcttctggtttcagaggtctctgtattggaggggctttaaagcaagaagggtctttacccacttactcttattcacagatgtgaatatgcaggtccagtggggaaagtgacatgtcctaagtcagaatagagtcaacaagaaaacagggcccaaaatgacttagcctctagtgtataatgggcattgatgagctactggaaatacagagatgaagaaaacacagtcccatcttcaaggagctcaatctagcaagggagacagactctttgtaggtgggaccgggcttccctgcagcagaaggaagcttgaaattggtaacgagcctcagaagggacagaggcaggccaccatgctaccctgagaggatcgcatgtggacacggggctatgacctggccctgctttgacccactagctgtgctgtagggccaggtggagcctggagtggcctgtgctaaggggctactatgagctctttccactcccccaaggcattgcataaataatgtcactttctgtttgcacagcaaaatcagggacacaattttctagaacatggggtgcctcccctccccccagcccaacagaagttctacaatgactgatgggcccttgtttttgtttgagacggaacaccccacagggttccgagtggtgatttgtggcccacaggccactggcaagtggaggcagagctgcagagccctcgggagccacagagggcctgctggccgccacgacatgccaactcagctgctgctggccctcctgtgggcggcagtgctagtgatgtgcagaatcttaggactagtgccaaggaacctataaataccctgggtgacccaggcgtgcactgctgtggtggccttcacagtcagaagatgacaagctgagaaggggagaatcggcccaaggtgagatccacagaaaggccagggccaagatgcggccagcacctcaggctggtggtggtcttacgttgaccatgccagaggccagtccttgattgctccaaaccctctgttcgagggttccaaatgaaatgagcaggtcctcgtgtcaggacctaggttagtttctgaaaaagcatgaaaagcaggcctcctgaacttccccgagtgactgatgcaaagtgcgtcctgcatgcttcacagcaccatggagaggatcttcaggggcaaactgcagactatctgaatgacggcactgaccatcagcaaaccgcagagctgcctgaccaagaaattgcgagacagaagcaatgcttgcaggcgaagaagaaggggccagacacagtggctcacgcctgtaatcccagcactttgggaggccaaggcaggcggatcacttgaggtcaggagtttgagaccagcctgggcaacatagtgaaaccctgtctctactaaaaatacaaaaaattcgccaggcatggtggcaggcacctgtaatcccagctgcttgggagactgagacaggagaattgcttgaacccaggaggcgaaggttgtaacgaactgaaatcgtgccacagcactccatcctgggcgacagagtgagactgtctcaaaaaaaggaggagaagaaggaaaggccaaggcaggaatgaaacaggccatgaatgttggagtgaagcaactggcctcctcgtgctaagcggctactgtgagttctttccactcccccaagacattgcataaataatgtcactttctgacactcaccccgctgaatgtcctgcctctgctcaagggtggtatgatggggacttggcagtggaggggaacagggaaaccagacatggtggtctccccgcttcctggctacaagtccctctgaagaaatccaaaggagtaaagagcttggagagtaggcctctgtagggtgcaagggcacagctggagacggagctcctgaggctgcagctgatgctgcccgctctgcctgaactgcaccaaaaacgtgatgaggccatagcgggagtccacggaggaggatgcctactgcccgacctctagcagagactaagcaaggtgcatgaaaacttgaaccacatgtgtcacacccatgaccactacatgaagatggcccaaaacctggcccaggaattgaagaaagactcttccaatttgctgtaagaaaatggcccagggggcaagcacggtagctcacacctgtaatcctagcactttgggaagctgacgcaggcagatggcttgagctcaggagttccagaccagcctgggcaacatggtgaaaccccgtctctaccaaaaatacaaaaattagccgggtgtggtgatgcatgcctgtggtcccagctactcaggaggctgaggtggaaggattgcctgagtctgtggggcagaggttgcagtgagctgagatcacaccactgcactccagcctgggtgacacagtgagaccccatctcaaaaaaaaaaaaaagaaagaaaacggcccaggaaggctggagggccgccgtgtccattgagagagtgctccaggcactccaaaaagaaaatgaccacaatgggaagaaaccagctgaccatgagaccaagttccaaccttttacaagtggcctgtggctcctggcgccccgcccacagctgacaggggctcagaagtgctagggggaccatgggccaccagggccaccaggagggaggcaggtaacgatgcgagggcttggatgcagaacaccagctggtttgattctgttttccctgtacctgggtcctgaatgcccagaggctcagggaaacaccagccagtgctgctgcctttaaagcacttttgactgatctcttgttaatttagcaactgttattggttgatgctgcagttgctcttattgaagtttgattgatagcattaggatggtaaggcactatttttcaaataaaggttgtttaatataaaaaaaattttgtttttttttctctcagcctttcacattggttcaaaatatctttcatctggctgcatttctgatttttgttttgttttttttttcttaattttatttatttttaattaaaaataattttttttgtcaacatggggtctcactttgttgcctaggttggtctgaaactcgtggcttcaagcaatcctcccacatcagcctcccaaagtgctggggttatgggtgtgagccactgcagcagcctgttttttttgtttgtttgttttttttaatttgacaagttttcaggtcctgtgaaatcagcagtcttacctcccaccttgcgcaccctgaggaggttgcagaataaaggagaattctagggacacgtgggcatcagtgcctgtgctcagagcacctcaggcagtgtggaggggtctagaggttactcaggctctgcctggcaacccgatagcagtatcagagtatagggccaaggggacggtccttgggcttggtgtggtttattagtccttttcctgtgaccctgatggtttggttcactcatttttatctccatactgggaacaggttcaagccccagcatttggttgataatgcaggaatccttgatacttttattgcccaagcttcccttcctggtgacctcatcctagcctcagtctttggaaaagccctccttgagtgctcaggcagactcaggtgccctttcttctgggctcccatgcactctgttcttacctccatcagggtgccacatgcactagtgttatctgctgccgtggccaatcatccatgaggccatgaggaagtggaatgtacatctggtataagaagacatggcagaagccagcctccgatctgtccacacgaatacagcattcccaaagcaacgtgcatgtgccattattcactggatgagcttgaggtggatgaactagcccaccaggctctcaatgtcatgaatttaacactgaattaagaaaaatatgttttaaaaataatagtttaggtgattgctggggtgctaggagaggaaggaatggggaataactgtttaatgggtatagttggccttgtgtatctgtgggttccacatctgattcaaccaaccgtggatcaaaatatttgaaaataaaaaacaaaacaaaaatgatacaaataaaaaccaatataacaactattaacagcatttacattgtactaggcattataagtaatctggagatgacttaaagcatacagaaggatgtgcctaggttagatgcatgtatcgtaccatttcatatcagggacttgagtacccacggattttggtatctgcagatcctggaaccccttccctatggataccaaggaacaacagcactgggtctccttttggggtgatgcagatgttttgaagctaggcagaggtagtggttgcacaacattgtaaatgtactaaatgccaccaaattattcatttttaaatggttaatgtgttatgtgaatttcaccttaacaactaataatattataggtaaggcacaagttacatctgtagcacaaaaatggccctaatttttaaaacactgctccagcatagcaggtatcacatgtgaggtagcaaaagctggagatcaaagtgtgatacctggagacttatcagtaagggtcaaatgttttttcaggttttgagaatcattcttggaattgttccagaagatatatcgtataactcttcttagatgctaagataagaaggcagatatacactagctcattttgtgttattttctagagctttactccagtcaatttcttgggggcagcatttgtggaatcagtggttcatctgaagggctgtgctgtggaattactatgcatttgttttgtcttccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacatattcacatacgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaattagccgggcatgatggcaggtgcctgtaatcccagctacttgggaggctgaagcggaagaatcgcttgaacccagaggtggaggttgcagtgagccgagatcgtgccattgcactgtaacctgggtgactgagcaaaactctgtctcaaaataataataacaatataataataataatagccatcctttattgtacccttactgggttaatcgtattataccacattacctcattttaatttttactgacctgcactttatacaaagcaacaagcctccaggacattaaaattcatgcaaagttatgctcatgttatattattttcttacttaaagaaggatttattagtggctgggcatggtggcgtgcacctgtaatcccaggtactcaggaggctgagacgggagaattgcttgaccccaggcggaggaggttacagtgagtcgagatcgtacctgagcgacagagcgagactccgtctcaaaaaaaaaaaaaaggagggtttattaatgagaagtttgtattaatatgtagcaaaggcttttccaatgggtgaataaaaacacattccattaagtcaagctgggagcagtggcatatacctatagtcccagctgcacaggaggctgagacaggaggattgcttgaagccaggaattggagatcagcctgggcaacacagcaagatcctatctcttaaaaaaagaaaaaaaaacctattaataataaaacagtataaacaaaagctaaataggtaaaatattttttctgaaataaaattattttttgagtctgatggaaatgtttaagtgcagtaggccagtgccagtgagaaaataaataacatcatacatgtttgtatgtgtttgcatcttgcttctactgaaagtttcagtgcaccccacttacttagaactcggtgacatgatgtactcctttatctgggacacagcacaaaagaggtatgcagtggggctgctctgacatgaaagtggaagttaaggaatctgggctcttatggggtccttgtgggccagcccttcaggcctattttactttcattttacatatagctctaattggtttgattatctcgttcccaaggcagtgggagatccccatttaaggaaagaaaaggggcctggcacagtggctcatgcctgtaatcccagcactttgggaggctgaggcaagtgtatcacctgaggtcaggagttcaagaccagcctggccaacatggcaaaatcccgtctctactaaaaatattaaaaaattggctgggcgtggtggttcgtgcctataatttcagctactcaggaggctgaggcaggagaatcgctgtaacctggggggtggaggttgcagtgagacgagatcatgccacttcactccagcctggccaacagagccatactccgtctcaaataaataaataaataaataaagggacttcaaacacatgaacagcagccaggggaagaatcaaaatcatattctgtcaagcaaactggaaaagtaccactgtgtgtaccaatagcctccccaccacagaccctgggagcatcgcctcatttatggtgtggtccagtcatccatgtgaaggatgagtttccaggaaaaggttattaaatattcactgtaacatactggaggaggtgaggaattgcataatacaatcttagaaaacttttttttcccctttctattttttgagacaggatctcactttggcactcaggctggaggacagtggtacaatcaaagctcatggcagcctcgacctccctgggcttgggcaatcctcccacaggtgtgcacctccatagctggctaatttgtgtattttttgtagagatggggtttcaccatgttgcccaggctggtctctaacacttaggctcaagtgatccacctgcctcgtcctcccaagatgctgggattacaggtgtgtgccacaggtgttcatcagaaagctttttctattatttttaccttcttgagtgggtagaacctcagccacatagaaaataaaatgttctggcatgacttatttagctctctggaattacaaagaaggaatgaggtgtgtaaaagagaacctgggtttttgaatcacaaatttagaatttaatcgaaactctgcctcttacttgtttgtagacactgacagtggcctcatgttttttttttttttaatctataaaatggagatatctaacatgttgagcctgggcccacaggcaaagcacaatcctgatgtgagaagtactcagttcatgacaactgttgttctcacatgcatagcataatttcatattcacattggaggacttctcccaaaatatggatgacgttccctactcaaccttgaacttaatcaaaatactcagtttacttaacttcgtattagattctgattccctggaaccatttatcgtgtgccttaccatgcttatattttacttgatcttttgcataccttctaaaactattttagccaatttaaaatttgacagtttgcattaaattataggtttacaatatgctttatccagctatacctgccccaaattctgacagatgcttttgccacctctaaaggaagacccatgttcatagtgatggagtttgtgtggactaaccatgcaaggttgccaaggaaaaatcgctttacgcttccaaggtacacactaagatgaaagtaattttagtccgtgtccagttggattcttggcacatagttatcttctgctagaacaaactaaaacagctacatgccagcaagggagaaaggggaaggaggggcaaagttttgaaatttcatgtaaatttatgctgttcaaaacgacgagttcatgactttgtgtatagagtaagaaatgccttttcttttttgagacagagtcttgctctgtcacccaggctggagtgcagtggcacgatctgggctcactacaacctccgcctcctgggttcaagcaattctctgcctcagcctcccgagtagctgggattacaggtgcctgccaccacacccggctaatttttgtatttttagtagagacggggtttcaccatcatggccaggctggtcttgaactcctgacctagtaatccacctgcctccgcctcccaaagtgctgggattacaggcgtgagccactgcacccagccagaaatgccttctaatctttggtttatcttaattagccaggacacttggagtgcatcccgaagtacctgatcagtggcccctttggaatgtgtaaaactcagctcacttatatccctgcatccgctacagagacagaatccaagctcatatgttccatcttctctggctgtatagtttaaggaatggaaggcaccagaacagatttattgaaatgtttattagctgaagatttatttagacagttgaggaaaacatcagcacccagcagtaaaattggctctcaaagattttcttctcctgtggaaagtcagacctctgaggccccatccaggtagaagtactagtgcaagaagggcctctgctgtccacttgtgtttctgtgatctgtgggaacattgttaacgccacatcttgacctcaaattgtttagctcctggccagacacggtggctcacacctgtaatcccagcactttgagaggctgaggcaggtggatcacctgaggttaggagttcgaggccagcctggtcaacatggtaaaaccccgcctctactaaaaatacaaaaattagctggccgtagtggcgcacgcctgttatcccagctactcgggaggctgaggcaggagaattgcttgaacctgggtggtggaggttgcagtgagccgagattacaccactgcactccagcctgggtgacaagagggaaactccattaaaaaaatgtaattcccgtgtctgccatcttaagtgtaaaggtggctaaattatatagaaaaataagacaatatcatttcccaattacattcctttcctaccgcactctatgatgctagctgagatttttccaaaagaaaatggcttaaataaaaccctaagagaaagaaaaactttaaatccctccaaagctcaaaagtaatagaaacagatgagtttggagtcaggatttctctgtaagattgcctaggctgtgtactgcacatctccaggtgccactgttgacagagattataactacaatgtgaagtgaatggtgccactgacagttatgcaaaccgtccagagcatagccacctgatcctgctgggattcctcttgccagtccatcagcagttccccttgaaagtttcaccaaacatcccttaaatctgccctctcctgcccgtccccagtggaggtcctcatcatttttcacctgcatttttgcaggagctttcttatatccaccttcctccttttctctcagcccatcatctagctacacagtctccagggtaagctttcagaaaggcaatctcttgtctgtaaaacctaagcaggaccaaggccaagtttcttagcctgaaaaatgtgcttttctgactgaactgttcaggcactgactctacatataattatgcttttctaccccctcacactcaacactttgactccagcaatcccaaatccccagatccctaagtgtgctgtgctattttcacgtggctctcagacttggccagtgctgtttccattttggtctttattccccacatctctgcctggggggtagattctaccctgaaaaatgttcttggcacagccttgcaaactcctcctccactcagcctctgcctggatgcccttgattgttccatgtcctcagcataccatgtttgtctttcccagcactgacctaccatgtgtcacccctgcttggctgtaccttccatgaggctaggactatgtgtctcctttgttgactgctgttgccctagcatcttgcacagttccttgcacacaattagagctctataaatgtcaaataaatgtgttataattatatgtttaagatagttgttcaaataaactctaaataaccccaactccaagagtgttagcaagaaatataaattttacagaagaatggttggaggtggggagggtgtccacggagtgagttacctcacacaggcacggaaaaacttgaacctcctaaggacatttttaagctctctttcccattttctctcctggattcccattgcctggtctcatttctctcttctccaccacaccacttcctcaaaaattcctttagggtttgttcttaagcttagataggtttcccattctgaaatacaaaggcctgataattagccaacttaccttgttggggatgtggaaggcaagactctcagactccatgactcaggtatattgcaacaattaggctgaaagttccttgagagtaagtgtccaaatcttttcatgtttggttcccagggctcactacagttgttggtatatcataggcactctaatatcttcttaaagaatcaatatcattaaaatggccataactgcccatagcaatttacagattcaatgctatttctatcaaactatcaaggtcatttttgttttattttttttctttgagatagaatctcgctattgtcacccaggctggagtgcagtggcgcgatctcgactcactgcaacctccgcctcccgggttcaagtaattctcctgcctcagcctcccgagtagctgggattacacgtgcctgccaccacacctggctaatttttgtatttttagtagagacaaggcttcaacatgttggccaggctggtcttgaactcctgacctcaggtgatccacctgccttggcctcccaaagtgcagggattacagcatgagccactgtgcccggcccatggtaatttttcacagaatcagaagaaactattctaaaattcatatagcggccaggcgaggtggctcacgcctgtaatcccagcactttgggagacagaggcaggaggatcatctgaggtcaggagttcgagaccagcctgtccaacatggtgaaaccctgtctctactaaaaatacaaaaatttgccagtcgtgatggcgggcacctgtagtcccagctactcgagaggctgaggcaggagaattgcttgaacccgggaggtggaggttgcagtgagccgagatcacgccactgcactccagcctgggcaacagagtgagactccatctcaaaaaaataaataaaataaaataaaataaaattcatatagaaccaaaaaagagcccaaatagccaaagtaatcctgagcaaaaagaacaaagctggaagcatcacattacccaacttcaaactctactacaaggctatagcaactaaaacagcatggcactgctacaaaaacagacaggtagactaacggaacagaatagacaactcagaaataaagccacacacctacagccatctgaacttggacaaactcaacaatattaagtaatggggaaaggactccctattcaaaaagtagtgctgggataactggctatccatatacagaagaatgaaactagactgctacctatccccatatacaaaaattaaatcaagatggattaaagacttaaatgtaagatctcaaactaaaaaatcctagaagagccaggcgcggtggctcatgcctgtaatcccagcactctgggaggctgaggcggatggatcacctgaggataggagttcgaggccaggctggccaacatggtgaaaccctgtctctactaaaaatacaaaaattagctgggcatggtagtgtgtgcctgtaatctcagctactcgggaggctgagacaggagaatcgcttgagcctgggaggcagagtgagcccagatcgcaccattacactccagcctgggtgacaggagcaagattccatctcaaaaaaagaaaaagaaaaaaaaaatcctagaagaaaacctagtaaatgcccttcttatatcagccttgacaaagaagttatgactaaatcctagaaagcaattgcaacaaaaacaaaaatttacaagtgggatctaattaaactaaagagattctgcacagcaagagaagctatcaagggagtaaacagacagcctacagaatgggagaaaatattcacaaattatgcatctgacaaaggtctaatatccagaatctataaggaacttaaatcaacaagcaaaaaccaaataaccccattaaaaagtaggcaaaggacacgaacagacatgtctcaaaagaagaaatacaagtgaccaacgaacatgaaaaaatcctcatcatcactaatcatgagagaaatgcaaatcaaaagcacagtgagatatcatttcataccagcaagaatgactattaaaaaagtcaaaaaataacagatgttgcaagactgcagagaaaagagaacgtttatacactgttggtaggaatgtaaatacattcaaccactgtggagaacagtttggagatttctcaaagaactgaattgaactaccagtcgacccagcaatgccattattgagtatatgcccaaaggaaaataaattgttctatcaaaaagacaaatacacccatgtgttcatcacagcactattcacaatggcaaagacatgaaaccaaaccaggtgctcatcaatggtggattagattgtgtacatatataccaccatatggtacatatacactgtggaatactatgctgccataaaaaagaatgtaatcatgtattttgcagcaatatggatgtagctagaggccattattctaaacaaactaacacagaaacagaaaccaaataatgcatgttctgacttaaaagtgggagctaaacactgaatacacatgggcataaagatgggaacaatagacagtgggggctattagagaggcaagggctgaaaaactacctattcggtgccctgctcactatctgggtgacagagtcattagcactccaaagctcagcatcacacagtatacctttgtaacaaacctgcacatgtaccccctgattctaaaataaaagtcgaaggaaaacaacaaaaacaaaaagaaataactcctgagttggggtctccatctcttagttcagcctattggcagtcccctttttcaagttctaaggagcctgtactagactactcttcatttagtcccataataatccctctttcaattattttgccttcaaacctatagggaagggattggaaatgaagtttcagtcattccctaagtaaaatgtatatacatattttaattgaaacaggatttcactctgttgcccaggctggagtgcagtggtgtggtcatggctcactgcagcctcaacctcctgggctcaagcaatgcttccatctcatcctcccaagtagctgggactacaggctcgtaaattttttagagaacaaaaacacagtctttagatttaaacatgtgaaagcagaaattttaaaaatacaatgaaagagttggaagacagagttgaaattgttcagaaattacagtaaaaatactaagagataggaaatagtcaacttccaaatgagaagaatcacgaaagagagaacagaaaagatagaaaaaaaattatcaaagaaataattcaagaacatttccttaaagtgaagggcatgagattccaggtatattccacatatagaaaaatatcccatacaaaatcacattgttatgaattttcataacatgagggacaaaaaaagataatataagtaaccagagagggaaaaaataaataaacaaaacaagacaaataggtcatatacaaagtaatattcatcacaatagcttcatagttctcaataataacaaaaagcctttaaaattctggttgaagcagttcagacaatgccatcacccaaaaatatgccattttggcatactgattattattagctgaaagcacttgagaaacagcagactgtacaggaagggctttccaacctcctcttttctacctaaaaacaggctagaaaatttcccatgataaaggtgccctccctctactagaaagagaaaaacatccttatcaccagagatagggaatcaatgccaaaatggatctgaacaaacttattggaataacccttgtcttccactacttatccccaatatagctcttagtaatttccccaagcccctttgtcttgtcatttcttcacaaatttatcatttctttgtctaaaacatatataaacttgtctgctatggtgacttcttcgggtctacatttgcttgtgaggactcccaggtacatgtaaaattgtaataagacttgcgtgcttttctactgttaatctttcctgtgtcagtttaattcttaggcctagctggaaacttaagagggtagaacagaaatttttcctttcctacatggtgaagggacattctgtaataaaactagcctcaacattaaaaaaatgtgatgtaataaaaaacaaaggaaaaagaaaacaaaacagaaaagcaattaataacactaggaaacacgaggcattgtacaggataggaaacgtcctgttatgttacacaatgcaacagtgggtattgttttcatcattattataatgaaaatgctaaatagtgatttgaccaacaatccagtttaaaacatttggaggaatgtgaatgtttatggccagaaaatggggagaaaaatggttaaggaaacaaaatctcatcatctagagtgggaaggagactgataattcctaatatgaaccaaaaactcaaacttttttttttttttttgagatggggtctcgctctgtcgcccaggctggagtacagtggcacgatctcagctcactgcaacctctgcctcccaggttcaagagattctcctgcctcagcctcttcagtatttgggactacagttgcacactatgatgtctggctaatttttgtatttttagtagagatggggtttcgccatgttggccaggctggtctcgaactcctgacctcagatgatcagtccgccttggccccccaaagtgctgggattacagacatgagccattgcacctggcctgaaaactcattttatttagatatgttaagggaaatctcaaaataatcagctagaaaaattgaaaatggttgcccatgaggaggggagaactgttattatttatgtcaaataaaatttgtaggaagccattgatttggactgtgctcctgcactaggccccaatagaccaaaccacatggagtcactcttgctaaagttccacgtcaccaaaccaaagctaagtagtttatcttaccttctgggaaattaggggagagaaataatagacaaatccccaaacaggccagttttagctggcatataaggaagtcctctctgttttaaccgtattaggagagtaactttgaaaagaccgtccactttttggtccctgtttctgttttcttctgccttttctgcctataaagctaacttcctctgcccagctcactggagtaccttctctgaatttttagaagacaggctgccctgatccatgaattgcaaatgaaagccaattagatcatttaactaaattcattgtaattttgtcttttgacatttgtaaacaagccttgtagtacttgctaaacaatgggctgggcgcagtagctcacacctgtaatcctagcactttgggaggctgaggtgggtggatcacctgaggtcaggagttcgagaccagcctggtcaacatggtgaaactccgtctctactaaaaattcaaaagttagatgggcatggtagcatgtgcctgtagtcccagctactcaggaagctgaggcaggagaattgcttgaatctgggaggcagaggttgcagtgagctgagatagtgccactgtactccagcctgggcagcagagcaacactctgtctcaaaaaaaaaaacaaaaacaaaaacaaaaaaacaacttgctaaacaacatatgtttattatttggtaaattataaacaataaattcaaaactttaaaaagaaaacattttattgatagctcactgaatacaaatttataaaatattatttatgcattaagtttcagttacacattttcacccatcattacagatgtcatatggagttgctagagtatgagaagagcttcttcatcccaacagctttcaaagtgaagaggcgactcatgcctgtaatcccagcactttgggaggctgaggcgggtggttcacttgaggtcaggagtttgagaccagcctggccaacatggtgaaacctcgtctctactaaaaatacaaaaattagctgggcgtggtggcgcacacctgtaatcccagctactcaggaggctgaggcaggagaatcacttgagcccgtgaggtggaggttgaagtgagccaagatcatgccactgcactccagcctgggtaacaaagcaagattctgtctcaaaaaaaaaaaaaaaaaaaaagtgaacatctgggtcccccagatctcttcagagatatgtaatgttctcctttttccaactacataactctttaagctgggttttcttcatatactccaatgaaaacaacatattgcaacagatggaatgaagaggcaagtagaagaatccagctgttttctattaagccaaacattacaattgtcagctgaagaattctgagattcataaatttggaaagaaaagcttcatttctcataaaagattgcagcctgcagggtggccattctgacaggctaagaaatgtagtctctggccagaagccaaaaacagacactgagggtcagaagaataagatgggcatttatgctgaataggatggccaaatatacatattcaataaactacagtcatgaatattcatgaaaggagaaacatgcacatgctcaattgagcttcatgcctctccatgggacgcgtgtgcaaaaaatggcagcattagcatgatcagagggtggagttttctgtcctctgatatcaaaaggtgaaacagaggacacagaaaccctcactgcacatcctctgtaaactggccagaaccactccattgtgggcagtctgttatcaggaaggaatgctggttagttgtgcagaaactgcaaaaggaaggggcagtgtcagaccattggttgatatcagcggtgcagctcgtctttccaaagggctggtttctgtttaacctgtaggaaggaaatcctaatggcgtttagcaatggagagggtataacaacacatcatggcaagaactcagttttcaaggtttctctggggtccccttggccaagaggtggtgcatccgtttagtcagctgggggacttaggatttcatttttatttctcagagttttataaaactctaaaataattatttgacagccaggtgggagggggtccctggagaaactccaaccagcctgcctactagggtggagccttgggagtttgcagcagggaggagcctggcgcctcctcttcctatgtgaacctgggattctagcagcctggtgggaagcactgtagcaggagactctggccttgcagaggatccctgttcccctcatccctttatttccccttttcacttaataaaaccctgctttactcaccctttaaaccatctgcaagcctaaatttttgtggctgtgggatagacaagaaccttctctttagctgaactaaggaaaagtcctgcaatgatcccattcttcacaccaaatatgttttgtttcaaaagtatagttatttatcataaatatgtcattaatattgttaaatcaaatttagcctaaagctgcctccttatatagtttaagcttgacctaaaggtttctctgtacttagtgaattgtagcctacccagatgtgtaaacaagactgtgaactactcttgtgacaaacattggattttggccaatcaaaggaggtcaactcttgacactgctttcaaataaggcaaatattgagctgtaaacaatctggctgtttctatacctcacttctgttttctgtacgccacttttctgtctctgtccataaatgttcttccaccacgtggctgtgctggagtctctgaacctactctggctgaggaggctgcccaattctcaaactgttcaattaaactcggttaaatttaatttgtctaaggttttcttttaaccatataaacaagtgagtttatgattgttatgtcttttttcttttcttttttgagacaaggtcccactctgtcccccaggctggaatacagtggcatgatcacggctcactgtagtctcgcactcccaggctcaagcgatcctccatctcagcctcctgagtagttgggagtacaagtgcatgcaaccatgcctggctaattttttttttttttgtattttttgtagagatagggttttgctacattgcccaggttgatctcgaactcctgagctcaagtgatcctcttgcctcagccttccaaagtgctgggaccacaggcatgagtcaccacacccagctattatttctaaattaatgaacagatgaacattttcaaaatttctcagttttaattttaaatatgattaaaaggatagatataacacacaaacaaaagctctatggagtcctctataactcaagaatataaagggtcctgagatttttctttaaagagaaccactgcactctcctggcctactagctctccgcaatccatcctgcttctccccttggcaggagagacctgttctagaccctcaaggacccctcataacatcacctagctattatctaaggaatctttctccatttggacttcccatttttttcttccccctttaaggtccccttattcttttcatctaattttgtgtgccacctgcagagtccttcttcttcttcttctccttctccttctccttcttcttctcagagtcttgttctgttgcccaggctggattgcagtggcacgatctcggctcacttcagcctctgccttctgggttccagtgattctcctgcctcaggctcctgggtagctgggactacaggtacccaccatcatgactggctaatttttttgtatttttagtagagacggggtttcacaatgttagccaggatggtctctatctcctgacctcgtgatccggccgcctcggccttccaaagtgctgggattacaggcatgagccaccgcacccggcgactaatttttttttttttttttttttttgagacggagtctcactctgtcgcccaggccggactgcggactgcagtggcacaatctcggctcactgcaagctccgcttcccgggttcacgccattctcctgcctcagcctcccgagtagctgggactacaggcacccgccaccgcgcctggctaattttttgtatttttagtagagacggggtttcaccttgttagccaggatggtctcgatctcctgacctcatgatccacccgcctcggcctcccaaagtgctgggattacaggcgtgagccaccgcgcccggccggcgactaatttttatatttttagtagagacggggtttcgccatgttggctgggctggtcttgaactcctgacctcaggtgatccgcccgccttggcctcccaaagtgttgggattacaggcatgagccaacgcacccggcctgagtcctgcttcttccagatctggtgcccagtcctgacgccagaaagggggtcttgttccagaccccaagagtgttcttggatcttgcctgggaaagaattcagggtaagtcgcagagtataatgaagttaagatagttaattagaggctactcaattacagagtagggcatcctcagaaaacaagaggaggaaggcgctaccttaaatgtagtgcttgcttatgtaggttgtataagaattgtgtactttattacaaaggcttgtgatcagcttgtgacaggctattggtactgttattttcctgttactattgatttcagcaagaatttatgagtacactattatatttaaggcaaaacctattccttaagaatgctttttgttcttaaaatactgggacatttccataagttctgagtctttagttagcaacattaactcattccctcaatcataaacatctcatgaccaagagtgcccagttcctggggaatgtaacccagcaggtttggctttattcggcctttattcaagatggagtcactctggttaggacacctctgacagtccctggaaatccaaaggaacccttctgtgtggcacagggaatggaagaaagaaagagatgaggcaggaaaatagggtctggaggcagaaaacataagccgattcacacttcagctatgacaggaaatatcctctccatagggcgtatgcctgtaactttacttcatcctcttcatttacataggacgtatcctaagtaaccaatggaatcgtctagagggtatttaaactcccaaaaattctgtaacagggcctttgagcccctatgctcgggcccgctcccacactgtggagtgtactttcattttcaataaatcccttcattccttccttgctttctttgtgctttgtgcattttatctaattctttgttcaagacgccaggaacctggacgccctcccctggtaatagagagatgagcctttcaaatgacctgactcctttatcccagccaggtgtgtgcccgaccctgaaaggaggaatagggagggggacgttcaacccggcctcccgctctgtgttagcagcgtctggatgggtcagggtggaggtgggggtgttctaccctgctatttgctcctagagaagcttctctgcttcactagtctcacagttctaaaggcaagaacagccctagtgggatcttccaaggattttagaaaagaatgaataagggaaaaattaaaatattgcagggtgccataaaaacatcccagtaaaacaaacacctttctagatgctcattggaacgtaaatggagctcagcccccatcccttcacaccagatccagtcttcatctttgtggttcactgccccctcaccactcaggaggaaaaccccagcttctgttctggctccccttctctcacttagaatttttcaccagagtttcagaaagatttgtcaggaccactccatgcccaaggtaaaaagtgtaagtggtacaaaaaggtagaaactcatcagacccccaaagagtgtcatttaaccatacaaagccctgataaactccagggcagaagaaaaagctgcatccttgactccactggggcattcttatgtaaactaagatccaagaactgcatcaggagagaaatcaagagccctggggatgttaggatgagccctagaggtgctaagacaggttatttgaaaaaccaaaaagtagactgagattcccttccttttcagggaagaattgagacctttcctttcttactgttcagagtgggggctgataagggtaattatttcctggagccactggctactgccctgggaaggaaatccgctgggttgggggagggaggaaggcagaaccaggcattaactctccctccactacatccctttcccgtacccctcccctcctctccttccccccactccctgcccccgccctccgaaaatgacacttggcctgagaaaggaggaaggtagaataggtggacacttcccttgtcctgctccaggggtgtctcagtgacaaggagatgtgaaaaaagaaggaatcccaaggctccccttggaaagaagggagatctccaggggctttgggaagtcaggttagtactgggaaggctgaagactcccagtagatagcgttcagggctgcatttggctgcaatcctataaaatacattcttctctaaggttggatacaagcatttagaagactggccattaaaaaaataaacagtattaataatattaataatcatgagtgtcagtagtgttgaattttttctggaatcctttcccaagttgcctaatgcccagagaaggaaaataacagtgtttagtagacataaattataggattagtgcaagtagctattgagatgatgagccaaggcttgtaaattggttttgttttggttttcctaattagatgtttgcgcctatctgtgtatgtgtgtgtgtgtttgtgcgtgtgcatgctcgcatgtggttaatttcatgacttttgcctctggctcttcctgattaaaaaaaatacttaaaatggtaggaagtggcacacacccttgatggacctgtgtttatattaaagaattggcttagtaaatttaactgggacaaggaaactgtgaaggactgtatttttgccattatttaataattcatatattcaaccgttactgattgcctattttgaaccaggccacgtgctaggatacaatggttaacaaacacattccctcccctcaaggaattcatggtctagtgaaatacagagatagaaaagaaatagaaaagtatatcaataaaatgcattgtggaaagagttatggtcatagtgtgtactatatgcttatagaggctgcctttgtataaacatacataagactgctttttaaattataaaaggcagtacataggccaggcgtggtggctcacacctgtaatcccagcactttgggaggccgaggcgggtggatcatctgaggccacgagttcgagaccagcctggccaacatggtgaaaccccatttctactaaaaatacaaaaaaaaaaaaaaaattagccaggtgtggtggtgggcgcctcatcccagctatcaggaggctgaggcgggagaatcacttaaacccagacggaggttacagtgagctgaggtggagccattgcactccagcctaggcaacaagagcaaaactccatctcaaaaaaaaaaaaaaaaaaaaaaaggcagtacatagtacaaactgcttgggttttgttgttgttgttttactgtaccatataggttggagatcattccacctagtagctgaacattttaagcagatcatctggctacaggcagtgagtaggatgaactgggagagtgatgagtgagttagagagttagggagggagggtgctgtcggagtgttaccggaaaggggtcccgatccacaccctaagagagggttcttggatctcgcacaagaaagaattcagggcgagtccatacagtaaagtgaaagcaagtttattaagaaagtagagaaataaaagaatggctactccatagacagagcagccccgagggctgctgttgcccatttttatggttattccttgatgatatgctaaacaaggggtggattattcatgcctccctttttagaccatatagggtaacttcctgacgttgccatggcatttgtaaactgtcatggcgctggtgggggcgtagtagtgaggatgaccagaggtcactctcgtggccatcttagtgttggtaggttttggccggctccaacaccggcttgttgttttatcagcaaggtctttatgacccatattctatgcccacctcctgtctcatcctgtgacttagaatgccttaactgtctgggaatgcagcccagtaggtttcagccttattttacccagctcctatttaagataaagttgctctggttcacacgcctctgacaagaacatcttcatgcctgtgcctggttgagagagggaggcctctgcgctgctgctggatctagtgaagattcactcagtctctcaaattcctctacagtttctctaatggaagagaaaagtggtgttattgctgctagggagcaacctagaagttattttatttatgccatagatatggtgggctaagcactgtgccaacgttcaataagtcactgcagattctccataaattattgtgacaagtacaattgtttgtaaggcttagatctaggtgtgtaagtccaaagaagggtgtgaagcatctgtatttctgttatgtagttattaggaaaaaggatgttggggccttaaaatggccatttttaacatttccaaacttgtgttgaattctaagattttataattgtatgtttccagttgagaagagctttgatattggtagctctaaataaataaataccgttgacctggaagagaaggtaaagtttagggagaggcctttttttagctttatatttaaacattttttataaatgtgattcatgggccaggcctggtggctcacacctgtaatcccagcacttttggaggccaatgcaggtggatcacttgaggctaggagttcgagagcagcctggccaacatggtaaaaccccatctctactaaaaattagccaggtgtggtagcacacacctgtaatcccagctactcaggaggctgaggcaggggaatcacttgaacccaggaggcgaaggttgcagtgagccgagattgtgccactgcactccagcctgggtgacagagtcagactccgtctcaaaagcaaaacaaaacaaaatgttattcataatgctcgggttgtaactatagtacttatctagcaaaagcttgcttttttttttttggctttgactaattgaaactgcaagagcttactggcagagtggtgtactggtcaatatttaaccaattctccaaaggggaaaaaccctgatttgtatgtaggatttgtcagtttccatggtataaatagtcttcccacagctggtagggtgaccaacttgttctggtttgccaggggctttcccatttttaggcctgaaagtcctgaatcccagaaaattcctcattccccaggaaatagcttgattggtcaccctaatggctggttgcaagctcccgatatgacagaactggacgagaagttgggcagagatgtgcacatggtaccagcctatgccaggagcagcggcctccagcaccccactgtcagggagtccttggcccagtagaggatggttagcagggcccggctgttgttcatattagctctcaaatttaccaccaaccctgtattagtttcctggagctgctgtaacaaagttccacaaacgggggtcttaaacacagaaatctattatctcacagttctggagggcagaaatagaaaattaaggtatgagcaggactctgctcttttgatggctctagataatccgttgtatgtcttttcctcagcttctggtttcacaggtaatctttggcgatccttgacttgcatctgtgtaactccagtctctacctccatcatcctgtggcattcttctttatttttctttctttttttcttttcgagacagagtttcgctctgttacccaggctggagtgcagtggcgtgatctcggctcactgcaacctctgcctcccaggttcaagcgattctcttgcctctggctcccgagtagctgagattacaggtgtgcgccaccacacccagctaatttttgcatttttagtagaggcggggtttcaccatgctggccaggctggtctcgggctcccgacctcaggtcatctccctgccttggccttctaaagtgctgggattacaagcgtgagccactgcactcggcccatggcattcttcttttggtgcctttgtcttcactgacttcttgtaaggaaatcagtcgtattggattagaggcctaccttattccagtatgatctcattgtcttaatttaactaaaacatctgcaacaaccttatttctaaatgaggtcacattctgaggtattagggtttagtacttcaacatatcttttttttttttttgagacagggtctcattctgtcactcaggctggagtgcagtggtgcaatcacacagctcactgtaactttgaactcctgggctcgagcagtcctcctatctcagcctcccagataggtaagattacaggtacatatcaccatgcctagctaatttttcaaattttttataggggctgggcccagtggctcacaccttgtaatccctgtaatcccaacactttggtaggctgaggcgggcggatcacttgaggtcaagagtttgagaccagcctggccaacatggtaaaatcccatctctactaaaaaaaatacaaaaattagccggatgtggtggtgggtacctatcataccagctactcacaaggctgaggccggaaaatccctggaacccgaggggcggagatcgcagtgaaccgagatcacgccatgcactccagcctgggtgacagagcaagacataaccttaaaaaagaaaaaaaaaaatgtagagatgaagtcttgctgtgttgcccaggctagtctcaaatgcctgggctcaagcaatccttctgcctcagtatcccaaagtgctaggattacaggcatgaggcactgcaccaggcctacatcctcttttttttttttttttttttttttttttgagatagagtcttgctctgtctcccaggctggagtgcagtggcacgacctcggctcactgcaacttccacctcctgggttcaagtgattcttctgcctcagcctccagagtagctaagactacaggcataatatctctcttagatatgacaaataatatcacagagtgtacacccactgtgatgttaggagtaatacctccctatgatattacaagtaatactgcctttagatactacaaataatatcacagggtgtacatctactgtgatattaggagtaatacctcccttagatattacaaataatatcacagggtatacacccacggtgatattaggagtaatatctctcttaagcgatcctcccatctcagcctcacagaattaaaggaattacaggaagagctgctatacctggctggatctatgttttaaaaatataacccagataaccctgtggtcagtgtctaagatgaattggattagaccaagggagaaaaactaaagatgggaatactagtttgggactttgcttgcttgcttgctctcatttagaaaacatttagtagttctacaatgctcaggcactgttctgggagtcacaaatataggattgaataaagtaaataaagcacttgctctcctggagctcacttttcactgggggaatgcagatagtagacacatacatctatagtatcagtaagtgctaatagaaaaatgaagcaggtgagatggatcatgctgagtagaatgtatcttcttttccttccttccttccttccctccctccttccttctttccttccttctttctttccttcctttcttcttttctctttcttcctttctctctctttctttgctttttattgtcttaaaatgtacataacataaaatttaccctcttaaccatttttaagaatacaattcaaggccgggcatggtggctcacacctataatcccagcattttgggaggctgaggcaggcggatcatgaggtcaggagtttgaggccagtctggccaatatgatgaaaccccatctctactaaaaaatacaaaaattagccaggcttggtggcacatgcctgtagtcccagctacccgggaggctgaggcaggagaatagctggaacctgggaggcagaggttgcagtgagctgagatcgcaccactgcactcctgcctggacaagagagcaagactctgtctcaaaaataaataaataaataaataataataataataataatacaattcagtagccttaagtacatttgcattgttatgcagccatcaccaccatccatctccagaatttttttgagtggagctctttttaatagagtagttgaaggcctctgtgacacagtagcatctgagcagaagcttgaatgaagtgagaaaagaatccttttgcatagtttaggggaagtatgttccattcctggtcctggaaatagttaagactatcacaatagtgcaggagaaagatgatacaatacagtttgtgtagctgaaaccccgtcttcagaatgtaaaggagaacagatgggaagtcatgttcctcccagaagtaattcatgtagcagagaagccaatgcagatccacgagacagacaattcagtgctctgcacaagaactgtgctttaagcatggagaggatttttgtatctgtcctgggatcctacatcaaacagcatgtggtgattgtgaacacaaacgtacaagactgtgaaccctaccaagtttccttcttccattagatatgaataaggagtcatgagtttcctttggaatgtcctttagcctgttggtacatgttttgcctgtgacgaatgcagttactcataaatcattgagcacattgggtacagagggcaaaagataaattcctgtatttcctctattcggtcaacagaaatacctctaggccataatccattcatccaatctaataattttgccatccataaaaccttcaggtgttctgaattcaacatctttttttttttttttttttttttttgagacagagtcttgctctgtcacccaggctggagtgcaatggcaggatctcggcttactgcaacctccgcctcccagattcaagcgattctcctgcctcagcctcccgagtagctgggattacaggtgcccgccaccacgcccagctaattttttgtattttcagtagagacggggtgtcaccatgttggccaggctggtctcgaactcttgacctcaggcaatccacccgcctcagcctcccaaagtgctgggattacaggcgtgagccaccatgcctggctgaattcgacatcttgcacctaattcctgttcagttaaagacccaaatcatgatctctgacttacctggatatttgaaagattaacttgctgtggtgataccatactagagtcacaaaatcaagccctaccctgccacagccacctaaaggaaattaggtgatatacaaaagaaattgaccatattgttgtccttttagtgactctcctaattttcttcccctgaaaacttacagagaaatttgagtatgtttgccttaggtggatgcttgtttttttattgatatgaaaagcagtaagaggaaatggagttttttggcctgttaaggaagggcagccactgtaaacacagttgagtgcaaattcacagtgttagaatgttgaagtgtatataatgattttgcaaaattttctacaaggctgatacagtatccaatcaggactaggattagatatattgtcatgtatgtttgcgcaggaaatgcagagactctaaggtgctacaactgcaatttgacatgtgggatagttcactggtaactgttgatctccctgaggtttaagtttacagttccacagctctttatctgaaactcttgggctatgtgttatggaatttagaattttttccgaaatacgttgcatatattgtatattatgacatgatacctccaagaaagacttggagtcacatcctataaacaaacacatgaatatatcccagtgaaatgtatgactatttttactaaaacaaatgagaatcataaatagacttacattacttcaggtcagattttgctgccgaattagtttgggcatcgaacttttggtttcagagacaaaactgtgaaattttagattatattatggggttgtggacccatgtaaccctcctctccgtaattcctaaaagcaagcaattgcatcaaccagtctcatgagtagctgcgattctagaaatcaagaatccggatctgaaattagccgggcatggtggcaggcacttgtaatcccagctactggggaggctgaggcaggagaatcgcttgaacccaggaggaaactgcagtgagctgagatcgtgctgctgcactccagcctgggcaacagagtgagactctgtctcaaaaaaaaaaaaaaaaaaaaaaaaagaatccagatctgggcaggaccgaattgctgacatgcccccggtatagcagagacgttttgcctacatgttacacacctgagtaatagttgtcagcagctgatgaagaagatgaatgtgctcttaatgtccatctttgatttccagtcattttgcttctgggtcttggcttcctgaggaaagaagtctccagtaggtgaatgcagtgatatggagaatactttcttctggctgcatgcagtaactcacacctgtaatcccagcacattgggaggctgaggtgggcagtgcacttgaggttgggagttcgagaccagcctggccaacatggcaaaaccccgtctctactgaaaatacaaaaattagctgggcgtggtgacagacacctgtcatcccagctactcggtaggctgaggcatgagaatcacttgaacttgggaggtagaggttgcagtgagccgagatcgtgcctctgcactccagctgggcaacacagcgagactctgtctcaaaaaaaaaaaagtgtgtgagagagagtactttcttcctgtttcctcataggccagttctctctggcatgtgagtttaacatcagtcacctccttcacacacagcgggtgcattcgtaataggaggtccttagctgggagtttttatggcacatcagtggggcgtgaaaacaccacataggagctaatatatctttgctggctgctttctccggctccgcagcagacagaaaccctatgaatcatatccaggggtcaggtgcaggcaacagacaactaatatctcccaagtgagttgaaaaggatcttgttacccagcatcctaaggaggttgtagccttgggaaccacaggcaagaataattaactcagctcctcggttagtgcctcttcagttcgagatggaatttatttgcaggcatggctccttaatatgccaaacccatgctcaagacatactccttctcctggaaggttaacgtggctcctgtggctgttccatccctgaggaaaagtgaggaccatgctctccaaacaggccatgtgctggactacctctgtttctgtctcctgggattccaatcagcaagtgagcaacgaagcaacccagacagtgtggttcataggatggctgggtaagtggctgtttgttttttccttactgtggatatgtatcagtgaaggaatctgtagaacattcttgatgggaacatttagtcatatcaagtcaataaattaatgtttaggctgggcgcagtggctcacgcctgtaatcccaacaccttgggaggccaaggcgggcagatcatctgaggtcaggagttcaagaccagcctggccaacatggtaaaatcccgtctctactaaaaatacaaaaattagctgggtgtggtggtgcatacttgtagtcccagctactctggaggctgaggcaagagaattgcctgaacctgggagatggaggttgcagtgagctaagagtgcaccattgcactctagcctgggcaacagagtgagactctgtcaaaaaaaaattaaaaaaaaagaaaaatcattattttatttttgacttattattaatataaataattatatcttggccgggcatagtgtctcatgcctataatcccagcactttgggaggccagggcaggcagatcacttgagccaagaagtttaagaccagcctgggcaacacggtgaaaccctgtctctacaaaaaatataaaaaattagctgggagtggtcagcttgcctgcagccctagctacctgggaggctgaggtgggaggatcacctcggcccaggaggtagaggctgcagtgagccatgattgtaccactgcactccagcctgggtgatagagtgatgagaccctgtctcaaaaaaaaaaaaaaaaaaaaaaagaaagaaagaaagaaaaaagaaaggaaaagaaatcatatattggtgaggagacaattcaacacatattttttattgaacacatactatgtgtcagggtaccagatataagctctatctacaaggattttaggagctggagtatgtgtatggggggatgtatgagtgtgtataacaaagacgactcctggggaagaagaggaagacaagccccagaggtatactgcataggcataatacacaacaggctagcaaagaagcaaaccatgggtatggtagagagaatcagaggatacattggggaccatgtctagtgagtgaggtcaggagagacttcaataatctgagtgaatttagacatgggccttgaaaagtggacaaggtttgttgttgttgttgttgttgttgttgttgttgttgttgttgttgtttttgagatggagtctcattctgtcgcccaggctggagtgcagtggtgcgatctcggctcactgcaagctccgcctcccaggttcataacattctcctgcctcagcttcccgagtagctgggactacaggcgcccgccaccacgcccagctacttttttatatttttagtagagacggggtttcaccgtgttagtctggatggtctcgatctcctgaccttgtgatccacccaccttggcctcccaaagtgctgggattacaggcgtgaaccactgcggccggcctaaatttgttttaaaagtacgcataggaaggctgggggctgtggcttatgcctgtaatcacagcactttgggaggccaagacaggcagatcacgaggtcaggagatcgagaccatcctggctaacacagtgaaaccccgtctctccaaaaaaacaaaaaattatccaggcctagtggcacacgcctgtagtcccagctacttgggaggctgaggcaggagaatcgcttgaatctgggaggtggagggtgcagtgagccactgcactccagcctgggtgacagagcaaactaggtctcaaaaaaaaaaaaaaaaaaaagtacatgtgggggacaggtgcagtgtctcagcctgtaatcaatcccagcactttgggaggctgaggtgggtggatcacttgaggtcaggagttcaagaccagcctggccaacatggagaaaccccatctctactaaaaatacaaaaattcgctgggcgtggtggcgcacgtctgtagtcccagctactgggaagactaaagtgagagaactgcttgagcccagaggtcgaggctgtggtgagcggtgatttcaccacttcagtctagcctgggtgacagagagagaccctgtctcatataaacaaataaataaaagtttatttatttattacacatatttattacacattattacaagaccttgaactaacaacattaacatgcatttgttaaaggaaaataaattagctcagatgctactacttttcataatacttgcacgattgatttcaatccctgttcatctgaatggagagttgcaggtatactatgcagctattctacttatattctgttttttaatgtaacagtattatttcttgatgtctctacacattttatatcactttaatatttaataaaaacatctaccataagttctaaaatggtaaaaggaagaatagtcattagtactgtcactaccctgaatgaatacaaatacagtttgcactagggcttattttgctcctgtcctttgcctgtgcatttcatttttgcatcgtggtaatcatactgggtgaattttgtattctgtaatttcaactgaatattatatcataagtgttatctacaagttccatgaggaccaaatcttctccacctttttcaccattttacttagcatggtatagtaaagctggctcaataaatatttgctgattgaataaatgttgttacatgctcttcctgattaacatatatatacgcatatacaattttttagtgactgcattaatttacttcattttttcctaattgttggatatttcagttgccatttttttgcttttatgaataatgtgttgatgaaaagatttgtgcatatagttttctctgcatttggactattgtctttttttttttttttaaagatagagtcttgtgctgtcactcaggctgcaatgcagtggcgcaatctcggctcactgcaacctccacctcccgggttcaagctattctcctgcctcagcctcctgagtagctagaattacaggtgcccacgaccatgcccagctatttttgtatttttagtagagaaggggtttcaccatgttggccaggctggtctcgaactcctgacctcaggtggtcctcctgcctcggcctcccaaagtgctagaattacaggcatgagccaccaacgcccagccttgactattgtcttaagatagggtgaaattacaggatcaaatgatttggacagttttgcaagtcttaatgcattttaaattaaaatgctttttaaaaaagctgggacagccaggtgcggtggctcatgcatgtaatctcaactcaggaggctgaggcaggagaattgcttgaacctgggaggcagaggttgtggtgagctgagatcgcaccactgcactccagcctgggcaacaagagcaaaacttcgtcttaaaaacaaacaaaaaaagctgggacagtttacaatgggcaatagccatgtaccagctttaccacaccttcacctgccctggtttttttgttgtgtttttcaattgttgttattgatttaagtgaaagaatttttttttttttttattgatcattcttgggtgtttctcgcagagggggatttggcagggtcataggacaatagtggagggaaggtcagcagataaacaagtgaacaaaggtctctggttttcctaggcagaggaccctgcagccttccgcagtgtttgtgtccctgggtacttgagattagggagtggtgatgactcttaacgagcatgctgccttcaagcatctgtttaacaaagcacatcttgcaccacccttaatccgttcaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccaccgttcccccctttctattctacaaaaccgccattgtcatcatggcctgttctcaatgagctgttgacagaatctcgctctgtcgcacaggctggagtgcagtggcgcgatctcggctccacctcccaggttcacgccattctcctgcctcagcctcccgagtagctggaactataggtgccgccaccatgcccggctaagtttttgtattttagcgtagagaccgggtttcaccatgttagccaggacggtcttaatctcctgacctcatgatctgcccgcctcggcctcccaaagtgctgggattacaggcgtgagccaccgtgcctggccaaatgaaagaatttttaatcaattagcctacttatataaccacagtttacatcacagggatactctgccaaataaatactcattaaaatgtgagcccattattttggtcatgtccctattatctctactattaccctatggataataagcaaagttgcaattcagctgtatctctaatttcaattattaacctatacgtataaataccagttgtattattacagaactatattattgttcacaactctttgaacatcacaatgagtaagtttttacattacgcactatcagtaatattaccttcattttctatgaaggcatccaatgaatatatctatgtgtatgtctatctatatctatatctgtatagctgtggctttctcactggaaattcataggtaatcccaacttcagagaaactatgcttttctatgtgaatttaaaattagttgtatttgccagaggcttaaataaaactacagtgatctttggactgttaacaaatggctaacacaaaatatttatttatgagttgtttgctaaagtccaaatgccataaagcaaacagtatgccacttacttgaactgatattttcttagaaaaactttttaaagatggctttaaaagagaaaaaaaaagcttgttaaaaatgtcttttaaagccattctagccatgaatctagaggtaaccactgactctaaactccatggagatttgtaaattgaatgacttacaacatcatgtcaaagtagagtggactgtaaagtgtgttaaagaggaccaaagtaatctttcacccagtgattgctgagcatggaggagggactgtcgttggctattcctctttcctttcttctcaacacctgactggtagtcacaggtcgggtgtttacctatttgtgccactgctcagagagaaggtggagcttcctgggaggagggacccaggttttctccaggctcaggagcagccctgccctcaggccaggcaggtgtggctggggaggggtaaggagtgccaaaagagcactcagcagtcatgtgacccttgtgaccttggccagcctgtttctgacaggtacagctgcccctatttagtcttcaggaagtaccagaacaccctaaaagcaacctctcactgggtccccttcaagactttctccatcccattaggatccctgcaagtgtcagccagtggtaactggcagatcttctagtccaccccattatgtttattttactgtatttggcttttaattaaattcaaaagagtacattattaaaaagtacaggtgtgggctgggtgtggtggctcaggtctgtaatcccagcactttgggaggcagaggtggatggatcacttaagcccaggagttggagaccaccctggccaacatagcaagaccctgtctccattaaaaataaataaatagccaggcgcggtggctcacacctataatcccagcactttggggggctgaggcaggcggatcacctgaggtggggagttcaagaccagcctaaccaatatagagaaaccccgtctctactaaaaatacaaaattagccaggcatggtggtgcatgtctgtaatcccagctactcgggaggctgagacaggagaattgcttgaacctgggaggcagtggttgtggtgaaccaagattgcaccattgcactccagcctgggcaacaagagtgaaactccatctcaacaaacaaataaataaataaataaagtacaggttcgtcttcaccactgttcccttactcccctaaataacgtctctcacctttccagttaaccactgttaaccaagatgctactcctctttccagcctttttcctacttattagcatatatgtgtatttactaaataaacaggtcaaactatatgtattgttttgcaaattgcctttttccttaaccatgtgtcttgaagaactttgcatattggcccatatggactagcttaccatttttaactaatggagagcattctttagagttggctggcagaaatacactaaaaagttgtgacccccaaatcaggaaaagccactaaagacaactaaaattcatttcaattcaatccccctccccaagtctttttttttttttttttttttttttttaagacagagtctcgttctgttgcccaggctggagtgcagtggtgcaatctcggctcactacaagctccacctcccgggttcatgccgttctcctgcctcagcctcctgagtagctgggactacaggcgtccgccaccccgcccgtctaatttttgtattttgtttttagtagagacggggtttcaccttgttagccaggatggtctcgatctcctaacctcgtgatccgcccgcctcggcctcccaaagtgctgggattacaggcgtgagccaccgcactcggcctttttttttaacatctgaaaacatatagactttaattacattttgttgaaaattcatgagccgggcacagtggctcacacctgtaatcccagcactttgggaggccgaggcaggcggatcatgaggtcaggagatcgagaccatcctggctaatacagtgaaaccccgtctctactaaaaatacaaaaaattagccaggcccctgtagtcccagctactcgggaggctgagtcaggagaatggtgtgaacctgggaggcggagcttgcagtgagctgagattgcaccactgcactccagcctgggtgacagaccaagactccatctcaaagaaaaaaaaaaaaaagaaaattcattcaactttggtgcttatccaaggacttataatgtaaatttctgacataaatcataaccctcagtacataatgtattttcaaaggaaacaagtcatcttaaagtaatatttttctatatgctaattgatacatttttatagtaaattgaaaattatgagtaaactgaaagtatgcttaacaacaaaataaatacagcatatatggttagcatatacatttcttagtgtaaaggcagcagtgaatttgtaccttacaacaaatctgtaactccagtagctttttttctggaatttatatggtgtctcaccatgttccacaatgctagaaaagtcttttttggcatcaatctatgcaaaaatttctgacattttccccaaatgacatgtaacttttttttaacttttccagaaaaatatggaaactttatcaaccacttcttaactgaacaaaaagttagagtactaccaaatgctcttttaattttgctctaacagatgttttaaaagttcagacatcgctgatgtttttaaggataactgcataaaacacactagatgattgctaaggatgaatcttagtatctgactcattcgagacatccttagtatccagaataaaatcagtagaaataaaagtaatataattttcaaagaattcatacatactggaagtcttagaaaaaccagcttctaaatgcaaggactaggagatttgcccatcgtactattaatagttacatacatttctcctcatgaagtaactgaagatttctggcttgtttgtggaactttagtttgtaggaaagcatattcatagggccaaatcttgttggtttctgttccagagaatgtttccaacaccccttttttctggtaatattccaggactggctttgtttgggtttcatgagcctttagtctcttgataaccgtctctggtttatcatcctcacgctgaatgagaggctccccagttagatcatcaatgcccacagttttgggagggttgaattcaatgccgtagacttggccactggtgggatgaatccccaaatttttatatagaaaaaatttcagccggacgcggtggctcacgcctgtaatcccagcactttgggaggctgagatgggcggaccacctgaggtcgggagttcgagaccagccttaccaacatggagaaaccctgtctctactaaaaataaaaaattagccgccattgtggcacatgcctgtaattccagctactcgggaggttgaggcaggagaattgtctgaacccaggaggcggaggttgcagtgagcagaggtcgcaccattgcactccagcctgggcaacaagagcaaaactctgtctccaaacaaaaaaaagggaaaaaaaaaaaggaaaaaatttcaaacataccaaatagtggaaagactaataaatgcccatatactttccactaggttgttaccacattcattgactgccattaatatctgatagggttttgtggttttaacatgagaagtatatgaaaagaagcagaactcatcaagtctcaaagtcttaagaattagaaagaaaaggcgcggtggctcatgtctgtaatcccagcactttgggaggccgagatgggcggatcacctgaagtccggagttcaagaccagcctgactaacatggaaaatcccccgtctgtactcaaaatacaaaattagctgggtgtggtggcgcatgcctgtaatcccagctattcgggaggctaaagcgggagaatcgcttgaacccaggaggcggaagttgcagttagctgcgattgcaccattgcactcgagcctgggcaacaagagcacaactctcgtctgaaagaaagaaagaaagagagagagagagagggagggagagaggaaggaaagacattatcaaatcataagagccaaaggaatgtaaaatccacttaatcgacctgggtggaaggtacaaatttctatgggtagaaaccaaattagtaatcctgggaggtgggctatatggttacccctttttgaaattatgaagcgatttaagtacaaacagggtttggtgagttccagccagatgtacttgctggtagctgtgcaacttcaaacatacttagaatgcaaaatccacaaattactggaatgatacatatatttgcttagtgagtgaaaagaagactcactcctatggtatacaaaatctaatcttgccgtcatctgaaatcttttctttaaagttcactaacaaagtagttgtctggccaagagtggtggcccacgcctgtaatcccagcactttgggagacttaggtgggtggatcacctgaggtcaggagttcgggaccagcttggtcaacatggtgaaatcctgtctctactaaaaatacaaaaattagctgggtgtggtggtgcatatctgcaatcccagctactcgtgaggctgaggcaggagaattgcctgaacacgggaggcaggggttgcagtgagccaggatggcatcactgcacttagcctggatgacagagtgagtgagattccatctcaaaaataaaatcaaaataaaataaaataaaattgaaggtaatcatccacctaggaggtgggcatctttttatccaaaggaaaatttatatatttatttataaatacataaaaataaaataaataaataaataaaaataaattttccgtgtcaggcatggtggcttacacctgtaatcctagcactttgggaggctgaggcgggcagatcacaaggtcaggagttcaagaccagcctggccaacatagtgaaaccccgtctctattaaaaatacaaaaattagctgggcatggtggcccatgcctgtagtcccagctacttgggaggctgaggcaggagaatcacttgaacctgggagttggaggctgcagtgagctgagattgtgccactgcactccagcttgggcaacagagtaacactttatctcaataaataaataaataaataaataaaaaagaaatacagctatatccaacaaccagaataaatcttggaaatataatttgcagtgaaaagagctggttgcagaagactacatagagtgtgattccatttttataaagaagctcaaaaccaagctaatccaaacaacatattgtttaggaagacatacatgtttgttaaaactgttttttttttttaaatgaatgcataatttaggatggtgattacctcgaaatggatggagaagatgggtttaggatttggaaggcacatggtagctttaaaagcaatggcaatgctttatgcataaattgtttggtgggttcatgtattcattttattatatactcctaagcttacagagatgttacttattttatatatatcaaatattgtataataaaatgtaagtgaaaaaatgctacttttataaaatggaataatcaagcaaacatgttaagttaaaacctagagaaagggttttagacttgtaactttaactaattggatactcattttggaaccaaagcaaacatctgaatagtccatacagaaaaacatttaacacatcatatagcgtaacattgtttatcctgccattcttttggtggctaaaaatgtaattttaatttttgctatttcagatacacaggaataagcatttttgaacttctttccttcttttttttttttttttgagacagagtttcactcttgttgcccaggctggagtgcaatggcatgatctcagctcactgcaacctccacctccggagttcaagcgattctcctgcctcagcctcccgagtaggtgggattacaggcacctgccaccatgcctggctaattttattattattattattattttagtagagatggggtttcatcatgttggtcaggctggtagcaaactcctgacctcaggtgatccacccgcctagcctatctttttcaatacttgtgtaagtattgttttttgagatagatgcttaagaatggagtgctgagtcaaagggtgaggagactgaagtgagactcggagaagttaaatgcataactcacatcacacaggcagcaggtggcaaagccaacagggctccttttggggctccacatcacccccattacaaagaaaacgatggttctggccgggcgcggtggctcacgcctgtaatctcagcactttgggaagctgagacgggcggatcacaaggtcaggagatcgagaccatcctggctaacacggtgaaaccccgtctctactacaaatacaaaaaaattagctgggcatggtggcgggtgcctgtagtcccagctactcgggaggctgaggtagaagaatggcgtgaacctgggaggcggagcttgcagtgagccgaggatcgcgccactgcactccagcctgggcgacagagcgtgagtccgtctaaaaaaaaaaagagaaaacactggtcctgcccagcacggtggtgcctgtagtcccagccactcaggatgctgaggtgggaggatcatttgatccctggagttcaagaccagcctgggcaacacagcaagaccccatttctaaggaaaagaaaatgaaaacattggtcctgtcaaaacgagtgctccactttccactttgatttgactctttcccattcttgtttgcccagactgcaggtgaagctcagtattgatttcaggacctcaggatacagaacacaagagctccctgtcacgagaggcacagaatagagctttgtctcttaaaaaggcttgattgcttctacgtgactgtcttgctgccagtggcagggagggaggctttgctgagcaccaagtcagaactcagagttcctgcgccatttttcatagtgctgcccttgtaacccaaggaggcgtcccattttatttccctgggcagattttgcaatgctcagtcgtcaaaatggaaatgtttattagctacggaaaatgctgttttgctgattacagaaaaacacagacaaagaaatacatacaacatggacctacaatgacaagaaaaacaaagatgtcagttaccacctatgcttgccagagtccctgtcttcctatctgaacacattccagaacaatccaattcttctttgaaatgttcattttatttcagatacagaaagaaattaaacaagattgggtgcggtggctcatgcctgtaatcccaggtcttttgaaggctgaggcaggccgatcacttgaagtcagaagttccagaccagcctggccaacatggcgaaacccccatctctactaaaaatacaaaaattagctgggcatggtggcaggtacctgtaatcccagctactcgagaggctgaggcaggagaatcacttgaacttgggaggcggaggttgcagtgaactgagatctcaccactgcactccagcctgggaaacagagggagactcctaaaaaaaacaaaacaaacaaaaaaaaaaacgccaggcgcggtggtggctcatgcctgtaatcccagcactttgggaggctaacgcgagcagatctcgaggtcaggagagatcgagatcatcctggctaacgcggtgaaaccacgtcgctactaaaaatacaaaaaaatttgcccggcaaggtgacaagcgcctgtagttgcagctactcgggaggcttaggcaggagaatggcgtgaatctgggaggcggagcttgcagcaagccaagatagcatcattgcactccagcctgggcgacagaatgagactccgtctcaaaagaaaaaaaaaaaaaaaaaaaaaagccaggtgcagtggctcacacctgtaatcccagcactttggggagggtgaggcgggtgaatcacctgaggtcaggagttcaagaccagcctgaccaacatggcgaaaacccgtctctactaaaaatacaaaaattagctgggcgtggtggccagcgcctgtaattccagctactcgggaggctgaggcaggataatctcttgaaactgggaggtggaggttgcagtgagccgagatcgtgccattgcgctccagcctgggtggcagagtgagactccgtctcaaaaaaaaaaaaaaaaaagaaaaattaaattagtatgccactcagacacaggtagtagcaacatcaactctatatactaaatcagtggtatgtgaataaaacatgccattaaataattttcctaaaatttttaccaacttagagaatatagaatttcttcaaatatctcataatttttcctagagttttttttttttaacccaagacccaaacaagatttacacattgtatttcactgatctctcttaagtattttagtctgtaggtttctcctccatctttttttttttttttttttttttttttttgagacggcgtttcgcttttgttgttcaggatggagtgcagtggcacgatctcggctcaccacaacttctgcctctcctgcctcagcctccagagtagctgggattacaggcatgtgtcaccacgcctgactaattttgtatttttagcagagatgtggtttctccacgtttgtcaggctcgtccccaactcctgacctcagatgatccacccaccttggcctcacaaagtgctgggattacaggtgtgagccaccacgcccagcctcctctatcttttttaatgccttgctgcatgttgaggaaactgggcgatttttcttttttctttttttttttttttttgagactgggtctcactctttcatccaggctggagtgcagtggcacgatcacaactcattgcagcttcaaccttcctaggctcaagtgatcctcccacctcatcttcccaagcagctgggaccacagcatgcactaccacatctggctaatttttttttttttttgagacagggtctcactattttgcccaggcttatcttgaactcctgtgctcacgtgatcctcctgcctcagcctcccaaagtgctgggattataggcaggggctatcacacccagcctgagtgatttttcttttagagttttttacatcctggacttcatttactgtacctagcagtagtgtagtgttgtttaacacattcctctatttcaagagtttttctaaacagttaattggatctagatgctgggtcagacactagtttgctctttttggcaagaatatgtcatttgtggttgtatatttctatcagatggtacataatgcctggtgatctccttttctgtgatgtgagtggctattcaatgaccactgcctggatctgttattttattagagttttacaaaatgctggtaattcaaatgtcattccttatttattgactgacataattccctcatcaagtcttcagttagttactctgagatacaagtggtacatacacatcttagcttgggtcttccaggaagcagagcctagagacaaaggcttgactggagaatgtggtgatcctagggaaagaagtgagggatggggaagcaggagagacaattcaagggagcctcactgaataggctgctgcttcaggttcctgaatggttggctgtgtgtgaccatatgagttgtatagaatgagtctcgggctccttcatcttgcggggaaaagggaggaagttttatcagttcctgtcccccactcgttaaaggttagaccatgaaacattaactcccccacacttcagggtgctgggttcatgggcaccctgatagcttccatagatccccacactgtcattaagagagaacccctggaatgggaggtaagaggtaaggattttttttgttttgttttttgagttggagtcttgctcttgtcacccaggctggagtgcaatgacacgatctcggctcactgcaacctctgcctcccgggttcaagcgattctcctgcctcagcctccttagtagctgggattacaggcacccaccagcctaggcctcccaaagtgctggagttacaggcatgagccactgtgtctggccaaatggtaaggttttttgttttttggttttttttttgagacggagtctcgctctgtcgcccaggctggagtgcaatggtgtgatctcagctcactgcaacctccgcctcccgggttcaagcgattctcctgcctcagcctgtcaagtagctgggactaacaggcgcgcgccaccacgcccagctaatttttgtatttttagtggagacggggtttcaccatgttggccagggtggtctcgatctcctgaccttgtgatctgcccgcctcggcctcccaaagtggtgggattacaggcatgagccaccgcacccagccaaccaagtggtaaggtttttaagggttgtccctgcatgaagtggtcagagcccccctggaacttgctgctgcagtagtggctggaataagataggtaaggccaagaagatctgaaatggtacataagaaatgttagatccagaaaaggcaggcaaaatgtgcaattcttttcctttatttaccatttgccagctttcaaaataatgaactagttctattgtatttccaaagttgagcaattaagatttttttaaaaatatcattatgactcatggatatacaaatatttgatatgtctcaatttattgctgtgatttttcttattgatgctcaaatttattccactttggccagcaggagtttctacaaattggttccagatgacatttcaaataaatttgtttctgagcgcttccttgctttctgaattggcaagatattccaggcttatttggcattcatcttactctagacctattatcaaccatgtctccaaggataagtagatccttttaagggaaaatggtattttgaaagcatagtgtgggatctgaggatacctattcctgtcaggttggttattgtttgttttcagtgagtagatcttggactttattaattttatttatttattttaagaaaagtacatcatgagttataagtaataattccaactcaaattttaatattgcttaacttctttgattttatatttatcttttacactgaaaagtcttggctgggcatggtggctcaagcctgtaatcccagcactttgggaggccgaggcgggcggatcacggggtcaggagatcaagaccacctggccaactggtgaaacctcgtctccactaaaaatataaaaattagccaggcgtggtggcgggcacttgtagtcccagctacttgggaggctgaggcaggagaatggggtgaacccaggaggcggagcttgcagtgaaccaagatcatgccactgtactccagcctgggcgaccgagcgagactccgtctcaaaaacagaaaaaaaaaaaaagaaaaaagaaaaatattgatatctaaggatattaacataattactgctaacattatgattattcaaaaaggttatagttttttttcttaaagttctctttgtccttagttatatccccaaaggctatagagtcaaataattgtggattttcttgttcagtcatccaggctgaagtggagttcagtggtgcgatctcggcttactgcaacctccacctcctgggctcaagcaattctcgtgcctcagcctccacacttggctaatttttgtatttttactttatttatttagagatggagtctggctctgtcgcccgggctggagtgcaatggcatgatctcggctcactgcaacctccgcctcccggttcaagtgattctcctgcctcagcctcctgagtagctgggattataggcaggcaccaccacacccggctaatgtatctttagtagagacggggtttcaccatgttggtcaggctggtctcgaactcctgacctcatgatcttcctgccttggcctcccaaagtgctgcgattacaagcttcagccactgcgcctggccttattttttgtatttttagtagagatggcctgttgaccaggctggtctcaaactcctggcgtcaagtgacctgcccaactcagcctcccgaagtgctgggatcaagagcatgagccctttgtccagcccaaataattaattgcgtctgtgtgtggttttttgttttcttttgagacagagtctgcctctattgcccaggctggagtgcagcggcctgatctgggctcactgcaacctctgcctccctggttcaagtgattgtcctgcctcagcctcctgagtagctgggattacaggcatgtgccaccacacttggctaatttttatattttttttagtagagatggggcttctccatgttgaccaggccggtctccaactcctgatgtcaggtgatccggccagctcggcctcccaaagtgctgggattacagggtgagccattgctcctggcaataattgtgttttaaaatcactttatataatttctcttcacactgttaagctaccaacttgataccagcattcatgtgttgcattttgctttttttaaatttaattttgtttcataagaatgtaaaaaacatttatatcattccaaagtcaaatccacaaaacacagtatattcttttttttttttttttttttttttgagacggagtcttgctctgtcacccaggctggagtgcagtggcgcgaccttggctcactgcaacgtctgcctcccgggttcaagcaattctctgcctcagcctcctgagtagctgggattacaggtgcccaccaccatgcctgggtaatttttttttgtatttttagtatttgtaatgattttgtatttttagtagagacagggtttcaccatcttggccaggttggtcttgaactcctgacctcatgatccacccgcctcagcctcccaaagtgctgggattacaggcatgagtcaccgcacctggccaaaacatggtatattctgagaagtctagcttcgatccttgtccttccatcctggtccctccctcccttataggtttccattttatttaataatttatccttccaaaaaaaaaagcaaatgtacttacgtgtgtttctgctttcctaggtaaacagtagcatcctacatacgcttttattactttgttaataccctagtttctgacaaattattgttcatctttcttaaaattgcagtgttcttcaggcttgatcttccctcttgttgaaataagttgttgatgggtatcatcagaagtctaacctaaatgaaaatgagtttttgtttttgttttgagacactgtcttgctctgtcaccaggctggagtgcagcggcacaatctcagctcactgcaacctctgcctcccaggttcaagcaattctcctgactcagcctcccaagtagctgggattacaggcatgcaccatcacgcttggctaattttgtacttttagtagagacggggtttcaccatattggccaagctggtctcgaactcctgacctcgtgatctgtccgccttggcctcccaaaacgctgggattacaggcgtgagccactatgtcaggcctgaacctgagttttataaaaagtactgttatccattctattacttctggcaaaagtttgcgtggggaagagtttggcagtcctaagcaaagttgtctggcgtgagtgatggcatcgatacccaggattttgtgtgtgtggtaaaatgtacatggcataaaatgtaccgttttaacttttttattttttgtttgagacggagtctcactgtgttgcccaggctggagtgcacagtgcaatggcaagatctcggctcactgcaacctccgcctcccaggttcaagcaattctcccgcctcagccttctgagtagctggtattacaggcatgcgccaccaggcctaggtaatttttgtatttagtggagacggggtttcaccacgttgaccagggtggtcttgaactcctcacctcaagtgatccacccgccttggcctcccaaagtgctgggagtacagtttgagccacccagcccagccctttttaaccttttgttttttttttttgttttttttttttgagacgtcgtctcgctctgtcgcccaggctggagtgcagtggcaccatctcggcttactgcaagctccctttcccgggttcacgccattctcctgcctcagcctcccgagtagctgggactacaggcgcctgccaccacgcccagctaaatttttttgtatttttagtagagacggggtttcaccatggtagccaggatggtctcgatctcctaacttcgtgatccgcccgcctcggcctcccaaagtactgggattacaggtgttagccaccaagcccggcccgttttaaccatttttaagtgtacagtgtaaggcactgaaaccgcctttgcaaaagtataactgaggaaattatgacagtgaaagaaatcagacctaactgactctatcttgcttctaacccttaagctgtccttgttcgttcctgggtgtaggcggaactaactttgggaaggaattccgttcatgatttgactctgaaacaaagttgctaacagccctttcctgaaaaagactcccttcttgcctggggtccagtctgcctttgcaggactaacaaattagctacaagattagaaattacagtttaggggtcttgctgcttccggatccaagagtctgaacctctccaaatttgctcctgtggataacatcactattgtaaaacctaagagcagtgcttgagatattttgcagaccctgcactcgatggatcagctgacaccacctggaccagtaacctggcccaaccagttctgccatcgcagataggaacagaagacatatgaaaacctaacttcgacccccgcctgattccatctccaacctgaccaatcagcactccccacttctcaagcccctacccgccaaattatctttaaaaactcagggcgggttgcggtggctcatgcctgtaatcccagcactttgggatgcgaggcgggtggatcacctgaggtcaggagtttgagaccagcctggccaacgtggtgaaatccttctccactaaaactactaaaattagctgggcgtggtggcgggcgcccctaatcccagctactcaggaggctgaggcgggacaatcgcttgaactcaggcgaaggttgcagtgggccgagatcgcccgtgccactgcactgcagtctgggcgacaagagcgaaactcggtctcaaacaaaacaaaacaaaaaaacccgaaaaccaaccaaacaaaatctgatccccgaatgctcgaagaaactgatttgagtaataataaaactccggtctcccgcacagctggctctgcgtgaattactctttcgccattggaattcccctgtcttgacaaatcggctgtctacgcagccggcaaggtggacccactgggcggttacagcattattaggtatattaacactgttgtgcaaacacccccactctcggtctccagaactttttgtcatcccacattgaaactctaccgattaagcactaagttcccattcccttcccagggtttttaacaaggccacgttaaacagaaggggcacctgcttgccaggtggaggcctgggcactggcagggttctgccctcccgactgagcaggggctcccgaggtgactaagcaggctctctgggtagtgctcccgccctcacctattgtccgggtggaggaaccggtatttccggatgggggcctcagacccagtgatcccggctaagggtgaggctggcgggggaggggaacggaagcgggtcgtaaaagttaactttacactaaaatcattaacttttctcacaccccccaataaaagcagtcacctcccccccccaagagccccccacgcacccacagtggcccacaaccatgcttcccgggggctttgaagggtagaggagctgacatcctccttgcccagaccctggaaaggattaggaagcggacctgggcacgaatagagaaagaagcccagcaaattcctcttgcaccagctctgggaggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctaggcaagtaccctcctctctctccctccccggcccaggtgctgcctgccgcacgccccgggagagccgccgaggcgcggcagcctgtgcccaggcgtcgccgggatgccttccctcctgtcccgactttggccagggaatgatttggtgggcgcgaattcgcgctggtgccctgggtcgtttgtgcaggcggggtgaggggcagcgcgagtaaacgggttgacatcccctaggtttctctgcagagtgcgctgtgtacttcatcgggcatttactttttcactgcttcctcatcgcccccggggcggcagcgcctcacagggtctctctgggggaatcatcaacaggtgtgcctgaacacgcacctgcggcagccacaggtgtctgggagccaccttttttcttctccctggcctggcaccctttcactcaagggatggaaactgtttcactttctgctgagcttctcttttacccgattaaaagggcctttgaatttctgttggcgcagccaactgcatcgggtgggggcaggagccggtgccttggagtgacgcgggcggagcgcggcgctggttattggaagctggtggggctgcttgagtgcccgctgagcctccgccgcggggcttgaaaactccgcactccagaaagcttgaccgtacagccctgggggtgctcgccctgcccgcgtggtccgcaaaacggggatctcctccgcctaacgcggcagagacttagaaaacatttaaacaacaaaaaaattttcactttctgacccatttgtaagggaggggccgagcttgtcagcatatacagggcgttgtaagtttcccagggctgcattgcaaggttcttctatagggagctctcagtcaaaaccgagttggagatctttatgttggaaaaaggccactgaattccaggcattcttcgagcttgagaagggcattttcaagactattttgaagtttgcacgagggctttctgcgcaactgagtatctcaactatccttattgtctgtggctacttcccagtcccagaggtgggcgagttccgtagggaggcctccgcaggcaggtcttctgtccaggtttctgaacgcatttccacaaacgtggtcggtaggtaagttaagcccttaaccaatccacttgagagatactacctatcctcttcgtttcctggtgaggaacctgttattctagttgctgatagggtgacattctgggtactttcaagtgttcacgtgtcttgccactttaaggtcacgggtgcattacctgtcgaccttttgaaatgcaggatctcaggccccacccagatctgctgaatcaggatcacccaagggatccgtttgcacattaacgtctgagaagtactggcctaggtatgttggagtgaagttttctgtccagtgtcaaggagtgctttacatttccatccggttatgtatttgaatctttgttttgcccaccaggacactctacagccgcatgggttagagcacctgcaccccagggtgacaggatatgtgattaacatactggccggtgatgtttttgattctgtggtaaaatatacataaagtaaaatgtagtattttagccgtttaaaaatggacccttaattcaatattgtgccaccatcaccactacccatttccagaactttttcatcatcccaaacagaaagccattagaataccttattttctcctttccccagcctctgggcttctggatacttttaattattattatattttttggagggaacagaagatgttgactaagaatgtacagtaaatgtctcaaaaaataagagaatgtatagtaaatgtgtagtagaatcacgctggcagaatatgaacaaacatttgggaattcctgggtagacaaaagcactatagctcaaggttcttagagtgcacgtactttctttaatagagacaactataaaccttcaagcgtttcctattttgactgaaatggaatggagttacccagtgctcaacctgctctaattaactaggcatagatgcttgatgatctgtaactctgtgattcttttaactggcctcattttaggtgtcctgttgatactgggtttagtttgtttttgttttttaattattttattttattttatttatttattttgagacggagtctcgctctgtcgcccaggctggagtgcagtggcgccatctcggctcactgcaagctccacctcccaggttcacgccattctcctgcctcagcctcccgagtagctgggactataggcacccgccaccacgcccggctaatttttttgaattttttttcttttttttagtagagacggggtttcaccgtgttagccaggatggtcttgatctcctgacctcgtgatccgcccacctcggccttccaaagtgctgggattacaggcctgagccacggcgcccagccttattttattttttgagacagagtcttgctgtgtttccaggctggagtgcagtggtgtaatcttggttcactgcagcttcaacctctcaggctcaagtgatcctcccacctcagcctcccaagtagctgggactacaggtgcaaactaccatgcctggctaattttgtttatttttgtagaggctagtttaaattattattattatttttttctgtagattgggttcttgctttgctgcccaggctagtcttgaactcctggctttaagccatcctcccgccttggcctcccaaagtgttgggattacaggtgtgagcccccgctattttttcttgacccttgcctcttcttgtgttacgactttcatcacaatgaggttatcaacttgtagtaagaatttacagcttcctttgattgaaaagtccctttgaaatggtgaatgaagataattcaaacggcaagatttggcagaacattctctcttaagaagactcctgcattcacagactttcagaatgttattacttccttttaattctagtaaggcaagagagaaaaggtttaccctcctatagtatgttctcttctgaacaatatagttcagagttttatttggtaaatggatgcattttgcaatctacatgagaaaacatttcttagaaaatgtccagtgaatggttttatcagtgatttcagtgatgtttggggaatcacctggtagcttaataaaaatggaaactctccaaatattccagatttattaagtcaaactctttttttgttgttgttgagatggagtttcgctcttgtcacccaggctggagtgcaacggcgcgatcttggcttactgcaacctctgcttcccaggttcaagcgattttcgtgcctcagcctcccaagtagctgggtttacaggcatgtgccaccacgcttagctaatttttgtatttttagtagagatggggtttctccatgttggtcaggctggtctcaaactcctgacctcaggtgatccacccacctcgacctccaaaagtgctaggattacaggtgtgagccactgcgcccggccaagtcaaagtctttatactacaatctgtgcgtttaatagcaccctgagtgatttttttttttttttttttttgagatagagtctaactctgttatccgggttggagtgcactggtgccatctcagctcactgcaacctctgcctcctgggttcaagcaattctcgtgcctgagcctcccaagcagctgggactacaggcatgcaccacaatgcccagctaatttttagtagagacgggatttgtccatgttggccaggctggtcttgaactcctggcctcaagtgatctgcccacctcggcttccaccttccaaagtgctgagattacgggcatgagccattgcacctggctcaccttgattctgatatgtaattaggtttgggggtcactagaataaacacatgcacacacacacactcgaatgtgagtgcaaaccaagatataaaattaatctgaagttacaagataacacaattttatatacaacatgaaataaaattaacaatagtttcttccttataattaggtagacagttcaagtttggcaaatctaattggcaccttttgatattgatcatcactgaactttagaatccccagtgtccagaactactggtctccataggagatatcaaggtactggactagtatttgatttagcattaatgaacactagttgtgtacccattgtgaaacagggattttcagatatactgtcgttaaatctttacaacaaccttgagcatggtatttctttttttctcattttacggaagagaaaattgaggccactttgggtcttcttgcttgaaaccatggttcttttcctggtcctcccattgtagaataagaaattcctacctactcactccccttcacctccagcagttatattgagatgtaattcatgacaagctatgtacagtattcataaattcttcatgcaaatcttttggaacatcaggtactgtgctaggccctgaggcaaataaaaagatgagccaaaatggaaataaatttcaaaagagcaaaggactcaagagccaagggttcttttcatggtaccctgagacctctgatgagttagattatacttgaatggggtcttaggttggctgggccagctccccagaaaatcaagtcgtgggcatttgcttattgagatgggtcagaagtactctgcatgacagtacctacctggcaccctgaaatgccacacagtgtaaaagaaaggacccaggctttaggtgtggaagaactgacctctgctacaaccagctgaatgaaccacagtaaatctcataagctcgaagctgccacatgctggtatataaaataaaggaaataattatcttgctcctgaattatagtgaagactcaaaaagaccttatttgtacaagggcttgtaaaatgtaaaatgataacaaaggctacgcacctccatttgggagaaatttataatgcaaaggaaacagaaaaagccataaatttacctagcacttttcagtgtactttttagttaactgaggctgttgataattctcttttagctttggccatttttgttttaaacagttacattgagatataattcacatactatacaattcacttatttagtctacaattcaatgtcttttaggatatttgtggagttgttaaccatcaccactgtcaatattaagatattttcaaggctagatgtggtagctcatgcctgtaatcccagcagtttggaaggctgaggtggaaggattgcttgagcctgggagttcaagtccagcctgggcaacatagggagacccctgtctctctctctctttttttttttttgaggcaaagtctcactctatcgcccaggctggagtgcagtggtgcgatctcggctcactgcaagctctgcctcccgggttcacgccattctcctgcctcagcctcctgagtagctgggactacaggtgcccgccaccacgcccggctaattttttgtatttttagtagaaacggggtttcaccatgttagccaggatggtctcgatctcctgacctcgtgatccgcctgcctcagcctcccaaagtgttggaattacaggcgtcagccaccgcgcccggccgcaagggagacccctgtctctacaaaaactttaaaaattagctgggcatggtagtttatgcctatagtcccagctactcaggaggctgagttgggggatcacttgagcccaagagatcggggcttcgccaagctatgatcatgccactgggctctagcctgtgcgacacagtaagatcttgtctcaaaaaaaaaaaaaagatgtttttaatgccccctcagagaacattttccccagtaaaccccctctaccccttagctggctcctgtcaatattccccctctacccctgaccagggtaccaggaatctactttctgtccctatagattagcctattctgaacattttatataaatggaatcatagactatgtggcccttcattgtctggcttctttgacttagcatgtttgcaaggtttatctatgggagccgtggtttactccagtaatcccactcctttgggggaccgaggtgggaggatcacctgagtcctgggcaacatggtgactaaaggcttatgtacattgtagtatgtatctgttccttttttttttttgagtcaggatcttgctctgttgcccaggctggagtgcagtggcacaatcatggttcactgctgcagccttgaacttctggtctcaagcagtcctcctgtctcggcctcccaaagtgctaagattataggtgtgagccatcatgacaggccagtactttattctttctattgctgaataatcatccattgcatggacatgtcatagtttgcttatccattcatccattatgggcatctggattgtttctgctttctggctattatgaataatgttgttatgaacactcatgtacaagtttttatgtggacatacattttcatttgctagagtacatacctagaagtggaaaatatatggtaactccatatttaatattttcaggatttgccatactgttttttagagtggccatattcttctacagtcccatcagccaggtatttggagttccaatttcatgtctgcatccacatacattattactgttgtctgtctttttaaattttaaccacgctagttggtgtgtgattttggtttttacttctctgatggctaatgatgttgaatatttattttttcatgtgcttattagaccattttttttttttttttgagatggagtctggctctgtcgcccaggctggagtgcagtggagtgatctcgtttcactacaagctctgccttccgggttcacaccattctcctgcctcagcctcccgagtagctgggactacaggcgcccaacaccacgcccggctaatttttgttgttatttttcagtagagacggggtttcatcgtgttagccaggatggtctcaatctcctgacctcgtgatccgcccgcctcggcctcccaaagtcctgggattacaggcgtgagccactgcgcctggctattagattattattcctggacttttttcttgattcttttccaagggaaaaggacatagggaaagaggaaattctgttttgaataaattctccagtttcaatggtttagattagaagcatactgaaaatgtaaattgagccatttgctcttttggaatttattgcggcttaggcctctgggcctagtgtaatacctgatgttcctaaagatttgaatgaagaattaatgaatacgtagtttcttggggttgatggggagtacgtaagcagggacttactattctacctgctgatttaatgtccatgaaaataatcatacactaaaatgttaataatacatacacacaaacggactagtgtacatggtggacattttaaactctttcaccaaaatatttattgattaacatctgtcagggccagatgaggtggttcatgcctgtaataccagcactttgggcagatcacttgaatccaagagttcgagaccagcctggccaacatggtgaaacccagtctctactaaaaatatgaaaaattagccaggcatggtggcgtgtgctgtccttccagctactcaggaggctgaggtgggagaatccttttagcctgggaggtccaggctgcagtgagctgtgattgcaccactgcactccacctgggcaacagaacaagaacctgtcgcaaaaaacaaaaaaaaaccccgtcaattctacttactaaaatatacaataatatagtttaaaaatcatattaatacattgtctatatattttattagggtactctttattttattctcaagtactgccaaaagaagagtagactaaggctgggtgcgatgtctcacgcctggaatcctagcactttgggaggccgaggcgtgcggatcacttgaggtcaggagttcgagaccaaagccaggctcacgcctgtaatcccagcactttgggaagctgaggcaggaggatcacctgaggtcaggagttcgagaccagcctggccaacatggtgaaaccctgtctctactaaaaataaaaaaattagctgggcgtggtggcgtgcctgtaatcccagctgcttgggaggctgaggcaagaaaatcgcctgaacccgggaggcggaggttgcagtgagccaagatcacgccattgcactccagcctgggggacaagagcgaaactctgcctcaaaaaaaaaaaaaaaaagaaaaagaaaaaaaagaaaaagaaagtaaaaaaagagtagattaataagacatttttcacgagtcagtgcatttttgttccttgtttcccaagctgcacggcagtgtttttcctttgtagccacagagaattttcttcattctctacagtcacaagccagtattgagtttcttaaatatctgttgtgttttggaggctcgctataacctgacctcaggttatactgtttggatcttgtattatggggaaatgttggtaatagcagagaactagggaagtcagctggatttagaaaaagaaaacttccatttgagggttctttgagacagtagtgggataggtgagtggaagtgtgtagcgcagtgattctcaaacattagtttgcatctgaaccatctggaaggcttgtcaaaatacagattgcaggcccccctcctggagtttctgattgcgtagatctggggcgggggctcaagaatctgtgtctctaacgagtgcccacccaggtcatgctgctgctgctgctctgggaatcccgctttgagaaccagtgctttggaggcctttggaagtgcaggtctggaacttgcatgacggaaggggccgggcttgaggctggtctgggcatcctgtgtgtgcaggggcttggtggagctgtggaagtgggtaccagccaaagcagggcgcatagacaagtgctgaggacgaattgaggaatactgtggggaggggtggctgcgaggaagaacagagctgagagataaggaagaaatggacagagggttatgaggagacctgggtgagtgaagacccacaaactcctatgtaaaggttcaggagagtgaggacatgtatgggtattggtgtcaggggagggactgagtggtcacccggatggtaggtgttgtagctgtgcaggcctggcctttccaccattctttcaggaagggcagcatccccgggcagtgggatgtgctgcttgtggccacagagtcacatgtggactttcctgtaagaaagggaattcttttagtctttctggccgtagtcccagggatcatgactaagttctctccctctttctgcctgtcactgataattaacgtaaaaccaggatgagttttgcaaaccagaagcaagatttctttgtgcgaggagtgactgtcatctctaaaactggagtttgtgtccttgtgtgtatttgcctgctcagcttaatagctttaggcatgcagtcatcttagcataacttgatataagccgattctgagagtgggtgctgacatatggaagtgtttttgacagtccacgttgtgaaggtcaggaggtttgctacaggaaagaaatccaagaagggcagtggcccactggtgttgggtcctctgagagtgagctgtgttctactcttcccactcacgtcacaaagtcgagagaaacatcccctaatttgattgtatatttcattttaaaggaatcctcattgcgtctgaggatgtaaaatatttctcttgggtttcggaaagaggccaaagcctgccccaaggtgttctctgttatcatttggggcatctgttgttagtagagagcaaagtgatttaatatcagtgcttgtaaaccaactgcctggtgacttgctgtatggtcaggaactgagtagcagctccttagtttagactttccaatttgcctttgatcccactcagccctttgcacagatgaacattcctgctggcccctgtaggccctgggtgtgtgattcctctggttaatggacaggactggaaaggaaatatttcacaaccctgcatctgtggagagggagtgtcctggaatccccaagaccacccccagtttcaatgattcactaggaggactcacagtactcagcacagagttgtactcatggctatgatttattatggctcaaagatgcaaagcaaaataagccaaggggagaagtactggagcgaagtccaaggcaagcaggcacaagcttccaaggctcctctcccagtagagttacacatgatgtgcttaattccctggcaactagttgtgaccacacatgtgaaatgttatcaaccagggaagcttataagggactcactgccccgggtttttactgggggattgttacactggtgtcctctgcctaccagctacccaaatttcagactcacacaaggaaagcagctgttcagcataaaccacatggttgtacagtttaaggacagtgtgagactcttaccagtcctggcagtggtgggaatccaaattcccaggcatcagctgagagccaccttgtaagtgggtctttcaaaggataacagtcaggcttgctatgttaccttttggatggggatgagagtggcaggtgaggatggtggtggggacccctgaacttggagaagggatctgttaatgcagcctcggggcctggtgctgcaggagaaggtggaaggaagtgaactggggttttgcacctagatcctgggttcagaatgataactgggattcctgcactacacggatagagaagggtggaaaagagttcaaagtcctgtgcattcattcatccatttattcattcttaacaggcgcttatcaatgcctatgccctttgaggcactgtggcaaggtgctaaggataccacggtgagcagggtaaattctctgctctcatgagacccacttctagagggaatgaatgaggaaaggggcagttaaattcattgctatggggatataccaaaggccctagggtacctacctggtaggcttagtgggagttcagaaggcatgaattttataatcagaccaacctgggtaggaatcacacctctactacttattacctgtgtgccttgggcaagttacttagtcacctggtgcctagatttcttcatttcttcatctaaaaacagggagaatttattgccttttttttaagatagggtctcactgtgttgctcaggctggagtgcagtggtgcaatctcgactcactgcaacttctgcctcctggattcaagtgatcctcctacctcagcctcccaaacagctgggactacaggcatgtgccatcacacctggctaatttttgtattttttgtagagacagggttttaccatattgcccagcctggtctcgaacgcttgagctcaagcaaccctcctgcctcggcctcccaaagtgctgggattacaggcatgagccactgtgcccatcctttcttttaaggctgttgtgagaactaaacaaggccgtgtatgtagagtgcttatttcaggggctggcacagtagaaatgttcactaaataatggcttagcgacgcctagccaaggataggtgtgtattctccggaaagactggcgtctgctgcatcttcactctgcaagtcacttcagaggcatccccttcagccctgggctcatgggtgcacacaagcctgcattcctgccacactgctccgcttgctggtctaagaatgctttcctgtttcatttttctggctttttttttttttttttttttttgagacagggtctcgctctgtcacccaggctggagtacagtggcgcgatctcggctcactgcagcctctgcctcccgagttcaagcgattctcctgcctcagcctcctgagtagctgggactacagcgtgcaccatcatgcccagctaagttttatatttttagtacagacagtgtttcaccatgttgtccaggctggcctcgaattcctgacctcaagtgacccgcctgcctcagcctcccaacgtgctgggattacagatgtgagccaccatgcccagcctcatttttctggctcttgaacacacttttctctttacctggatgccccagatttcttttgtcagcctaaggaatatgtactcctattattaagacccaactcaagtactttctcttttctctctttctctttcccaagccaagtccctcggacaggattgctcatgctctcctatgtcctaccctggttccatggtcactcacatccgtattacagcatgctgggtcgcagttgcttgttgcagcattagactgggtgatttttgaaggcaaggatggcttggtattatttgaatctccagtgccaatcagactgtttgatagggaccagctcaggggatgtagagggagtgaatgaatgagtgtggagttggactggaacacccaacgtgaaatggatacaacgtcagcaaaataggtctctgccctcagagcagagcttacagtctggaggaggcagatggtgcacaggtaaacataaatataacaattagagactaagcagtgacacaagtcccacagcaggtgcagggagtctctcctgggaagagggagaaataggaagttggaatgttgataccctgggcaatgtggggctgttgtctggagtgtgagtggtgttggaggcctgaagggctggtcctgtggggtgcacacctggagagctaggaggcggatagtgaagcagtggtcactggcacctcagctgccagagggcaggattgcagcaagatctaagtgtccacttggaaggctgaagtgctccactcaagcaagacaaactgggttcgaggaacccagggtcaatagaggaagtaccacccagcgagctgaaagacctgtctgagctgggcctacgacctgtgtcttagtcagctcgggctgctataatgaagtaccaatgactgggtgggttaagtaacagacatttgtttctcagcgctctggagacatgaggtttgataccaggtgccaggatggtcaggttcgtggtgagaacccttttcctggcttgcagacagccaccatcttgctgtatgctcacatggcctttcctggatgcattgtgtatggagagagagggagaagagagaagaggagagagagagagagagaagagagaagaggagagagagagagagagagatctgtttctctcattctctctcttgttgtagggacactaatcctatcatgagagtcccaccctcatgacctcatctaaacctgattacctcccaaaagtcctatctccaaatagcatcacactggaggttagggcttcaacatatgaattttggggagatacaaacactcagtccttagcaacccaggccaataacgatttgctgagtaaataatcatggctggcactcttaatagctctttgaatgggacaggacctaaatgttttgcatatagtcattaaaattcattctcaaacaatctcactaggtatggccattatttattatccccggtttacagatgaggaaacccaggccctgaagaatttaagtgatttgctaattaagtgtgaagctgggattctgaccaggcagtctgcttctagggtctaggattttgttgttgttgttgtttgttttttgaggcagagtctcgctctgtcacccaggctggagtacagtgacacgatctcagctcactgcaacctctgcctcccggattcaggtgattctcctgcctcagccccctgagtggctgggattacaggcatgcaccaccacacctagctgattttttttttttcttttgagacggagttttactcttttgccaggctggagtgcagtggcgtgatctcggctcactgcaacctccacctcccgggttcaagcaattctcctgcctcagcctcccaagtagctgggactataggctcgcgccatcacgcccagctaatttttgtatttttagtagagatggtgtttcaccatgttggccaggctgggctcaaactcctggcctcatgtgatccatttgcctcagcctcccgaagtgctgagattacaggcgtgagtcaccgtgcccagccaagtgtagggtcttaatcattatacttgcctgactcttaattaagaagtaaactctaatattattggacgtcagtcaagtgctagttcctgagtgaggagagatattagagatagaaggatgactatgacatcatacctaccttttaggctatctcagaatgctcaaagagatattatttcttgatgtcaattcaaatttgataccaccaagaaacttttatctttgtcttgtaactgtggtccatagaaccaatagcagaggaaagtgttttgcaatttcaaatgtgtctcgtggctgaactgctgacaaaaaaatatgttttttaagaataatgggtgcagtggctcatgtctataatcccagcactttgggaggccaaagcgggaggatcacttgagaccagaagtttgagaccagtctgggtgacatagtgagacttcatctctactgaaaaaaatgaataaataatgagctgagtcatcaagttaaaatgtacagttcattttagtagagtgtatactataatgacaataacttcaatgatggtaaaaggtatcctaaaatttataatactaatcaaatcataatacagtttgagaaaatatagaaccatttatgtaaaaaagtttttttttagctaaaaataaatgtagatgatttggaaatattttacaggaaaatttagaacaaagtgtcttaaagactttgcggtgtttctggatcttgactactagggtcatgtgcaagctcagtgaatgcaggaggaaactacatccatttcctggttgggggtgtctgggaaaaactcagcccatgagggagaaggagaggatgaggaggacagcggccctttggtgagaagcctggtgatggtggtagggtgtgttcactcaggcttcctggagaaggagaaggaagaggatatcctcttgtcatgaactccacatttggattcactggaaacagatttgggaaagagcaggaggagagggaagaggttgggggtgtgggaccctcctgtctccgaggaagcagcaccactgctcagggcaacgctttgtgtgtgtcatcagatgctagaggatccacttccagaaggcactgagcagagtggaaggagtcagccctgctgcgtaggagctgtgcgatccaggccaggttccttagctctgcctgatccctgaattatgtggctcgagtttcattgttctgttggttattctctttctcaggtcggcagcctctcgtcatgagctgaggttttgtccagctgcccacactcttcaaccaatgatcatgagcttctttgttttctttccttctttctttctttctctctctctttctttctttctttctttctttttctttctttctttctttctttctttcttttcttttcttttcttttcttttcttttcttttttttttttgagacagggttttgctttgttgcccaggctggatggagtgtgcagtggtgtgatcacagctcactgcaacgtgtgcagtggtgtgatcacagctcactgcaatgtctgcctcccaggctcaaacgatcctctcgcctcagcctcctgagtagctggaaccacagatgcgcaccaccaggcccggccaatttttgtatttttttgttgagatggagttttgtcatgttgcccaggctggtctcgaactcctgggctcaagtgatctgcccgcttcggcctcccaaagtgctgggaatacaagcatgagccactgtactcagctgagctttttttttcaagggacagaatctggccttgagaagaagaaactttccagcttttcttcaaggtctttgaatctctttctgtgggtccccagatctcctggtcacagctcatcttgtcatttgcctcagatctttcctcctcttcctctactttgacaggtaatatctcagcaggctccatttctttctcgtgacaatgtgcagtcatttcatttcctctctccagaagactttgggcagctcaatccagacatcttaagatgcccctttgggtctgcttttctgttctgttcttccacagggttagtatagaattgatttttctctcccacttggttggtcagaggcatgcttgactttggaacatcaatcactttctggcctcatcgttctgcctgtcatcaacaggatctccatcctgattccaacttaacagccctgttctcttctccaagaggcattaccagttctctcatcttgaaccaacgttccgcccgttccatacccagaccctccatgctgtctggaggtcccatgtctttgtttgctcataatagttataagtgggttttagcttcttcctcttgagtttggatggatttggcttctgctgccagagcctagattgttctcacgtatcagacattggcttatcttgagggtggaggattttcttttcccagctggtttgctataaagtatataatgggctcagtcacagggctggacagatccaggccatcaggaacttctgggctttcacctttttccatcacaagacaaaactggatgagaactttacaaaaaaaaaaaaaagggccagggaccatggcttatgcttgtaatcccagcactttgggaggctgaggtgggcggatcacttgaggtcaggagttcgagaccagcctaaccaacacggcaaaatcctgtctctactaaaaatacaaaaattagccaggcagccgggaggctgggcatggtggcttacacctctagtcccagcactttgggaggccaaggcgggaggatcacctgaggtcgggagtttgagatcagcctgaccaacatggagaaaccccatctctactcaaaatacaaaattagccaggcatggtggagcatgcctgtaatcccagctacttgggagactgaggcaggagaattgcttgaacctgggaggcggatgttgtagtgagctgagatcgcaccactgcactccagcctgggtgacacagtgagattccatctcaaaaaaaataaagggggctgggtgcagtggctcgggcctataatcccagcattttgggaggccaaggcaggcagatcacctgaggtcaggagttcgagaccagtctggccaacatggtaaaactcctgtctctactaaaaatacaaaaaaattagctgagtgtggtggctcacacctgtaatcccagctgctggggaggctgaggtgggagaatcgcttgaaccctggaggcggaggttgcagtgagctgagattgagccactgcactccagcctgggtgatagagtgagacttcatctcaaaaaaaccaaccaaccaaacaaaatgttttactttagtcagtgttatgggttgaattatatttcccacctccaaaatttctatgttcaagtcctaacccccagttcctcagaatgtgcctttatttggagatgcggtgtttatagaggtaatcaagctaaaatgagatcattaaggtggcccctaatccaatctgttcttataagaggaggaaatttggacacagacacatacagagggaaggtaatgtgaagacatagagaaaagatgggccttcccaagccagagagagtggcctggagcagctccttccctcacagccctcgcaggacctaccttcccagcaccttggtcttggactcgcaggcatgagataatgaatttctgttgtttaagccacccagtctgtggtattttgttgtggcagccccaggaaactaattcaggcagaataagaaattctacctaaaaccaagagagctattaatgcagcagctcatggcacagccaccatctcccattgatgagcagtgagagcgagaccaggtctcccatagccaggtccttgtctcgaactcggccgtgtcttctaggtttaccaagagcaatagctctgtagcaggacaaagttcctccatagggccctatactgccacagagtcccctggggccttcctggccagcaggaaggtcacaacactgtggtcactgggcaggcttctgtctggagccaaaccttcgtctagagcaagtaggcgaccgctgccgtgagcgttgggggcaggcttagatcagtatggaactcaaacaccctcagagctgccctggcctccttctttcctcctcaggtgcttaaacacattttaagtcatcgtgttccagttttaattgatgaagcccaaagtatgtgagagggcagaataggaacaccaaacccagtctggggattcaacgaaagaaagctttttggaagaaatgaagccacaactagtcagcaaagaaattaaaatacacttacacggtgtatattatgtgctggatgttacatgtgctcagtgctttccatgtaataactggtgtaattttaaaaacaactctatgaggtaggcactattattagccctgctttacagataactgaggcagagacattgactcttccaaagccacacagctagtcagtgatggagctggacttcaatctcaggcagtgtggccccccaattcatgctacagagtgggaggggtgtgtcagcaggtgcagcgtgggatcatgtgaactactctctccagctgctgtcagccaactgctgtatctcaacacctcatacccggtatagtcactaccaagttcccagttctgatgtgaggggtgttcctttcctaaaattccagagcagaggtgactgatattcccctcacccaatgaatggccaggccacacttgtcttaaaccagctcctgccaagattctgaattctgtgcaacacctcatcgctcatgtgctcccaggcaagggaactgctagaatcctacaattctaggctcatagtagaaacagcgtaggatcaatttctaccaacagtaatagggagcggtgttccctcacataaggagttcaaagttttttatttctctttgtttttttgggagacggagtctcgctgtcgcccaggctggagtgcagtggtgcgatcttggctcactgccacctctgcctcccaagttcaagtgattctcctgccttagcttcccaggtagctgggactacaggcgtgcaccaccatacccagctaatttttgtatttttttagtagagatggggtttcactatgtgttggccaggctggtcttgaactcctgacctcaggtgatccacccgcctcagcctcccaaagtgctgggattacaggcgtgagccactgcacccggcctgaaagttttttatttcttaggactgagagtactcagagaatccatgaattattatatatatgcaagttgtttgggaagggcagtcaattaagtgattttaatgttggcttgaactattcagtagcaggggttaaaaatctaggacgtatcacaaccataagggagggcctccccagttggcccaccagagccaggcccctttcctctgctcccccgagcaggacccaggagcctactttcctttctttgtggtgttttccaccgcccactccagcccttgggtccctgtaccctccagccagcctgtctttcagtctcactgtttttcccacaaggaccactcttcctgaagaggcattaggaatggaaaaagaaggacagatgggagagaggaagggagggagggatgatatccaccgaatgtatatacattacggcattatttattaattcattttgagacagagtctcactctgtcactcaggctggagtgtagtgtcatgatcttggctcactgcaacctccacctcctggttcaagcgattcttatgcctcagcctcccgagtagctgggattacaggtgcccaccaccatgcccggcttttttgtatttttagtacagacagagtttcaccatgttggccaggcaggtcttgaactcctggcctcatgtgatccacccacctcggcctgccacagtgctgggattacaggcgtgagccacagcacctggctgcatttattatttaaaacaagccctgtgttgtggtcttagtctagctgtacgaatgatggaacagaggttcagaaaggtcagtaacttgttcaaggtcaccaggtcttaaacagtagaggtgggattcaaaccaagtctttcccctgtgtcatggggttggtatgactggggacacacaggaatggatgagggtgtcttcaaggtctcatgctgggtgaaccaggaggtggatgcacagaagccggaaaaggcaaggggcactgtagctggcgctgggcacatgggttatttccaatagatactgggttgtgccagaggacaggattggaacgataaatttgatgacatccagttgaaggtaatagtttaaacctagtagtgaatatgttctgaggatgaatgactctgaggagagaaggctagtttgggctgagcaggtgagtctaaaagagccacactaaactttattaactctttggtaattcttttacatcacgtaatctgcttttcttacagtgtattggtggggcatctgagtagcaaatatgtaaagatattatttatgagcatattaaggaggagagaaatgaaatgcttttttcagtagagctaaaaaagcaaaaacaaaaaaattgctgtttccctaactcttctacttttagttaaagcttttttcagctcctgaaaagcagaccacaccctataaaacagactgtacagggcattagttcatttccctttttatacttccaaagcacagtaactgttaaaacacccagtgaagaagcatggccactgtctttctccagaagaaataaagtagaaatattagttgaaaggaaatgtcagtctgatctgtgaagttttatgttcaattttaatcatccagaaagaaaacttgagcatcctgacttaaaagctttttttggatcatgtatatttaaaaacacttttaatagataaatgatttttagttaatagttccagttataaacaatttctagaattgtaagggaattaacccaatatatgcatatttctaaataatttctagaattatgaagtgtcatatctggaaggggtattttggctagatttgttatttcctgtgttattaaccttatgtataattatgagagattccacacaaagatgacaattttaaaaaatgaataaataaattagcaagttgaacagtctgatttatggaagaaaagcaaattctttctaatatttgctaaggcagaattattttcctaatgaaagacacaattttaattttatgtgaaatcatcatagataagaatcactttgtaagagctgcatgttaaatgcatcgaaaattccaataaaaaatgaaactttaaaacatcccatttgcaaaatatcatgtcacttttcactgcaggagaacagcttccaatgggtaacaagtttaagttgattttttcttgttgttagctcaggctttgttacttatttagagtgttgtatagtaatttttatcatgcgtcatcagaaatacaatttgttagaacaatgactgttgtgtgagtgtaattacatcttcctgtatgattaaatgagggctgtatgggacctttactcagaggtggcagctgtagccaaccaagttcagcctataaaagaattcctgggactaactggtactaattgtttgcagaacaaccagtgggagtaatattcatgaatactatggaaatgaaatattccaagaccaaatgctttagcccttgttttttactttattgtggtcagattatattaattgcataatcaggccaagtgaagtgggagctcttggtcttttgttgtttttggaagaaaacttagccttcatctattcagtcctctcatcttataaacagggaaattgaggcttagggagtagttgaagggttatttaaagtcaccaaactgtaatataccctgtcagagttttaagtacactcatatacccctgtcagatttttaagtacactctaccgtatacatgagtatattagtttgtaaatagtgtaccttattacaatttaaaagatattagttctcaaggtaaatattatgaatattcaaaacacaaacattcaattttattttttatttttttgagacagagtctctctctgtcacccaggctggaataaaatgacacgattatagcttactgcagcctcgaacttgtgggctcaagtgatcctcctgcctcagcctcctaaagtgctaggagtacagatgtgagccacgtgcccagcaacactcaaatttttaaagcatgagagaagaaaagaggaaatagatggcataatactttcttcccacatcccaaagattgttggtatgtgcacctcactttggagatttaggtcatttaggtcaaaagaaacttgctattgaggaaagagaatctgtagaagtagggtttaagatttgcggggatggggaagggtttgggacactcactttggacatctaggttaatcagagttactgcataatggctccccttctattttgcttccctttatgtatgggtttgtttagacaaggagcagcatgactcttgtatgttgccatagcacatcaaataggaaaaaaaaatagcttgaagaagttggtgaggaaggagctatttaagtcagaactctcagagtgacaaactcaactaaaattaaatttcacaaaagtcaatttattagctttcataaacgataactgtaatctcctagggtgacagtggcctccggcatagctggatccagaagctcgagtgatgtcatgacatttttcttggtactgtttttctcaactattgtaatactagtgaagagccctctccatgtggcggggcacatgactactatcaagagctccaacttcctatcagccctggttagcaaatccaatggaaacaggacatttccctcctacagtcatctgttcaccccagggaagactggttgacccagtatgtggatcatgtgtaccatggcccattgagtgggccaccatgataggtggtccacctttacccatggacaaagggtaaggaagctcttcaaagccaagaggagacttaaagaaaatggagatgaggtagattctgaacctctccaaacgatatattttcatgatggcagggatcacacatgttgggttctagaggtatttaaaaagttgtttttaataataattttaaaaacccaccaaattgtttcttaattaattaatctttgctattgacccaagcaaggagtttatagtgcttagaaatgcattgctataaaatgacaactagaattccttcctcacttgtcaaagcacaggcttttagagagagagatatttgtagaaagagcaaatctgtttctgattttagttcatccagtggcaggcaggctttttggaccaattattaccagaccttgagataaatcacctcatgagccattagttcttgaaggattagcggcctcaaagatttatgtgcggattaattggagtgtacattagatcgccgtgtttaaaaccgcagtcattcctgcaaatcattttcattagtgctttattcagaattatttagccttgtataatactgccattgcagggaaatctgaaagacgttctctttatttgtggtctgcccccccatcaccacggttgtgtttaatagatctagctagggctacatagagaacatccaaaggaacagcagcttccattaaagattagttcagttgcttcaggtgaacagtgactgaaatttacaggaccttgtaccgagagagacaagatgaggtacaagaaatatatcggtattctggaagcagcagttggtattaccccacttaacaaaagagaacttctacctgagagcagaagacacgtgaacctttggcaacaacctgggtaagcagaggaggctggaagcttctcactatagatgtaaatactttttgtctgttttggggacccatatagaaaaaagggtcctctgtcttgtggggataataaatgagttcttcattaagaacttgtttcttcttggtggagaatggaactcctagactgatttaaaaataggaatgaaattgttggataatattctaatacccaagaagatgaataatgggtgtgtctagagcccatttttacaatctagacatttaattttctgattttgaaaatgtttttttaacatggtttacaaatgtagcaattcttaagaatgaagaaaatatgccttattactataatgtttttcaacaatacaagtgtttttctgattaaagtgtatgtgcagactatgcttcggggaaatactttgcttgaaacagcagttttccttccacatctctttctgcagccccactgatttaccatgatgaagaaaggttgagaagttctttatgcatagctacaagccttagttctaactttcttctctgaagtcttcttttgtgcttcttacacattaaagacaaggtgaatttaaggtgcctttatggtagacgatatttttagggcctgaatttaattttcaaactgaatgagtcacacagtagcatgtactgatcaacttgcatctgtgtagcaaatatttctttttaacaattagatagttactagcttatttttatcatatgagcaatgtacattcattatagaagatttagaaaatacagaaaaataagggggaaaattacccattgtcctatctccccaagagaactactagaatcgtttaggtcagtggttgtcaacggggaggtggaaatagggaattttgctccccaggggacaattgtcaatgtctggggcattttttttgttgttatagcccaggggttgctattggcatctagttggtagagtctggggatactgcccaacatcccacaaggtacaggacagccccctgcaacaacgaattatccagcccacagtgtcaacggtgccactggtgagacatttgatttagataggttttcttcccatctgtaaaagggtacattttattagaaaaaaataaatatttctttgggaaatcttagagatgctttagaatggaattctgaggcaacattttaattatattattgttattctactgttattgtcttgaaagtaaatggaagtgtgtatatgcgtggagagggcagggggcatacagagactctatcagagtccatgtaggttaatgctgttcagccagggctgtggaaaacattgtaatgactaaactgagattctccaagtagcctctcgtgattgggcatgcggtagcctagaccttagtctcagaatgacgaaagtttagaactgggaggacctttgccagggatggcaaacaggtttcatgtggaagacaggtgccagttgatggttggctgcttggagtatctagctaggaggacctggaggccaaacctgggcttagcgggaaaggaatatcgcaactgattagggatgtttgttctgaacctatgattagggaattggggagatgcaagccgtggcctatatatttaccattcctgaattctagtttagtgttcgaattttacaagtgggaaactcagcctcattggagtcatcctgatcaagggcctggctctcagacagaaacgggatgttcttagtttctgcctcagggtctttcatgaagggattcggcctaaacaagctcccatgattcagatgtgcaagttgattgctagattattaatttttgttcagagataacctctactagcaattggaataagtaccctaaatagacctaaatagatctctgcttctcctcatttccccaaatcaaaccaaacagaagtcaaattattacaaagtagcccttaataagggaagttgaatgtgccttttttttgagagagagaacgtttccttaagctggatgaaatagcattggatcagaggacgaacaagatcttccttgtacctataatactctttgagttctgtgaatacacagggataaaacatttcactgatcacttttttttttttttttgagacagtatttagctcttgctgcccaggctggagtgcaatggcacaatcttggctcactgcaacctccgcctcccgggttccagagattctcttgcctcagcctcccgagtagcttggattacaggcatgcgccaccacgtctggctaattttgtatttttagtggacacggggtttctccacgttggtcagggtggtctcgaactccttaccttaggtgatctgcccatcttggcctcccaaagtgttaggattacaggcatgagccactgtgcctggccctttcttttttatattttttttaatttttttttttttttgagacacagtctcaaaaaaaaaaaagccacaattggaagtcaggttataatccagtatttaaaacctcaaggaattcattcattcttctcatgcttccccctctgtaatacttttttttttttttttgagacggagtcacactttgtcgcccaggaggctggagtacagtggcaggatcttggctcactgtaatctctgccttccgggttgaagcaattctcctgtctccacctcccaagtagctgggactacagataccaccatgcctagctatttttgtattctcagtagagatgcagttttaccatgttggccgggctagtctcgaactcctgaccccaagtgatccacccgcctcggcctcccaaagtgctgggattataggcatgagccaccgcccccctctgtaatactttttcttgctgtctgcaagcagggatgtgcttgggcttctattctgcaaactgtacagttgcatgattggccaaaacgaatggctaccaaccgacaattgactgagtattgcaagttcattgaaacagagattggatgatttacacatgtgtatatttgcccattgcccagcacatggtaggtgctcaacaaatattttccagtgctaactcggtttcagtatagccacaatggagaaagatagaataaaaataattgatacccaaatactaacctaaaatacccagccacctatgaatcttccttttgaaatctgtaaagtttttcagctttaactcatgttacctgacaattttacattatctctcaatactattgaaatccaagaatatattttatttctttctgccaaatgttcttttaatttagaggccctattcaataatagtgtattttagaaacaactgattgttattgggggtttgtatacatgaaaaaactccttggattattatagagaaagttaaagccaggatacattagaaatgcagaaaactccttaaattaaaaagcaagccattttaataaaagaaataagctctccttggagctgatacctgtagaaaagtttgcatatgaagccaaaagcataactaagtacctctcgatttgtaagccatttatttatctttggaagtaataatagaaaccatgtatgggctgggctttaatcccgttgcttgctttgtaggatgtccagatggcatagctttagcctttgcctacatttcctgctgatcctgggagaagggaaatgtgcctcccgcctgtacaaataaaactgacaccatcttttctttctatttcatcgtgtagggagtagagtgttttgcacagacgccacaatatcagtttgtctagcaaacagaagagtatgtccagaagtggtgagaggctgcattcttcctcccactgaaagtttttcctgtgactgcccgagtgaagctgccttcacaagctcaacccagaaaggagcttgcctccttgtggtattcgaaaggcacatgcaggcttcataagaatttgcagaaggggtatttcttgggttttcttggtcttaggggtaaaacgagaaagtatttgccatctttcctgctggtgagcaacccataaatataaacacaagcctaggccagttgcggtggctcatgcctgtaatcccagcactttaggaggccaaggtggatggatcacttgaggtcaggagttcgacaccagccgggccaacgtggtgaaaccctgtttctactgaaaatacaaaaattagccggccgtggtggcacgtgcctgtaatcccagctacctgagaggctgaggcaggaaaactgcttgaacccaggaggcggtggttgcagtgagccgagattgtgccactgcactccagcctgggcgacaagtgagactgtctcaaaaaacaaaaccataaacacaagccagtgttataaatgctatgaaaaacaaattcccttttggtttaaaatgttttctctgtagtatactttggaatggtaaattttatgttatgtgtattttactataataaaaaatttttttcttttctttttttttttttgagacaagagtttcactcttgtcgccaggctggaatgcagtggtgagatctcacctcactgcaacctctgcctcctgggttccagtgattctcctgcctcagcctcctgagtagctgggattacagcacctccccaccatgcccagctaatttttgtatttttagtagagatggggtttcaccatgttggccaggctggtcttgatcgaactcctggcctcaggtgatccacccgcctcagccttccaaagtgctgggattacaggcgtgagccaccatgcccagcctaaaatattttgttctagctattttctcacccgctgatatttgtttaacctgaaaggcgaattcttataagatcttgtttctcagagtgaccctcaggtggactggtgataccaaagtttaggtggcaattcactttctccattttttgaagactgaaaacaggggcagcaattccattatttctgagagaaatgaaaacatatgtccacataaacaattgtacacaagtgttcataatgaccaaagagtagaaacaacccaaacttccaccaactgaagaatagataataaaatgtggtatatccatacaatgtaatattatttggccataaaaaggaatgaagtgctgatgtatgctataacatcaatgaaccctgaatacattatgctaagtaaaagaaggcagtcacaaaaggcctcatatcatatgagtccattcatatgaaatatccagaatagataaatctatagagtaaaaaattagattggtggttgcctagggccaagaggcagagagagaattgggggctcagggaatgatggctaatggttatggggcttttcttgtggggttaatgaagatcttctaaaatggattgtgggccgggcgcagtggctgacgcctgtaatcccagcactttgggaagtcgaggtgggtggatcacctgaggtcgggagttcaagaccagcctgaccaacatggagaaaccccgtctctactaaaaatacaaaattagccgggcgtggtggcgcatgcctgtaatcccagctttccgggaggttgaggcaggagaattgcttgaaccagcaggcagaggttgcggtgagccgatatcacaccattgcactctagcctgggcaacaagagcaaaactccgtctcaaaaaaaaaaaaaaaggattgtggtgacagttgcataactctgtgaaggtactaaaagccatcctaaaaacgggcaaattgtatggtatgtggacttcagtgcatttcccaaaatcttaccattgcagggaatgagcatgttggatttttaacaacactgtcttttccagggtgcgaagtaccacattactgtcatctccctgtgagtgggattggcaccccggctgcagctccaggagcaagtactccaggaagcacagagctgtaccagtacacggcccacgttgccaggtatttgcttatttaatctctcatcaacctagttactggtctcccccaaaatttgttcgaatagttaccgttttcacattctagaggtagtcagagttaccatttttgatgttgctgatatatacattttcatagaaaatttaatggtaatgtcctatttaccaaagaatagaaacatcttacctgaattaatggactgaattgataggtataactttgccatggttggtgaatgcttattgaggatgacctttctggcatgtaagtaagtacaacttctgtggttcaaaataaatgcctaaattggcatttggtgctgatgatgtctgggattggaggtcattttaataggttatattttttcattatcattgaggtagtaaaattatataacagtggtaagcactttgatgaaaagataaaggacatcagtcacactggcttctaaagattaattatgtccaagcttttagtgaaagagctaggagcgagtattatctatttactgattcacttttaagagtgaatcaaatgagatttacaaggtcttaaattttgacagatgtgggatgcatttgttttttgttacactttgacctctgtttataggccaggccatggctagctggaatggggttgtaatttttttcatgtgcttgttttataattcctgtctgttgaagttggcagcccctacttgggtggattccagataaatgtgtgaactggagtttagtggagtgtgaatggcacactccagaagagcagatagtcgttcagatcctagtcctgctgccttctaattgtgtgatcttgggcacatgtcttaatgcttctgagcctcagatccttcatctgtaaaaagggaacgtcgacatgaaactaaatgagttaatgggcccagcaagtaccaggcccatgctaaggcctttctcagtgtctagttgtccaaatgaggacattcaagtgggggaagtcctcattttccactgaattaacagggctggatgtgggttttgtttactgaaatgttctctctggagctctttttttttttttttttttttttttttttttgagacggagtctcgctctgtcgcccaggctggagtgcagtggtgcgatctcggctcactgcaagctccgccctctggagctcttaaaggtcccagccaggcaaggcagctcatacctataatcccactgttttgggaagtagaggtgggaggatcgcttgaggccaagagtttgaaaccagcctaggcaacatagtgagaccctgtctctatttaaaaaaaaataataataataatttgctgggcatggtggtgtgctcctgtagtcctagctacatgagaagctgaggtgggaggatcgcttgagcccaggaattcgaggctgcagtgagctataattgcaccactgcaccccagcctgggcaacagagtgagactctatctcagcaacaaaaaaacgtcccaaacatgagaagacagatacctgctcagactccagaaattgttttccttgtctgggcgcggtggctcatgcctgtaatcccagcaatttgggaggccaatgtggaaggatggcttgagcccaggagtttgagaccagcccgggcaacatggcgaaaccccatctctgcaaaaaatacaaaatattagccaggcgtggtggtgcctgccagtaatcccagctactcgggaggctgaggcacgagaatcacttgaacccaggaggtggaggttacagtgagctgagatcgtgccactgcattccagccttgcgatacagagaaactgtctcaaaaaagaaaaaaattgttctcctaaaatctttagatttctagataggatctgttgattattcaaataaattggaggggtactatagagtatggcaaagagagattggagctagcattgtctgttggaggaaaggctctttctgactctagccagcccctcctgataaatacctcccttgttctggttccctgtacctgcactatgaactgcatgcctttccaacatcaatttgattgcctaagtcagtgccttactccagagttctttcatgtgtaaacacttaagcttggctttctgggacgaatcagccttgggtgagcttgagtgatgtggatttttttcccaggcatctcacgtcgccctagtttcagatccagcaaacactcattaagggccttttatgtgccaagcaaggggcaaggtgctttcacccatatggttcctcctcacaacaaccctaagaggaaagtattaactagctcccatttgtaaataaagaacttgagattcaaagattttaaatgattcctttgtggttgcacagcccctgacttccaagttcagtgagatttgtatttctatactaattctacagagcttgaagacttaactccttaactcagacgagtaaaaaggtttctctctaaggccagtttggatcaattgctaggtggctgcctggagttaaggatttgcaagtgccgctcaagtttgttgagcaagaatgttgtgatcgattggcaatgtccggcgtgggtggagcaggtgtctgccaaaccgctctggacctgaggtttctaatcatcagcctctactcattctgctctcctctgccattctggagtctctcctctgatgagcactgtttgcctgaggctggatttttgcaactttaaggggctttgattatcacctttctgacttggcaggatcatctttgccttcagaaataatgctaaggctttgggaggctgaggcgggaggatcgcttaagcccaggagttcaagagcacctgggcgacatagaccgaccctgtctccattaaaaaaaaaaaaagaaggccaggcatggtggttcgcacctataatcatagcactttcagaggctgaggcaggaggagcccttgagcccaggagttcaagaccaacctgggcaacataaggagaccctgtctctttttcaattttataattttatataaaaaaattaataaataaaaattaaaaaaaagatgctaatagtctggtgaagagcttcattttctagatacgaaatctcattgttaggcaatttagataccttaaagttatcactgactcaccccatcatataggcttagaaaagtgagttgaggttggggtcagtggctcacgcctgtaatcctagcactttgggaggccgatgtgggtggatcacctgaggtcaggagttccagaccagcctggccaacatggtgaaacctcatctctactaaaaatacaaaaattagcctggtgtggtgctgggcacctacaataccagctactcaggaggctgaggcaggagaatcacttgaacctggtgggccagagattgcagtgagccgagatcgtgccacttcactccagcctgggtgaaagggcgaaagagtgaaactccatttccaaaaaaaaaaaaaaaaaaaaaaggaaaagaaaacaaaagaagtgagttgaaggtgaaagctcgaaacttttacttctgtgcacctgggagcccctctatagcttctttccctcttccctaggggctcctcggtttacaggaattctcagggaaatcactccagcagccaaacttccatactgggatggacagacccagagcagtggcacatcggtatcgcctggagggcgtgttaaaacacggattcctgggccccacccccagggtttctgcttcaggcagtctggggtaagtcccaggaatttgcatgtctggtttccactactttgacaaccactaacctggagagtacttgtaatggctggtttagagcatgggcttgtttacagatggtgtgtgtggccagtttctctatctgtggggaagggattctgtcctcaaatatttaatgagcatctcgcactgtgctgctgagggaaatgtagaggaatattaagcttgtccctggtagactttggagcctaatttggaatcagtaaattgcattgctgtgtgtaaagtactgccctcacccccttaagaggatgtggcagaaggcctgaagcagtgactaagtcaggggaggattcctgcggcaggtgatatttgaaaggaaacctgaggctaaaaagttattggctatgtgcacttatgggggaagagaaactcggagcagagcctgtacattaaaagagtctggagatgctgcactaggtgagaagaaaaggtttgtgtttgttctgagaattccattgtgactcctatatgtaaaccagaaagtatcagagacaaagtctcaatcaacttagagagtttggccaggcagggtggctcacgcctgtaatcctagcactttgggaggcccaggctggaagatcgcttgaggccaggagtttgagaccagcctggccaacatggtgaaacaccatctctactaaaaatacaaaaattagctgggtatgtggtgtgcacctgtaatcccagcttcttgggaagctgaggcaccagaactgcttgaacctgggaggcagaggttgcggtgagctgagattgccactgcactccagcctgcgcaacagagtgagactctgtcccaaaaaaaaagaaaaatttagaaagtttattttgccaaggttacaggacatgcccataacacaggctcaggaggtcctaacgacatgtgcccagggtggtcagagtacagcttgcttttatacattttagggagacataatacatcaatcaatacatgtaagattttttttttttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtgtttttagtagagacggggtttcaccgtggtctcgatctcctgacctcgtgatccgcccgcctcggcctcccaaagtgctgggattacaggcgtgagccaccgcgcccggccaatacatgtaagatttactacattggttccatctggcagagcaggacaactcaaaaggggtagaggggctgccaggtcataggtactctactctaggggtacctaggggctgccaggtcataagtactgctattctaaagcctccaagtaacaggctttagagaataaactgtaaacatttcttatcagacttcaggtcagtgttgatgttaatattggaggggtatgatggggcatgtccaacccccacttcccttcatggcctgaaccagtctttcaggttaaattttagggttccccggccaaggaggaagtccattcagatggttgcaggggcccttcaaattttatttttggtttatagatatgaaataaagatgcaactgtataatgatcatgatgaaatgtgggtgcttactgtgtagttggtgctgtgctaaacatgttactcaaacatgttacttccatcgtcttatttctcatacccatcccatgaggtggaggtccaactctaatccccatttgtagtagtttgccgaagccacagtaacaaagcaccataaactgggtggcttaaacagaaattaacataaattattgtctcatggttctagaggctagaagtctgaactcaaggtgtctgcagagttggtttttttttttttgagacagagtctcactctgtcgcccaggctggattacagtagcatgatcttggctcattgcaacctccacctcccgggttcaagcaattctcctgcctcagcctcttgagtagctgggattagaggcacacgccaccatgcctagctaatttttgtatttttagtggagacgggtttcccattttggccaggctctaactcctgacctcaagtgatccatctgccttgacctcccaaagtgctgggattacaggtgtcagccaccacgcctggtccttattctttcttgctttctaatgacttaaagctaaacatattttccaaacagaaatcagagtgtgtgcttttttactcatgaaccaacaagacagagtgctggtcatttggcctatccttggaaatctgtgatgtctggacatcttaagcatagcatgtagatgagtaatactcaagctaggttctgaagcataatttaattatactcctgcatgtttaaaagaattcagaacctaagaattaaaagctgacccagaggcaggcacagtggctggccgggtgcggtgattcactcctgtaatcccagcactttgggaggctgaggcggtggatcacctgaggtcagagttccagaccagcctgaccaacatggtgaaaccccatctctactaaaaaacaaaaacaaaaaattagccgggcatggtggtgcacgcctgtaatcccagctatcccagctactcgggaggttgaggcaggagaatcgcttgaatccaggaggtggaggttgcagtgagcctagatggcgccactgcactccagcctgagggacagagcaagactttgcctcaaaaaaaaaaaaaaaaaaaaaaaaagctgacccagagccctagatctcttaacttttcacagccaaatcttaaaaggcttctctgtgctttttgttccttttcctcactatcacctgcccttctgacactttctcctctacctatgccagaaacttagaggcccagtaagtggtttcaggtgtcctatgggctgcgcacagcactaaataaaagcacttcccttagctcttcccttaaacgttgctgtttaaggaagcttattcttcttcttattttcaagacagggtcttgctctgttccccaggctggagtgcagtggcatggtcatagctcactgcagcctccatcccctggcctcaagcaatcctcctgcttcagcctcccaaagtgttgggattataggtgtgagccactgcaccaggctggaagcttatcttatgatttccatttcatctgataaaattgagatgaagaatttgcttctagttctggctggaatgggggggttcttcactcacatcggttttgattcttcactcatatcagttgaatggttggtgacaaaacttttcagttcagtcaaaatttttattcatttagaggtaatctgattgtgtagtgagattaggcaatccccttgggcaggattcaccgccccccccccatcaaaattatttgatatttgaaaaaaatatgccgggcacggtggtttacacctgtaatcccagcactttgggaggctgaggtgggcagattgcttgagctcaggagttcgagaccaacctgggcaacatggagaaactctgtctctacaaaaaataccaaaaagaaaaaaaaatagctgggtgtggtggcgggcgcctgtaatcccagctacttgggggtgctgaggcaggaagataacatcacttgcgaccaggaggtccagactgcaatgagccaagattacgccactgtactccagtctgggtgacaaagtgagaccctgtctccaaaaaaataaaatagtgatgtttgaaaaaatatatacaatttttattataattattgctgtttgatattgatatttgaaatataatattgatattgatatacaagtaatcaaacatttatgcatatataaaattatttttacttcacatcttaagactggttacttaaaataattaactctgtcaatacgctttgaaagaggctttgtaaattgttaaagttacatttgtctcttctgatagctttagctcagcagaataaatatggtaatagttggctgggtacagtggctcacgcctgtaatcccagcactttgggaggccaaggtgggcatatcaagaggtcaggagatcgagaccatcctggctaacacggtgaaaccccgtctctaccaaaaatgcaaaaaattagccaggtggtggaacgcgcctgtagtcccagctactcgggaggctgaggcaggagaatcacttgaacccgggtggcagaggttgcagtgagccactgcactccagcttgggcaacagagggagactctgtctcaaaaaaaaaaaaaaagaaagaaatatatacatatatatatatatgtgtgtgtgtgtgtttctttttttttcctagagtgtgtatatatatatagcaataaagagggatgctttcccaagacttagaacaagaaatcaaaatactttagcaactgaaggatgattcaagcaaaggcagaactcgatcaagaagggagaagatatgtaaaaaataaagtgtcattgggaagaatagctaggattggctctggaaaaaataatagaaaaacactctgcttatgtgatttagtgtttacaatgtaaatctgaaggacttctgaatcttttggaaataaacctggattgacttgtttaaaaacttagatcatgtctcagtgacagagctcagcaaaaaacaaaaacaaaaacaaaaaacagaaacaaacaaaaacttagcttatgactttggaggtaggaaaagctgaaagctccctacattcctgaaattaaatgaaagatttcactcttgtgtttaacctggccttcagatcctagattagcaaagaatttgatgtaccttctacaaacctgattttgttcattatgactccacaccttgcttgctttccttcactactctaggaatgtggaaaagtttagctggatgtagtcctggcctaccagcaagctctcccagagagcatgggacagaaaagctcagagaccaaaaccaggtgttaaaatcacacgattcactcaacttgaaaacatagtgagaagcaaggggaaaaagatggtgtattagtctattttcatgctgctgataaagacatacccaaggctgggcaatttacaaaagaaagaggtttaattggactcacagttccacatggctggggaggcctcacaatcatggcagaaggtaaaaagcacgtctcacatggcagcagacaagagaagagagcttgtgcagggaaactcccttttttaaaaccatcagatctcgtgagacttattcactatcatgagaacaggatgggagagacttgcccccttgattcaattacctcctactgggtccctcccataccttgtgggaattcaagatgagatttgggtggggacacagccaaaccatatcagatggagactaacaggtaggtgaggatacaaatggggtgagagatccacacttctggaaccctatgcttgcagtgtcagctttccctgctgatggtgtggtcacaaaaaccaaagttaaggttgaacaaggggcttcaacggatgggaagtatctgaagtcagcacatgcgtgctgtgtcggagggatgcaaggtagtatgcctggccaatagctgtaggtcatcagtgatgtgtgtgtgtgtgtgtgtgtgtgtgtgtttaagatggagtttcgctcttgttgcccaggctagagtgcaatggcatgatcttggctcaccgcaacctccgcctcctgggttcaagccattctcctgcctcagcctcccaagtagctggggctacaggcatgcgccaccacacccagctaatttttctatttttagtagagatggggtttcaccatcttggctaggcaggtctcgaactcctgacttcgtgatccatccgcttcagcctcccaaagtgctgggattacaggcatgagccactgcgcccggcctgatctgtgttttatctacattttggggcagagtatatgtggggccagaactgaacatgatggatgtcacctatgggtgatcaatttaggaatgacatagctgtcaatcttggggtaacatgagctgagcactattatatattattaatatttatgaagtgtctattattaacaatgtaaatcataatctagaaaaatactttatatataattatatattatataaacaatatataattgaccgggtgtggtggctcacgcctgtaatcctagcactttggaaggccgaggtgggtggatcacctgaggtcaggaatttgagaccagcctggccaacatggtggaaccctgtctgtactaaaaaatacaaaattagccggcgtggtggtgcatgcctgtaattccagctacttgggagggtgaggcagaattgcttgaactcaggaggcagaggttgcagtgaaccaagatcatgccatggtactccagtctgggtgacaagagcaaaaactccatctcaaataaataaataaataacagcatataattatacaaattatatttttataaaattgtattatataataaatataatttttatatattatatatgaatatatatgcctttatatattatatatatacataaagtataattttgtattatatattatatataaaatacaattataagttaaatatttattaactttactattaagtaaatattgtaagatttaaaatttatttcattcctccatttctttgtatgtataagtaaaactctcatttgtttcattcttttaatctatatttaacacaggaatattctattctgtttaacatcttacaggttattatcttacatgtcttacaacttactgtttacacttaacacatcttatgaattctgcgtgagtcttacaagctacttatttcctcattatctatgctaaatgaatcaggagtttcattcatctgatttttaaattgtcctctatactagtttgaaggagaactttaaatgaaagtatttattcagccaattatggtatattcatacaaatggaatattatgcagttagaaaagatgatgatagagatctagttcatgaaacaaatagtcaaactctattcttatgtagaaataggttgcaaaagagcaaatttggtgtatcccaagtgtataccccaggtgtctaagttgtgtacaatatgtacctacttgtctgtgcagagagatacctggaaaggtgctcagtagttggctctggatggtgacattttagttgtactttaccactttttggtgatctacttactgcatagtttgagtgaataaacaattatcacttatattaaaaactgaaatccaaatgtgtgtttgtacaaacatatgtaaataacataaaaagaattgtaagaccagacccttttcttctgaaaaacgtacacagcattttgcaaataattattttttaaaaagtatctttattttattttatttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttgtatttttagtagagacggggtttcacccttttagccgggatggtctcgatctcctgacctcgtgatccgcccgcctcggcctcccaaagtgctgggattacaggcgtgagccaccgcgcccggcctcagtatctttattttaaaacatttttagctgagtgcggtggctcaggcctgtaatccctgcactttgggaggccaaggcaggtggattgcctcagttcaggaattcaagaccagcctgggtaacatggcgaaaccccatctctacccaaaagacaaaaattagctgggcatggtggtgcacgcctatgttcccagttacttgagaggctgaggtgggaggatcacttgagcctgggaggcaatggttgcagtgacctgagattgtatcagtgcactccagcctgggcaaaagagtgagagaccctgtctccaaaaaaaaaaaaaaaattgagatggggtttcaccatgttgcccagactgaactcaaatccctgagctcaagccatccatccacctcagccctcccaaagtgctgggattacaggcgtgcgtgagctgccatgcccagctgcaaataattatttttttaaacttcaaaatgttttacctgacttcaaaattgtaatctttctgtcttgtgtcagagaattgtaatgatgtccctttagcagaatttcctaaacctctcccatgatgagaatcacctgggggggcatgtgaacgctgtcagatcccaacgcccttctcagacccactgaattggaatctctagcaagggacctaggacactggttttaacaagtgcctctggtgattcctatcatcagagaaatttaggacactgtcttatagaaccataaattttatgagccacgttttcaatttttattgaacatctcccggaggtgccttttccaggccagtttcctttgtttaaagaggcccatgcaaatttgcatggctaccctggaaagctatttgcttgcaggttttttctaaggccactttcagatccgaaaattctttgtgaatctaagatactcttcaactttaatctgtgttgatcgaggatcctgaattcttagagctagccgattctggtgataagttttttaaagcaattcaggaatgcagagggccctctggtttccccagagtactggacagtcccctgggccttgctcaccttatattccctcttagagcccctgagaggagggcctttttatttagtgaaaatttttgtttactgaagtgtttttcttaaagtattttgggggtgaagggagctctgaaactcagttagacaatagaacggcatttgaatcaaggattctctcgttggagtcaaatcgcatttgtggcattgacctttttaatatttcataggaagagtttcacaaacttgattccccagcattgcttggataaaactcactttagttgctgcgagagcaaaaatcgtcttgcattctgttaaaagaagctaaaaggaaagcaacaataacagccacacctctcctcccaccccatgcaattgttttactgggtagaggcaaagaatagaggggccggaaagccgggaagtgaatgggctttgaatctgacagacctggacctggattttttttcttttttttgagatggagtcttgctctgttgctcaggctggagtgtagtggtgcgatcttggctcactgcaaactccgcctcccaggttcaagcgattctcctgcctcagcttcccgagtagctgggattacaggcgcccatcattacgcccggctaatttttatatttttagtagagacggggtgtcaccacattggccaggctggtcttgaactcttggcctcaagtgttccgcctgccttggcctcccaaagtgctgggattacaggcttgagccacggcgcctggctggattctttctttttttgagacagggtctcagtctgtcactgaggctggagggcagtggcacaatcacggctactgcagcctcaacctcttggactcaagtgattcttctgtctcagcctctggagtagctgggacttcaggtgtgtgccatcacgctagctcatttacttttattatttttattttttgtagagacagggtcttcctatgttgcctaggctggtcttgaactcctgggctcatgtgatcctctcaccttggtctcccaaagtgctgtgattacaggtgtggccaccatgcccggtgggtttggattccatctgcttgaggacaaccatgggcaaactgctttctctgaagcatagtttcttcacgtataaagcaggggcaagaatactgactatatagtcactacattgaatgacttagtatagtatatgaaaagctcttggcacagaatatgcatttagtcaatcattgtttatcagagtttctccactgcttctcagtggagggctaacaaggggtctctatccccgaaaagagagtgtggctttcatatattctgcagtgtaaacagcagtaaaatagtaaaagctgtcatactttggagcaccttggagtgcctctgaggacccagggtgtcctgccaggaagaagtgctccctcctccatgttgcaaagcacgctccccagcaggtatgtctaaactagaacgtgtgccataggatgcttcttggctttccaggagtggatcagggttacgctctgcctcagccccaggcggagcaccaccgtggcctctgcccaccagcctgagcacacccagatgagccctataagtcacctaggagtctgcatgtggtcagcctagactacagtcatctccttccaacccaggactctccccaaacaccagtctagggcaccccagcttcttaatccgttcaggccatagctgactctgaattgcacagctaattcttttttatttttttttgaggcagggtcttgctctggcacccaggctggagtgcagtggtacgatctcggctaggcagcctctgctttccaggctcaagccatcctcttgcttcagcctcccaagtagctgggactacaggtgtgtaccaccaggcctagctgttttttgtagagatcaggtcttgctatgttgcccaaggctggtcttgaactcctgggctcaaacaatcctcccatcttggcctcccaaagtgctgggattacaggcgtgagccatctgcctaaccttatttactgtttttaaacagtaaacagtaaaacagttttaaacagtaaaacaacacagggccaggcaccgtggctcatgcctgtaatcacagcactttgggagaccaaggtaggaggatagctagaagccaggagtttgaggccagcctgtgcaacatagcaagacctcatctctactaaaaataatttttttttctgagtagctgggattacaggcatgcgccaccattcctggctaagttttgtatttttagtagagacggggtttcaccatgttggccaggctggtcttgaattcctggcctcaagtgatctgcctcccaaagtgctgggattacaggcgtgagccaccgtgcccagccttaaaaatatattttttaaaaaattagccaggcctggtggcatgggcctgtagtcccagctacttgggaggctgaggtggaaggactgcttgagcccaggagttggaggctgctgtgagctatgattgtgccactgcactccagcctgggccagagtgagactttttctgaaaaataaataaaataggctgggtgcagtggctcacgcccataatcctagcactttcggaggccaagacgggagaatcacttgaggtcaggagttcaaaaccagcctggccaacatggtgaaaccccgtctctacgaaaaaaaaaaccccagaaaaattagctgggcgtggtggcacatgtttgtaatcccagtttgggaggctgaggcaggataattgcttgaactcaggaggcggacgttgcagtgagcctagatcatgccactgcaccccagcctgggcaacagcaagactgtctcaaaaacataaaaataaaaataaataaataaaaataatactgtagtgggatctcatttttgtaaacatttttcgtttcttgataagtcatccatgtggtcttctgtctgtatatatgtctggaatgttcacctaatgtcgaagacaggtattaggactttagtttttaaatttcttggtgctcttctgaactcctcagatgctttataatgagcaccttattcttgcaaaactcagtggtctaaaaaattaacaaaaatgaaaatagtttttagtaactatggaacaatgtaaatagccttacaccttaagttacttgctttaataaatagaagaatgtctacctggcctggtgtggtggctcacgtctgtaatcccagcactttgggaggccaggaggctgaagcaagcagatcaattgaggctaggagttcaagaccagcttggccaacgtggtgaaactccacctctactaaaaatacaaaaattagccgggcatggtggcacatgcctgtaatcccagctacttgggaggctaaggcacgagaattgcttggacctgggaggcagaggttatggtgagccaagattgcaccactgcactccagcctgggcaagagagcgagagtctgtcaaaaaaaaaaaaaaaaagaagaagaagaagaatgtctgcgtgaaaatttgttctgttctttgagatactagaaacgtagatgccaacgtgttgggtttaatggcaaaaaccgcaattactgttgcaccaacctaaaataattgaaaagtggcaacttagagcagctttgttctttctacataatatcaagatgtgggaacaatcctgaagacaggtagtctgaaaattacttatgagtgatccactgaatgtttctaaaggaaaagcaagaatcttcagttgcccaaaagatggaggaggtctgagagttcttagagtggtttagaatgtgttcctctgtgctggaagatagcttgaaaatactttgctgtctttgtaatctttatacatctatgattgctataaagtcagctttgttctctatttctagaaccatcatgtattggaatgaggagcatctcaattcacaggtctattatttcttgggggtgggtgtcagagggcatatggcattagaagcagctctgtgtacaactgaaaacagtgtcgaagctatttaggatctgggaagtgtacaagttaattacccccaccctcaaaaaagaaaaaagaggaggactttaacaaactttgaaagtgatcatgagggcaggacgcggtggctcatgcctgtaatcccagcgctttgggaggctgaggcaggtggatcacctgaggtcaggagatcgagaccatcctggccaacacggtgaaaccccatctctactaaaaatacaaaaattagccaggtgtggtggtgggcgcctgtagtcccagctactcaggaggctgaggcaggagaatcgcttgaacctgggaggcagaggttgcagtgagctaagacggcgccattgcacattgcaatccagcctgagcaacaagcgcgaaactgtctcaaaaaaaaaaaaaaaagaaaaaagaaagtaatatataataactaaaagtgaaagcataagggggaagcagaacgttagatgccgctctcctggaggtaatcacaggggccattgagtggggtgattattgtgggaggaagcctgcaggtgaaccgggtggttattgttaactggtgtttggactgaggaagatgggtggagccaggagaggagatgaggctacctggaagtgggggcggggacgggggaggacacaaggcctttactgaaaaaacatcaggtccttctggcggagttttagctgctgcctcagcactttagtcatctctgtagttgagcaattctcctaacgtgtcacaatgtgtttacatatcgttgtcttcaacacactgtgagcaggctcccttttataaattgtcattatcttctgtatagctaccccagggtatatggtaggcattcaagaaaggtttgttaaaggagagttacgattccagtctactttacagtgtacacgttaactaaattgtttggtgaacctgtaaacttttctctttttttttttttttgggggggggatggagtttcactcttgtcgcccaggctggagtgcagtggcgtgatctcggcttactgaaacccccacctcccaagttcaagtgattctcctgcctcagtctcccaagtagctgggactacaggcgcctgctaccatgccagctaatttttttgtatttttagtagagacggggtttcaccatgttagtcagggtggtctcgaactcctgatctcagttgatccatccgcctcggcctcccaaagttttgggattacaggcgtgagccaccgtacccggctgaacttgtaaacttttcagtgttagttttctttgctcccagttgatgatactttataaccatattgcagatatatacatatatatatatacacacacacagatatgtttcttaagatctccacattcttgagaaaatatgactaaaaggcatttagtttatctcattaaggtcttctgaccaacttatttcttattttttgagacagtgtctctctctgtcacctaggctgcagtatagtggtgcagtcatagcttactgcagcctcaaattcctgggctcaagcaatcctctcccctcagtcctcgagtagctgggactacaggcacatgctaccatgcccaggtaattttattttattattagtttttgtagagacagaatctcactatgttgtccaggctggactcaaatccctaggctcaagcaatcctcctgtctagcctcccaaagtgctgggattacaagcatgagcccctgcacctagctgaccaacctatttcagagaccttatatattgtaatatacactgaaaagttgaaaaaaattgtccattgcacaaacaataactaaatttaaaaagaaaaatatatgcacaagcctgtcttttcatgaagtcatttttttgcatactttccagtttttattttttttataattttatcactgtcatcatcatacattagatgtaatttgtgtttttttgttgataattatagcattatcattctccttgttgtatagacttccttattacaattttaaatgatggtctgctatgccaattatgttgatttactgtaatttaatagcccagcccaccatcattggacattggtggtttccatcattcattattagatacaggcatatagtgaagtgctgcctcatacctagtcatccactgtaatctaacctccagtcgtatctttccattgaaaagctctggccaagataagcagtggtcctccacttaatgaacatcatcagttcttaccttaattgacctcctcgaaattccatgttgttggcctctccctctttcctgaagtttgttctttccttggctttttggacactctcctccagaagcgttttctttcctttctggcagctcctctttggtctctgttctggcaactcaagtctgccccctaaatattggcattcccagagatgagtcctgtccttagtcctctcttggcttaatctacatcacgtctctgaatgtgggattgtcccctcccaagacttcaacttttatgatacattgatgatacccaaatcactcccaaatctctctcctcaaatactcatcagtgcctagcacataggagacacttgatacatatttgttaaattactgaacatcttcacctggatgacccatagcacttgaaaatcagtctgtaactaaactcatcatctttcttcaagctcctcccaagatctgctcccactcctgtgttctgttttgataaaagccaccgtcatctcctttaagtaagccagaaacctgagagtcagcgtaggctcacttcccgctcgcgtctccccatatctagtcaggcagtcatccagcctgctgatctacttccttagtttctctagaatctggctcccttttgtctaacactgcctaacttcatagccacgtcatctctcacctgcattcccacaaaaatgcatttttggccggtcttgtcattcttactaacattctcctcccccaccaacccctgtcccccaccaactgtcaaatccatctttatacttgcctgggcaacttcaccttctggcacctcaagagtaagcctgctgtctcttccttccttacttctctctgtgttatttattccccttacctggaaggcttttttccttctttgtgtcttaaaaactcattccgacctctcctttagaatgtataagcaaccccatctctggaaagccttccctaagtctctcctgctagaccactctgagcctgccaggaatctcagtgcttacacagtttatcattacttgttgattgtctactgcaatagactgagtttcctaaggcaggatcctgagtattttatcaaggggttgacagaggtgttcagtaagtacctgttgagtagaagaatttttttttttttttttttttttttgagacggaatctcgctctgtcaccaggctggagtgcagtggtgcaatctcgtctcactgtaacctccgcctcttgggttcaagcgattctcctgcctcagcctcctgaacagctgggactacaggcgtgcgccaccacgcccagctaatttttgttatttttagtagagacggggtctcaccatgttggccaggatggtcttgatttcttgacctcgcgatctgtccgcctcgacctcccaaagtgctgggattacaggcatgagccaccgcgccctgcggagtagaagttctttggataaacacattctaggagtggggtcaaaatgtgcaaacccacacgtgaagaagatgactaataaattgtttctccaaagagttgtattgatttacactgccaccagcaaaaaagctaatatatcaactgaaccgtgtttctaacaaccatttactgaatgcttatcatctgtcaggtgttgtgccagaagaatggagtttgtctataaatatttcatcatttcgagtagtgcagtccaacagaactttctgcattgatggaaatattctatatttgcactgtccaatagggtagctattagccacatgtggcttctgagcccttgaaatgagacaagtgtgactgaagaactgaatttgtcatttcctctaattttagttaatttacatgtaaatgtaaacacttactggtggcaagtggtcatcttattgaacagtgccgctctagagagaaaaaaggaaatcagtcagtagatgtaactgccacattctggattattttttaaatgttagtggctctaagcccacatcattaaggtgtggccacctttcaagtgctatcatttttattagtcagcaccacctaatttgggaaatattttatttttttttccttttttttgattaaaacaatttttaaaaaatagagatggggtctcactatgttgcccagactggtctcaaactcgtgggctcaagtgattctcctgccttgccttcccaaagtgctgggattacaggcatgagccaccgtgcctggccagatttgggaaacattttataaataggtgcttagatcaggagagcaatgccttacatcaggaatacaaccaaaatgtctaagtccggagactcgaggcaaagtgggaaacgttactcacagtgctttttatccagaggcgtggacttagttactccaaaggagtccagaagcataacacttctggagaggcatctactggacttgtttttccacgaaacttctagacttgttttgatcaggcaggaagtgaagcaacttttcagggagagagcccagcatctgcatctcctctgggacagaccacaccttttaccttctacttgtgagcctaggacgagttttgctttccaattaagggaagagcagggcaggcaaaactattctcttacaagatggttttttaagatttcaaacccaaggttatatttttaatcggtacctgtttggattctccaaattaatttatatgctcttaaaataaagacacttaacgtcactgcacaattctttgcacatggaggacttcgaaaggaataagcacactgaattgcattagatgaatcctgtcagataagcacttgtgacctactggcaaccttttataagctgatgatgggagaggagtttcaatctctttattggagttgttggaaatgtgccaaagagataacctggaatatattgtcctgaaaagtcctgttttaatatttaatacgaacatcttataaccctcggaattcgggtaggcagttgttgggctgagaaatgtggggtacaaggccgtgtatgtgttggttagccgggcaggcctctagacaggacctaaaactttgaggttttcccagttcgactcttcgtaggagaactgaagctgcctgtgtgaggccctgcgaacctcgccaaaaagtcttcctacaggatgcccccgcgacctcaccggggaaacaccgcggacagtcgggccagcagcgcccggagctcactccaggtctccaaacttgcagcacttcccagagcgcgcgcgctcggagcgggacctgcttgctccagtgcacgccgcggagcgaaccatcgggctggcgggggtggaggggtgcaggcgtgggggctgcgggccgctcgggccttgggcttctcctgccgccgccgccgcctcccgcccccggccaggagtcgcgcgtgacgcggttcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgtaagtgcctccttgtgccgcgcggttgggaggagggtcgtgagcgtgagcgtgggagcgctgggggctctgctcgcgtgctgctctgaagttgttccccgatgcgccgtaggaagctgggattctcccatccggacgtgggacgcaggggaggggtaggtttcaccgtccgggctgatgactcgtggcctccggggctcctggaacctttactctgaagtcacttgggctggagattaaggcgcgagtaggggacactgtcttgaacccggtgtcctggatttctgctggcttggaggcatctcgtgtctgttgtgtcgcttgcatgtctttgtgttttccttctctatttcaaaccacactcggtattgatgcaaagttacaggcttgtgtacgtgagagaaactgaaaactcatcacagagcagaatcccttttccctttcaatcagctgcgtctgtaatagaagtaaaagttgtttttttttttttttttttccagtagggaatggggatggaggtttggaaggacccacaaaagaggagtgtgatgaatgctttgtattctagtactagcctacctgtcaccagttctttttatgtcttcatttgtcaagtttctgcttttacacggtagtttaagttataaataatcagggatttctaccacagggttttaacattcttgaaatgtggacaaacttgggagtgagtgctcccgcgcttagtaatggaatacagcctcccacctctatttcagcttcagttcttaggctaggctgcttttctggcagctgtctggcctgagtaatgatggttgtggtttccctgaagttcccagcggagagtcatcccatgatagaaactgccttgcgcttctcactcacgctctcagcccggggaatcccagcggggaggagggagggaggtcgttttcttcagctccccaggtggtctgtgctgggtgtgctgacggtccttttgggaaaacaggtccacctttgccagcgtaattcagaaagagatgtaattttctgagagcacacacctgggcaggagatcgcttgaagtgagaaattcgtagtggtaaatgtatttgtagcaaagtaccactgcatatcctgcttgagaggatgaaatttgattatttagtaagttttcatgaacaactccacttcagtgtggggattacgcagatgagcaagagcgtggctctgtcacacagtcccgttgggaaagcctgcaactcattaagaatccgatgagtgccatttagaaatgtggacagggtactggagcttcctcattgtggggagatggcagaagcggaggtgctttactaaagcaccggtggcttttgaggtgtttcttgtgtttttttcagaactacttctgcagtggggccactttatttcttttcagagctacttatgcagattgatgaaggggaactttcccctctgaaatgctgctgtaactttttcagtaccatccagatattataatactgaatgagcccctactcctgccagtcactgtgggggatacaaagatgaacaagattcaatttctgcatttaggggtctagtggacctgaaactgttagactttactctgcaatctgtgtcgggattcctgagactgagggagggaatgtatgatgccgatgcacactctgcaatacagaaatttagcaaagagtgggattggtcctatatgcattcccttcaggggattcttgctgggaataaagggcatttgaacagttacctcacccgagcaagccactatagaaaatggggccagtaatgcgcccacctcaccgggctgagtgaggtctgaatgaaatgacagagagtacaaggcatgtggtggatgctacgtaaatggtggtagctagtaataggaacaaaacgggtgctgaaaactcttaagtgttgggtcctgggttgataagggaggtgagatctaaagatacaagtaggaggtgccaggtaggtgtccaggaaaaaactgaaagagttgttgttcacactctgttaaaaggccttgaaggccataacgaagctttgggtggggggaagtcagaaatccctcatgtattaaatgacttgactttccctacaaaagaagcgaaccagtttcccagtaaacatcccaccccataactatttttgaggcattcataggcttaagaccaatgaatttttacatcacccccgggggaattgcatttgcaatgacttctgcctacatttaacttttgatctagttctttgtacactgacaaaagttcacagccaaccatttctcttcaggacaagtgtgagaactttctgcatactgctgaaggcaagggagattttgagtttagcaaggttttctctccttaagaaggttatctttttacgagacacaagttattgaaactaggcggggccactttagtcctgtgtacaataatatgtgtagtaatataaatagtaatttaaaaagtcatgcagacttggttggggagaggcatgaagtttgggtgtggtgggggcggggtgaagcggtagaagggttcgcaatcactgctgaaactttcaacatattctaccaacaatatgagccaccagggaattccttgcctcatctctagaacgaatcccattaagcagttgtggctacagatgaatttatctaggttgagagctgattcccaataacatgcctcattgatttgactctaagcagtaatcaggggcccaacagttgttggaccaaccagccttgattttccagagaaggtgatttggtatatggtagtgtctgagggtgagattgccccagatgggagtggagggaagcagaacagttttctctggtgttttactgagtttttgtcttgatcctaaatccaagggttagggtcagaaacacagactcagaggttagatttaacacccatttagtgggttaaacacatcaatggttatgtgaactttgttaaggtttaaaaagctatttagggcctgtttctccctcataggaatttttgcaatcagcctttttagtagatgcccatatagaaagtgaatttgggagggtctaaggtggtattactattaaactttttgaaaaggctgtgtgatagcaatggaaaaaaaaattcaggcatggaaatccaatatgcagtattgcagtagctagttttaattttatttttgtttttttggttttttttttggagatggagtcttgctctgttgcccaggctgaagtgtggtggtgcggtcttggctcactgcaacctctgcctcccgggttcaagcggttctcttgcttcagccttcaaagtagctgggattacagaagtgagccaccgtgcccggccactagttttaattttggatggtacctaggaaagcagttgagctagtatgctgcatacattgtagtgtgagaggcagagttccgagttggagagtgtctgcttccactttttccatttgattaggaaaagcacttcttagaactgggtgactgacagctagagccccagaagacctgcacaagctggggcaatggctacccataacagtgacggctccattctgttttttaaagggattggtgtctctatcatccagctggccattaaacaaccaaagcttcatcatcctagataacctgtgagctctcagaggagacagagtaaggactatcatacccccaaaatacctaatcatttaataaagcattttctctaccttttatgctatcccaaaacagtgctttccaaagtctggtatacagacagacttacaggtggtgcagagagatacatattctatttttcaattatgatgcatgaatattatatgttaggaataaaaacagaaaaccagctaccacatccatttatttcatggctagattgcttagaatgaggcaaaaataaatattaagtaaagcagtgagtttgctttaagaaaaattatcaactctgggaatgagtaatatgaggctaaggcaaaaatggtaaagctagcccttgacatctgaggtgtgcataatactgcttaaaatatgagtgtggtgcttacttatagagagcctggtataccttgaccacgccttcaagaaagtcaaacacagaatggcccagaatagccaggaaagttgaatttgatggactttctgtcttaagcgtgtgcatcctgctcttatccactcagatctcttagatgtggttgcagacagtgtatttgtagagctagctgtttgttttaacgtctggcccaattctcattcctttctctgcttccacaagccattctgcagtttttaaaggtctgttggtatgatatttttgatatgatagagtgataggggaggaagtattttgacactgatgaaggacatcactgtattatcaagtgactcttgctcatgattcattgccgaagaatgtggacagccaaacagcctcacctgtaaatgcatttaatttctcaaagtctttcagaagaatgccaactggatgagtttttttttcttattttttttttaatatgaagcttgtattggtctgtaaaataggctttaacaaggattttcgtaggaacaggaagccttgaggtagaaaacaagtatccctgctttgacctagagagatgcatgctcatggcaggcgaatgaatcaaggagaagagaaaatactgtttcagtagactctctagtgatgtgtgtgttcacaccatttatgagaaatcctaagctttcaattagtaacttgtactttagtcatttaaaatcagcacagatgtttgtttagtgcctctgccagatggttaaagttaaatcaggttttttaacctgaaaaacgtaatgtagctttccttaaccatttacacaccattgtatattgcagaccatagtcagatacattttgttataatgaatgtttattttaccttttagctcaattagaatatcagtggttatggtttctattttgttttcctacagttactgtatgggggtgcagtaacagcggtggtggtgaaagtaagttacttttttctttttctttctttttttttttttttgagacggagtctccctctgtcgcccaggctggaatgcagtggtgcgatctcggctcactgcaagctccacctcccgggttcacgccattcagcctccccagtagctgggactacaggcgcccgccaccacgcccggctaattttttgtatttttagtagagacggggtttcaccatgttagccaggatggtcttgatctcctgacctcgtgatccacccgcctcggcctcccaaagtgctgggattagaggtgtgagccaccgcgcccggctgaaagtgaatctcttaatggatcttccatgaatcaaatatttgtgttttagtaagttaggctgaccaaaagatttcgaatcatacctttaatcatggcaaggatcttatgtcacattcttgagtacacatgttcactaaattttacctatatgtgtatgtgaacatggacttcagaattaattagtgtggtaattattatttctattgtagactttaatcagccatattaaatatatgcattatgttcacagagaaaacatggtatcatctttggaaactttacagtatgctctatattatagataccctatataactatggtactaaacacacgagttagtgacaagtcaggcatttggagggaatgtttgtaacccattgtgggagagagttattagaatagttattcttactggtaggtaacagttatggctgtaatgaatagaatgtgactaaaatccagttatgcctttgccatcgtattaaaagctttggtggagacgtgagaacattgcagatactttggattttgtcacttgagttgaaggtaaacagagaaaacagtactttctagtcatcagtaggaattaactcttccaggacatgtagcttcaaggaccttctaggttcttctgagggggaaataatgttccacttggggccatttttttccatttgttgagagtcatttgttttcagagtattaaaggaagtgttccgagttctaggttgtgtttctttgatgcctactaaagctgagcacacctgagaccctgggtggagctctacaatgggaataggagtaagtaatgtaggcttcgagagacaatcattctgctctcagtccttggaagactgttcctaggtatatatggcaaagcagatgaaattatttgagggaattaattagcaaaactaaacatttctgtttttgaaaggaatgaatcatttggaaggaacttcctggtgagctcagttttagcagcctggtttctgcgttacccttctgcagtctggctgaatcaattgtgttcttgcctgtgattggtgaggatgcacatgctagtatttattctagcccttatcacttcccatcagccctgagcccctccctggtctgagtcatcttggtaaccccagaagctaacagagcaccaacacatccactaaacgttggactgacttgatttggggcaggcttgttgtataagctagtaggaataagagactaattgagaaattaggacagtggattcctgacatttatatagtgagtagatgatcgtttgttagaattgcgaatttcatccagagaattttgtccaaaaaaaattatagaatttcatctagaccatttttgtaatggcatggaagcagcattagctgcaccactgattagctgggtggcttttgctgtcttgtgactctagtttgcaatttcttttttttttttttttttttttttttgaggtggagtctagccctatcgctgaggctggagtgcaatggcccgatctcagctcactgcaacgtctgcctcctaggttcaagcgattctcctgcctcagcctcccaagtagctgggattacaggcacacgccaccacaccctgctaattttttgtatctttggtagagacggggcttcaccatgttggccaggctggtctcgaactcctgagctcgtgatccgcctgccttggcctcccgaagtgctgggattataggcatgagccacctcgcctggcctagttctcagtttctttatcagaaaatgagtagttacagttgatcatctcaaagtcttttgtgcttaagattctgaaggttttgaagtttgagtataaagcctagagaacattctaaattatttccattggttcttctcatcttaaaatgtttttgtgctccttaaactacgtttgtgtttgcttgcttgctttcttttttttttagagatccagtggattatctctgaaaagcattttttaaaaagacagagtccaagagtggctggtagttgttttgctcataaagtgatggaaagatctattattcagttgcagcttaaattatgtaccagcaccacgtgtgctggattctcttccttactttgcagcttaagccagcaactgcaaccatcttgcagagcttcttgagaatccttcttcctcttcctcttcctctccacccccatggacttctccccgggcctcattgcctgtgacatacgcttggaaggaggggcaggcctgcagctgggagccctttctgatttgttcttcacaaatgtgttgaagatgagcctactggtcactgctgcaaaaaaccacattgttcactggtgtaaaatcactgctgtcatctgagtttcagcataacttcaggcatgttggagtttttcaacgtcacctcaggcagagcactttgccttccttgggctggtctgtttagtgtctgggtgagttttaagagaggagagacattgtggcatcttagacactcactgaaattttccagaaatggagctggaaacatttgtgcgtttccttctggtgttattgttaaagcctaaaaacaagggcaagtggcaacacattgaaatgaagaagccccaagtttgcaacacattgaaaggaagaggccccaagttcgttttgagcctaaattgaattttaatcaaaggtctgagagaaatatttagtctacttatactatttaagtgcacagtttggcagatgactttgggcagtgaaggatctggaagaggcaggaaaggtagactcaatctgccagacttagagctaaaaaaatttgcctggtatgtttccatgaagaaaattttcctgtagaagcagtggcacgacctctgttacaagtctgcttattgataatgaagctttttctgtgttatcaatttcgttgaatttatatgtatgtatatacatatacacacacacaaatctcaagtagagagcttgatgaatttctttttttttttttttttgagatggagtttcactcttgttgcccaggctgaagtgcagtggtgccatctcggctcaccacaacctgtgccctccaggttcaagcaattctccggcctcagcctcccgagtagttgggactacaggtgcgcaccaccatgcccggctaattttgtattttttttttttttagtagagacaaggtttcttcatgttggtcaggctgatctcgaactcctgatctcgggtgatccacctgcctcagcctcccaaagtgctggaattacaggcgtgagccattgtgcctggccagggaattttatttattgtggtaaagtacacataacattaagtgtaccattttaaccattttaaagtataaaattcaatggcatttaatacactcacagtattttgtaaacaccatcactctctagttccagaggtaggtgaatttttacatgaatgtattcacctgcatgattaccacctagattaaaaactagaattttccatcactctggaaggttctctcttgccacttttccaatgattaccacacctacctaaaagagaacttctcttctgacttctctcaccgtggaacacttttgcttgaacttgggagaggacccatatataaataaaatcaacattttatgtctgtcatctttcactcaacctaacctctgtgaaattcatccgtatttgttgcgtgagattcagtagttcttttttgccactgagtcgtattccatttatatgcatctgtcacatttggcttatctcttctgttgataggtatttgggttattttcagtgtttttgctattatgaataaagctgccatgaaaagcacctacacattgccttgtggacatgtacacccatttctcttgtgtgaattcctaggaccataggttagggattttttaaaaaacttattttagattaaaaaaaatattttttgagacagtctcactctgtcacccaggctggagtgcagtggcatgatctcagctcattgcgacctgtgcctcccaggttcaagtgattctcctgcttcagcctcccaagtagctgggattacaggcatgcgccactacacctagctaatttttgtatttttagtagagacaggtttctcttcaactcctgagttcaagcagtctgcccaccttggcctcccaaaatgctgggattataaatgcgagccaccacgcccagccaggttacagatgtttaactttgattctttacctctgaagtcaaataaacctgggtgtgaattcttttgtcctgccacttgcttgcttgactttgagcaatttacctttttctcatgttcagttttctcagttgtaaaataggcctaccctatcagtcatggttcagtcaagaagacatgtcattctagctatttcaaggagaaggggattcaatacagagtattagttgccttcaggacaaagaaaaggcgagatgcgcaaaaaatggaagcccaccgctggctttctgatttgccgcaaaaaaagttagaaagctgctgccacccagagaagactcagaaggtcttgcttgaccttccaccttctcagcatctccagccttgaggctggtgaaagggcagggaatctggacatgctgtaaagctcatgtctgaggaatccaacttttgcctgctactgctgctgtctgtaggaagaagaaaaacaaatggcttctgctttccttcatccttccaaatctcaaacacgtgtacctcgctggtagaaccctgttggcaagagagatgggggatctctggtagaaacagaaactcagtgccagcaaagaagaaatggcatagatgccacctggggttgctttgaggtgctcagtaaatggcagtggttataatttattattttcatcattcctcaagaactgctgctgcagttcagactgatttctctctctctctcttcttttttttttttttttttgagacgggcttgctctgtcacccaggctggagtgcagtggtgccgtcacagctcactgcagcctcgacttccctggctcaagtgatcctctcacctcagcctccgattagctgtaaccacgggcatgcgccaccatacctggctaatttttaaatattttgtagagatgaggtctgtctatgttgcccaggtgggccttgaactcctgggctcaggcgatcctcctacctcggcctcccgaagtgctaggattataggcgtgagtcaccacgcttgggcagcagactgatttcttttttttttttttttgagacagagtcttgctgtgttgcccaggctggaatgcagtggtgcaatctcagcttactgcgacctctgcctcccggattcaagcaattctcctgcctcagcctcccgagtagctgggattacaggtgggtgccaccacacccggctaatttttgtatttttagtagaggcagggtttcaccatgttggccaggctggtctcgaactcctgacctcaggtgatctgcctgccttggcctcccaaagtgctgggattataggcgtgagccaccgtgtccgacccagactgatttctgtaacggatgttcattcttttcactttatagtcacatggatgccactgtaagagctccgtgtcacataaggtgttgtttttctggaagggccttccagattctgtatctattgctctgtgattctaggtacttttctaaaggtataagcttgagaaattagttttcaagtctgtaagttaatgtagagctgaaaggtgacttaattctaagagttgctgctttaatgtataattttatggaacctaatgagtgttttctttttaaagtcattccactttattattaataaaataaaaggtaatatataaatctggctgatagatggggttacttttttccctgtctttagcttcctttgtgttctgataaatgagatggaagatttttatcatattttgtacctcaaatctctcgcggagggaacactgtagtctaccaaaacagctggcagaagtgtctgtcctattataagtttattttatgaaacatgagctataatgtagtcctttttttttttttttctttttttggagacggagtctcggttgcgcctggctaattttttgtattttttagtagagatggggtttcaccgtgttagccaggatggcctcgatctcctgacctcatgatccgcctgccttggcctcccaaagtgctgggattacaggtgtgagccgccgcgcccggccaatgtagtggttttaagacatttaaaaatcttgaaccaatgttggcaacagcctgtctgtaatgatgtcacatgtggaaagaaccgagtttttcttaactttagaatgtgaattttttcctccttcaaatactttttcctataacccagacctattttactttccagggaccctactattactgccctaaggtaatttgctagaaatggagtggtcaagatgtattgattaacgttttaggcatacttctgtagtactacttccgaaggctccttgcagagaaatttgaagtgataaggaaggcaaatattcgaaatggaaagataagtataaccagtgactatttcagccactggtttagcagttcaagtgagctggctgtttgtaaagcttgcttagtaaatgaatgtgctagaaatatattgacagaatttggttttatctctttttctccagacttttagtcggccagggctaacaatggatgtccaaacagtttacagtggctgatacacaatgcacaaagggcttcactgtttggagactggaaaatagagccagaggggagcttcttatgggcattgacctaattcactccttttggcaaaaatgcttggttttaaatcaatgtatgtatttctgacccaaatatctataaatatttcagctagtagtgttacagctggaggaagggacccgtggtgttgcttcgtgtattttgatttgacaatattctttagaaataaattgtcaagtgaactaatattacacaaaagttagggaaagttaagagaggcagctgaaattccatcagtttcctccttagtccctggaacctccccacaatcaggaatttgttagtcacctggtttttaaagataaatttctctgtgggcgtttctgctgagaaatgtggggaaacaggactgggctaaaaataaaattagttcaggcattgctaaacttctaagtatcatgtttgtgatgtacttttccaggaaacataaattggcaatatttttgctcctttttactaccacagaaagaatatttgcagtcagcatgcacggcctgaaagaatctctctcgcctattaatagaacagaaggaacatacacatgtctatgtgggggaaaaacatctcatttggcttagtagtaagctccaaataacaattgcattgttgttctgaattgtctttgagtgtgattggatgattaaatataaatgttgacctgattggattatatcacagcaatgaactgtcctgaaaaaacagctgtaacataccactccagactgttaccagacttagtcggctggctttatatttgtgttgtcaaaactgggatgctgtcatttctgtttctctgtctctttcgtctgttccaatttgagatatactgactatgttagtgtagtctgctacatggatagtcctttatctttcagcaacataagcaacataagctttttgactgagacgagcgtaatcaaaaggaatgctgggaaacagtgaactgtaaaaaatgtcctcaattagatacaggcttcagtgcatgggtttatcctttcagaagatcggtgtgttttcagtgagggtctaaacccactggcctggattccacctcttgttggatgggtggtcagttttaacattagggggtgttgattgtgagctcttgagagcagggctggttctttgcattcctaggtaggcatgatgtagagtagttgctcagtaaataggggaaggtgaaaggaagagaagggagaaggtgagtctcaaaagactggaatgtgataagcacacgtttatcacactgggggtgtattctctcccttttcttagagtattccttgcctcctgaaaaaagcactttgcaggaaatatggagatcttctgaacctgtggctttgtgttattggactgagaagtccaaaatgtgcattagcggagcttatagaactgctctgagaatgtgttcttgagttctacaaatattatggggtgcgttgggggctggctcactccagctcagttcccatgtgttaagtggaacttctgatctgttgaatgcctaaccatgacggagcccaggagacaaagtaaggtgtggtttgttttgctgtaagaccacgtttggttagcttttctctagcaaagctggggaaggagatcacagggctgatgtggtggtaggcccttggtgtagatctcactgacttttcccagtcaactaggagtaaatgttaaccctattttataggtgggaaacggaggctcagaaacattaagtaaattgcccagtgtcacacggcttgtgtgacagggaggggatttgagccaaggtccatttgatgaatttgaaacctgtagattctgtcaattccaccagtctctgctttttagaatcacagtggcaagaaaataggagaagctcaaggccctgtgttgattattaggagtttaaacatcatcgctgaaagtgcatagaaatatttgtattcctagagaatcttaagtaaaagtaacatatcaatgttgtcaagagatgtcttcattcatcagagacctctgtgtgttcattactgtatgagaccccaaagactctaagttgcctctaagacacagccttacagggaggtattaagtgattatgtatacagctagctaaaaccacaactttattatagaaatattaagaatatgtcttatcatgtgagagtattctttcttcaagtccatagcctccagttagaaatggctgtgttgtcccatcaaccccttcactcaaaaactatcattaatatcaggaaaaacttatggttacaaactcctgggttatagaattggaaggaaaaacttagatatgctgtgtttgggagcttgccttgaggattggaattccattgcaagttaccttggggtcaaagtacatcccctaaaacatcaaatacctccaagaggttttaggctatcagacagccacactttaatgtggagtagactagtcagctttcttctactatctaactgacaccatacacattgttaaagagataattttgattgggaatgaagatagggaattttgaagccagaacattctggtgatggagcagatactgccgagatgttggcctcgggacagcctggaggaggaggacactgataaacagagcaaccagcccaaggggtggaaagacctaggaagtctccacatacaaattttgcttctttcctgtttctccactgaaccctgggaagggtgcttatttctctcctcactgtctttccccaggacccagaattgataggttagttgagtttctgtgggcagtctaaggtagtgttactatttaaaatgttagtaacattttcagattcactgagattcttgctgagtgtggtggcatatgcctgtggtcccaactacttggagactgaggcaggcaggaggatcgcttgagcccaggagttggaggctacagtgagttctgattgtcctgtgaataggaatagccactgcagtccagcctgagcaccacagtggagactccactttttttttttttttaagtttaaaaaagttaaaaaaaaaaaaagacaaagaaaaaggaaagttgatttttggttctaactcagttgtgacaaacggtggatatatggttctgaccacattctaaattggacttgatggtgggcaagggaaacttccaatgcctatcccctcactttaaaaaaacttctcctgggccaggcacggtggctcatgcctgtaatcccagcactttgggaggccgaggtggacggatcatgaggtcaggagatcgagatcatcctggctaacacggtgaaaccccgtctgtactaaaaatacaaaaagaaattagccgggtatggtggtggacgcctgtagtcccagctacttgggaggctgaggcaggagaatggcatgaacctgggaggtggagtttgcagtgagccaagatggcgccactgcactccagcctgggcaacagagcgagactctgtctcaaaaaacaaacaaacaaacaaacttctcctgtagcagtttgctttgagttgtgggtgccacctccctcactgtctttttctgagggtacataaataaattgcatcctagcttgagatcaggagcaatggtttttagttctctgtgtccaacacaattcttctacacagtgtcttgcccaatacatgtgttggtaatactgacaaacatagttaatcttcttctttgaagattatctgaagcaagattttgaccttaggtcagcttcccctgaagtatgtgattggaaactgaacgagttcagattttagtttaggtaaaaatataaccagagaagttgctaccaagcatagttgactttgagctgacctaacttttggattatgtactcactaagaacttacctcttattaattaaacaaatacaaggaaataaataacccaataaaaacactcaaaacaagtttatccccaaatagtgtacttgatgctaaggacagacctaaagtttgttgaggatagaaatgaaaaatgaggcaaaagaaaccaggaattgagatgtgtgtgtgcctgtaccagcacccgtgtgagccccttgcaggtaacgacccatggtccctgcacatcagtcttctgttactaagttttgcataaattgagtctggtggttggcaagctacatatagccagctgcgtgtttgttgttttttctgcctgctagctaagaactgttcttgcattttaaatggttatgtaagtatctatatgatctccgtgattttgcctcttgtagtggcaagcctaaaatatttattgtcaggccctttgagaaaatgtttcctggctcctgcctcagacctcctggaagcagggtgttggcttgatttgtctcctgttctgcaatctgggaatagtagatcaggatgctgacttgtgggaagatgctggctgcatgagatgcccctgtctgcagtcactcatagcttggaaaagcaaaaaggaaaaagggttggatctgagcactgacagacaggtttgcttctggtttcaatgtagtaaggtgacctgataacaagggccacttgagaagttgcaaatgcagatttcctccgtgttaggtggtgaccaataaaagcatattttgtttttaggatgtagaaaggctataaaactgcaatgtctttgtatcatcaaacatttctgtgtttctgatgtttcagatgttcctatttctctggattgcaggatttcaactttgcaacatgtactgttgtgtttctgagttgttgactatttcagttccaaacagttcgttatttcctgtcagaggaaacttcagagtaacaataaagtgctggtgtggcttcaaaggcttggagaaatgaaaagcagtggagaaattttgtgaggttcctttggcttagaaggttcagaaaggctttgagcgaatgaatgtatgtatcagtcactgttactccaggtccgttagctgtttccagacctttctgtgtcctaaaaacaaacatcattttgagggtggggactgtgtcctatgttgacaggtctttgttttcaaagtctgatgtacaatagagactaaacgttcaatgactgaatgcagttcatttttaaaatttttttttttttgagacagagtctcactctgttgcccaggctggagtgcagtggcatgatctcagctcattgcaacctccacctcccaggttcaagcgattttcctgcctcagtctcctgactacctgggattataggcacgtaccaccacgcctggctaatttttgtatatttagtagagacagggtttttgccttgttagccaggctggtctcgaactcctaacctcaggtgatccacctgcctctgtctcccaaagtgctgggattacaggcgtgagccaccatgcccagccgtatgttttaaatcttatattaagcttataccactgttgattgccgttgctacagtggggcttatattaatattagaaacacccctcatttgagtggtactttacagtttatagcaacctctacataaagctgggcatggtggcacatgcctgtaattccagctgcttgggagactgaggcaggaggattgctccagcccagaagtttaagaccagcatgggcaacatagcaagaacttgtatcaaaaaaagaaaaaaaaaactttcatgttaaattctcacttgatcctcaccaagaaccctgtgaggtgagtgttattcactggatgcttagagaacctagagatcatacagctggctagtgcgtaccaggaacttgaactacttataaactggagcagtcggagaaagcttggtgtgtttgacattgtctgtctcttggtctccaggccccaagaggaagcaaaagcctaattcatcttggcaaatgctgtagaagttcttgcttggattttctttcgctagacagtttttggtggtggtttgttgctctccttcagataaacatttcttgatagtgcagtttcttccttcaatatgttcttattctggtgtgtacatccgtttctcagaat

SEQ ID NO: 131 - DNA, 65115 bp, Homo sapiens
gtatgctcgtagacatctggactgctctgttgcacaagttcctaggatgtccatgggatggcagtgggtctggaaatccaccaggcgtgatctggaagaagggaaatttctgtctttcttttttttttttttttgagatgatgtctcactctctcttgcccaggctggagtgcagtagctcaatcttggctcactgcaacctctgcctcccaggttcaaacaattctcctgcctcagcctcccgagtagctgggactacagtcacgtgccaccacacctggctaattctgtatttttagtagagacggggtttcaccatgtcggccaggctggtctcaaactcctgacctcaggtgatccacctgccttggcctctcaaagtgctgggattacaggtatgagccactgcactcggccagaaaaatttcaagtcactcttgagggtccagcctgcagccttctccctcattcccccttagcttggcatgcccattgtcgtgccaaatcctcctctgccttcagagcctggcccagagcctttcctctgtgaagtgtgcccctgtaacagttaaatgtaccattccttggaacccatagcatttcactctgagtttgggctccacgatccctacttatgagatctcagatagcttctttaacctcagtttcctcaactataaaatagagatgacagcagcactacctcgtggatttttgtgaggatgaagtaagagaatgcataagccaggcatagcggctcacgcctgtaatcccagctacttgggaggctgaggtgggagaatcagttgagctcaggggttggagactaccctgagcaacacagcaagaccctgtctcagaacgaaagaaagaaaaaaaaagaaagagaaagagagacagagagaagagaaggagaaaagagagaagagaagagaaggaaggaaggagagagagaggaaggaaggaaggagaaaaagagaggaaggaagaaaggaaagaagtaaggagagaagaagagaaagagagaggaaggaaagaaggaaggaaggagggagggaaggaaggaaggaaagaaggatcgatttaccttattggggttcttgtgaggtttagatgagttaatatatgttaagtacttaaaacagtatctagccctagtaagtatttagttattcagtaaatgttagtattatgattattaagagccctgactataagatagtttacagatgaggaaagtggtagtctcagaagttaagtaacttgccgaaggttacaaagaactaagtaggagaaccaagttgcaaaccaaggttattgtcaacaaatgtcacttgaatgaatgatagcttcaattttgtaagtgttttgtcctgagaagacacaggaaagccagatcagaatttcaaatttcctgaagagaatatttatcaaatctatcaaataccttaccaatctcccatgtcctttgatctggcaatggtactagtagcagcacatcctaagtaataactacattagtgcacaaagattaaagagtaagagttgggcaagcatggtggttcatgcctataatcccagcactttgggaggctgaagtgggctgatcacttgagctcaggagttcaacactggcctggccaacatggcaaaaccccatctctactaaaaatacaaaaattagctgggcactgtggtgtgcacttatagtcccaacatactcaggaggctgaggctggagaatcgcttgaacccaggagatagaggttgcagtaagccgagatcacaacactgccctccagcctgggtaacagagcaagactctgtctcaaaaaaaaaaaaaaaagaagaagaagaagaagaaaaaaaccaatctggctgggcacggtggctcacacctgtaataccagtactttaggaggccaaggtgggcagatcaactgaggccaggagttcgagactagcctggccaacacagcgaaatcccatctctactgaaaatacaaaaaaaattagctgggcgtggtggcaggcgcctgtaatcccagctacttgggaggctgaggggggagtatcccttgaaaccaggaggcggaggctgcagtgagccgagatcgcaccactgcactccagcctgggtgacaaaacaagactccgtcttaaaaaaaaaaaaaaatcgctgggcacggtggcttatgcctgttatcctagcactttgggaggctgaggcgggcggatcacgaggttaggagatggagatcatcctggctaacacggtgaaaccccgtctctactaaaaatacaaaaatttagccgggcctggtggcacatgcctgtagtcccagctacttgggaggctgaggcaggagaatcacttgaacctgggaggcagaggttgcagtgagccgagactgcgccactgcactccagcctggatgacagagagagactccatctcaaaaaaaacaaacaaaaaaaaacaaacaaaaaaaaaaacaaaacaaaaacctaaatatctagcaatagaggaatggttaaattaagtgtagggcatccatacatggaatataatgcaggcatttaaaaatcaagttcttggctgggtgtggtggctcacacctgtaatcctagcactttgggaggccaaagcaggtggatcacagggtcaggagttcgagaccagcctggccaacatagtgaaaccccatctctaccaaaaataaagaaattagctgggcatggtggcacaagcctgtagtcctagctactcgagagactgaggcagaagaatcgcttgaacctggcagacagtggttgcagtgagccaagatcgtgtcactgcactccagcctgggtgacagaaggggactctgtctcaaaaaaaaaaaaaaaagttcttaaaggacagtaagtaaaaaaataagcactaccatttattgagcacttactcttcaccggtactctacaccactctacataaattatgtaatttaactctcaccagaatcccatgaggtctgcattattatcccagtttttacaggggactaaacggaaccttaggtttagtgatggagtttttaggttaagtgctgtgctcaagatcgcagagacccagggtttaaattcaaacccgtctgacttcagatcctgtcttaccactactccacaccacctccacagaaaaatgctcatgagacatgtgccgtaagagaaaaaaagtaagacacaaatacattctcagaatgtctacttttgttatctggatagaaaatgactggaaggaaatgcttcccaaagtatgatagattatcttcaggtgatagaatttttaatgattttttaaaatacatttttatatttcctgaggttttacagcaaagaaaaaaaagacatatattctttttgagaaaagactttcacaaaatatccaaggtagctacttcgtgaagcagccagtgggtccacggttccctgggagggtcagaccctgctcagcacaggaacgtggccaggaaggagtggcgtgtgcctcatccctgcccaccctgtcctcccaaactacacacctgcaaagcgggtcggagaagcagaggcgccgcagctccaggcagttgggggccacaggcggcagcgcgcagttgggggcgatggtgttgcgccggcgctccccgcagccccggtcgttgggggcacatgggcacagtagcaggccctgcgcgtggggctcggcggccttctcgaagaaagtgagcagctgcctgaggcagacgtggcgctggcagtggggcccggagcacgcctccccgtaggccttgcgcagccggtcacacttgtcattgagagtacacagcatggcaaacttgaggcagaggtctgagtctggggggaaagggcacggagtcagtcggctgggccctctgcacgcctgcaccccaggttccacaggaaccccggaaacccctgatttgacaagaaggtagtggatataggaggaaaagaaggcctgtcatgaataaacccactcctaatccagggcttcccctctccccacaaactctacctgctgttttgaagccttccccaccctactcctctttttttttttttttttttttttttttttttgagacggagttttgctcttgttggccaagccgaagtgcaatggcgtgatctcggctcactgcaacctccgcctcctgggttcaagcaattctcctgcctcagcctcccgagtagctgggattacacgcatgcgccacgacgcccggctaattttttgtatttttagtagaaatggggtttcatcatgttagccaggctggtcttgaactcccgacctcaggtaatccgcccatctcggcctcccaaagtgctgggattacaggcatgaaccgccgcgcccggcacaactcctcatcttgactacgtaaaataataagaataatcactatcatcatctatatgcatcgaacacccatttatctagaattcaagcagccagaaagcttaaataaccatacctctttcctcagtgctatgctgtgagatctgatggtagaaatgataacctagagtacctgcaacattctaaagcactttcagaactgtccaaaacagatgcatccaaattctattttaggtttctggtttggttttggcttcgtctgcacctatcctgttccattttaatgtcacctgcccatctttcattaattgattcatgtatactctgttccccatactctgaatcttgggaaattatggtgatatttctattaacagaatattccagcagccacagcaatcaagtaattgcaacaggttatttgctgatcttgtcacttagagtttttcatgcatgaaactctatgcctttttctcaaaattctaattctaatgataaagctcacatctttctcaaaaagagagtgcatgtgtgtatgtttttcctcaattaactcatagcctcactttcctgaaaaacatgcaacacagtccttgccagactgatggctccccaccctgagtcaccccgtgcagagtcacactctcttttcctgcccaatacctcgcccatcccattagaatggttgaaaacaagcaatttcctagtcttcagggacaaaaaggctactttcccagctgccttgaatgcaagtaaatactgcatttcagcacaatttttcctggggctgctgccactcccaccacgccctttgcaggggctcgccttgtggaaacagggagccctaatgggctctcttcaaatgcctccctaataactgctgtcctttggagacccctgtgagaccagatcatgccccagagctcacacttccagcctgacacagtcttccttagtcacctggtaggctagaaacatttcccttataagctccccaacttctgcccctccccagccacccttcctccagggtccagccccagcctctggttcccgagcctagttgccctccacacctggtttgagcatgttcagtttgctgagattcattttccagggtttgctggtcactgtgtcttcatagggggagacatccagctcatagttacctagagacaaggtggggagcaccagaatgctgaggaccagggtggggtaggctggaggggctgaagctgctggctcagacctcaaaggcctgtggagaaaaggaaaagcacagcctctacctaaccagctgcaagctgtgcaaagatgagaaaaatgcagggccgtaaggtataggctgggctccaccaataagccataagaataataagagctaccatttgttaagcacactgtgtgctgagcaccatgctataagtgaggtaaataaatatgctgagcaccatcgcacttacgcgatggtgctcagcacacagtgtagggaggcaagaggattcagggagaagcctctgaggaagttcggaaagagaagtgattaggatgaggagtagaaaacagggagcaaggagtgtggtaaactgtattattgtttccaattatttgttccccaccccttgggaggattatacgtccccacctgttgccatgtaactttcacaccccctgtgagaggcgtacacttcctcaccccactgatggcaggcttggccaggtgacttgctctggtctgtggattgtgagctgaagtgatgtaaatcacatctgagcagaagctttaagaatcttcacatggttctgctgctactctttctcctctaccagcctggatcttccagtgaagaagacaagtagaacagagacaaggccaactcatagaagcctccagcagatgtgtaacatgagcaagaaatacatttttgttgttgaaagccagagatttgggaattggttgttgcaatagcataacctagcaaattcttactaaaaatgcaatggggtgccgggcacggtggctcacacctgtaatcctagcactttgggaggcctaggcgggtagatcacctgaggtcaggagttcgagaccagcctggccaacatggtgaaaccccatctctactaaaaatacaaaaattagttgggcatggtggcgcatgcctgtaatcccagctacctgggaggctgaggtgggagaatcacttgaacccgggaggcggaggctgcagtgagccaagatcatgccactgcactccagcctgggcgacagtgagtctccatctgaaaaaaaaaaaatgcaactgggaggctgaggcaggaatattccttgaacctaggaacttgagaccagcctggagaacacagcaggacttcatctctacaaaaaatttagctgggtccggtggcacacacatatagtcccagctactcgagaggctgaggtgggaggatcacttgagcccaggaggttgaggctgcagtgagctatgactgtgccactgcactccagcctgggtgacaagtgagactccaactaaaaaaaacagcaaaaataaaatgcaattggtacctagaagtggagcgctacagtaataaaataatataatgtgtgtcattggctttggtactgggcaatgggtggtaaggaagctgttactgggggctggaaagatggcagtcttcattatgcagtggcaaagcatctggtaaaattgttgtgtgtgataactgggaagattatatgctgaatgagtttgtactgttaggggaagctgagaagcagaagtttactagtatgtcttgattgctattggctgcatttggcaaggtactacaagatataagctcagaaaagaattggccagttcccaaatgtggaggaaaagataatctagaaatttcaggacttccaggattaagaaatgcaactgtgctgggcgcagtggctcatgcctgtaatcccggcattttgggaggccgaggcaggcagatcacgaggtcaggagttcaagaccagcctgaccaacatggtgaaaccccctctctactaaaaatacaaaaattagccaggcatggtggcaggggcctgtaatcccagctactcaggaggctgaggcaggagaatcgcttgaacccgggaggcagaggttgcagtgagccaatatcacgccactgcactccagccagggcaacagaggaagactctgtctcaaaaaaaaaaaaaaaaaaaaaaaagaagaagaagaagaaatgccactgtttcttgtattcataaggtaaaagataaaacataaaaaaaaatgctttgagtgataaggttgattacaactcagccttggggaaaagaccaaatgaggtatgtggctatcacactgtttgtggatatctctcagtcgattaagatggtacccaataagtcctgccagttggacaaatgtactcagggaaaaaagactaaagtagtggctcttccacagaagcctgataagggctaggtgcttctaattaggtgtagaaaaagaggcatgtcttgaattgtgggaaaggccacaggcacatgagatgatagaaatcaaagatataagcagcaattatgttttcagagagttgtactacaaagagctaccagtgtagattaaaagagactgtgactatttgagacttaaaatgccccaacatttctcaggcaggaagcaggctgagaatgcggctcagtcctcagggagaatgtagtccctaatacccttttcaaatgtggccaaagagaaaactgaaagaggaaggacctttccagagggctgggccaagagctctggaaaacaatggatagggcaactactcccgtggagtaaaaacagggccttattaaagaacaatccctattcccagggaagaggacccttacaacatttgtctagcaggatttcagaattgctatgaatcaatgtctgctgtgtgtctcccattcattcattcatttatttatttgagacagggtcttgctctgtcacccaggctggagtgcagtggtgtgatcatggctcactgcagcctcaacctcctggactcaagtgatcctcccacctcagcctcccgagtagctgggaccacaggtgtgcaccaccacactcagctaatttatttatttttttgtagtgatgggagctcgctatgttgtccaggctggtcttgaactcctgggctttagggatactcccgccttggcctcccaagttgctgaagttacaggtgtgagccaccacacttagatgcccattcctcccctttctgagaatgtttgttgtggttatcctgaccctgttccgttattatatgctgagtacgtataggaagcagatgacttgtctttttagttcataagtttttagattaagaggagccacatccagacccaatttggaaactatcatgagatcctagacttgaagcctgatgtcatgtttgtttgtttgtttgtttgctttttgcttgtttttttcgagacagagtctcgctctgtcgcccaggctagagtgcagtggcgcaatctcgactcactgcaacctctgcttcccgggttcaagtgattctcctgcctcagcttcccaagtagcctgggattacaggtgcccaccaccatgcccagctaattttttgtatttttagtagagatgaggtttcaccatgttggccaggctggtcttgaactcctgaactcaagtgatccgcctgccttggcctcccaaagtgctaggattacaggtgtgagccaccacacccggcttgatgtcaggtttgaacagagcttttagggcatcttccatggaaaataggtgggtatattttacttgcagaagggagagaaatgaatactttgacaatggtagattgtattattgtttccaatcattctttgccttccctgtaagattgtatatcctcacttattgccatgtgatttttggtatctccctgtggaagaagtataattctcaatccagtgatgtcaggcttagccatgtgacttgctctctcaatgaaatgtaagcagacgtagtgtatataagatttgagcagaaactttaaaaatcatcatgtggttctgccaatgctcatttccttctgccacgagaagggaacatcccagacagaggctgcaccttgagcctggatcccagaatgaagaaggcccatgaaagagccaatacagaacatgagcaagaattaaacctttgttttgcaagtcactgttttgttacagcaacatagtccggtaaaagctgactaataaggggcctatggaaagagtgacaagcagctcctctttggctctttctgtgccttctctctcttacatctcctggctggttaatgagtattctttctgttaaaggctggaccaagatgttacctccccatctctctgaacttggtatttggagcctgtttatgggttaagacttttttctcccatctcctgtccatacccgctgttccaggaactccccaggttgggcctcagcctggttcacagctctgctaagtgggaactgacatgttgccaggtaagaaagggggaagtagggagaagagagggcagtgttatggggccccaaggagatcccagcactatccctccacctttcctgatgtcaaatgcagagcttcattatcctcctcctcagattctaccatgtggcccatatcctgcaggattaaaaaacaacccccaagagccatcttccccagcttagtccactctataatgggagcctcaccaaggctgcgggcacggtgaacggtccaatagatgtccaagcaggcaacctggttcttcatgcgccggtggcacatgcagcctatcagagagctgttcctgagttgctgtgctgcctccaggcagtcagcagggaccgaaggctcctctgagggcagtggggtgcttatgctagaggtgcaggaatccaggtggtggtaggcagcactgcaggtgggatcagcctggcacttcctcctggcctggagacagctgttcatgagtcggctttctgtgggaagggggtctcctgtaaagggagataccaggtgaggctacgtaagattagaatagctgtctgggaataccaagtcatgaggttgggagagggatattcctgatgaaactttgtgaaagtcttagggtagcacaaaaggcctttaagaataagtgtggagagagagagaagcccagcaggactggatagtctgcagctgccacagtcgggacagaacagaccaggcccaacaagaaataggggtttgcagagaggctgctcagccttcagggaggtgaagggaatagttgtttgaaggcgagcctgatgaccctgacaggcacagaggaaggggtccccaggcagagccatgccatgggcagggctagtatcagaaccagagagttgagaatggacaagggagtgctaaatgggagtcagcaataactttgagtctcccattaaaaatcatttaaaaatacctgaaggtggaaactggctggggttggggtagagagctaattccaaaaggaaagaaagggtaacctgaccctgtctcttactcagaaataccaagattcctccacagcccggaaggaagcccctgcatcctaggatttagggtgctcaacatggggtaatagaacatcatcatctcactagctgttcaaagataaaaatctaggagaactttttttttttttttttttttttttttgagacagagtttcgctcttgttacccaggttggagtgcaatggcgtgatcttggctcaacgcaacctccgcctcccgggttcaagcgattctcctgcctcagcctcccgtgtagctgggattacaggcgtgcgccatcacacgcccagctaattttatatttttagtagagacggggtttctccatattggtcaggctggtctcaaactcctgacctcgggtaatccgcccaccttagcctcccaaagtgctgggattacaggcgtgagccaccgcgccttaattcatctctttctttcacagcctgtgttcaattcagcaagtcctgtcaactccataacacatctggaatctgcccacttttctccatgtgtgtcactacctccttagatcaagccaccatcaactcttctccttcttccctcttctttcttccttctccttctcttctccttctccttcttctcctttttcttttttagatagggtcttgctctatctcccaggctggagtgcagtggcacgatcacagctcactgcagccttgacctcctgggttcaagctatcctacctacctcagcctcctgagtagttgggactacaggcacatgccaccacatctggttaatttttgtatttttagtagagatgggttttcatcacgttggccagactagtcttgaacttctgacctcagatgatctgcctgccttggcctcccgaagtgctgggattacaggcatgagccaccacacccagccagtacctcattgttctttatggatgactaatatttcattatatcgatatgctacattttgtttatgcattcttcagttaatggacacttgggttgcttccaccttttggttattgtgaatagcgctttgatgaacatttcatgtacaagtatttgtttgaacacctgttttttgttctttgggatacatacctagggatggaattgctgggtcatacggtaattctatgtttaactttttgaggaaccgccaaattgtttttcacagcagctgtaccattttacattcccatcagcaatgtacaaggagtctagtttctatacatactgccaactcctgttattttccattaaaaaaaattataaccatccttgtgagcatgaagtggtatctcattgaggctttcatttgcatttccctaatgactaaggatgttgagcatatttttatgtgcttgttagccatttgtacatcttccttggaaataaagtttttgttgaggtgtaacacagaaaagtacatgaatcaaaaatgtatagctcaatgaatttcacaaattgaatacacttgtgtagccagaatccagataaaggaatagaacattatcagtaaccctgaagccctcttccagtcactgtgctcccaagtaaaccagtatcttcatttctttttctttctttcttttcttttcttttcttttctttttttttgagtcagagtcaggctggagtgcagtgatacaatctcagctcactgcaaccttgcaacctctgcctcctgggctcaagcgattctcctgcctcagcctcccgagtagctgggactacaggcacccgccacaatgctcagctaatttttgtacttttagtagagaaagggtttcaccatgttgcccaggctggtcttgaactcctaacctcaagtgatccacccaccttggccttccaaagtgctaggattacaagtgtgagccactgcgcccagcctgtcttcatttcttttacttgtcttctggtttgttgaagcaataggtcagacgtttgccaaaataatgtctgtcagagtggctggccataaacacttcagcaccacattcatctgaagggtactcctgacgaaggtgactatttttgctattctcatccaccttatggtattttaggacagccagcttcaccttttttcttttatgctttttttttttttttttttttgagaccaggtcttgctctgttgcccaggttggagtgcagtggcatgacctcagctctctgcaatctccgcctcctgggttcaagtgattgacctgcctcagccacccaagtagctgggattacaggcatgcgccaccacaccgagctgggttttgtaattttagtagagaggtagtttcaccatgttggccaggctggtctcgaactcctggcctcatgcgatccatctgccttggcctcccaaagtgctgggattacaggcatgagctacagtgcctggcctattctttttgggagtagtttaagacttcttccttttcttagggccaccacgaagtctcaacacaagaagggtggactccttttgaatgttgtagtcagacaaagcacatccgtcttccagttgcttgccagcaaagatcagtctttactcgtcagaaggaattccttccttatcttggatgttggcttttacatttccttgtatccaagggttcaacctcaagactgatggctttctccataaaggttgttatgaaaatctgcattttggtggtggctccactgcagatggtggatcgaaaaggcagtatctttgtctctaacatcagggattagttttgccccagtacagccaactgatcttggcaacaaagcaaacgaaaacataaagtggggaaagaacagccttttcaacaaacggtgctgggataattggctacccacatgtaggagaatgaaactgggtcctcatctctcaccttatacaaaaatcaactcaagatggattaagaacttaaatctggccaccacgcctgtaatctcagcactttgggaggccaaggcgggtggattacctgaggtcaggagttcgagactagcctgatcagcatggtgaaaccctgtctctactgaaaatacaaaaattagctgggtgtgatggcgggcgcctgtaatcccagctactcaggaggctgaggcaggagaatcgcttgaacccaggaggcagagtatgcagtgagcagagactgtgccactgcactccagcctgggcagcagggtgagactccatctgaaaaaaaaaaaaaaaaagaaatctaagaactgaaactataaaaattatagaagataacattggaaaaatccttctagaccttgacttacgcaaagatttcatgaccaaaacccaaaagcaaatgcaaaaaaaaaaaaaaaaagataaatagctggtacttaattaaactaaagagcttttgcacagcaaaaggaacagtcagcagagtaaacagacaacccacagagtgggagaaaattttcactatctatacatctgacaaaggactaatattcagaatctacaacaaattcaaacaaatcagcaagaaaaaaacaaacagttggctgggcgcagtggctcatgcccgtaattgcagcactttgggaggccgaggtgggcagatcacaaggtcaggagattgagaccatcctgactaacacgatgaaaccccatctctattaaaaatacagaaaattagccaggtgtggaggcgagcgcctgtagtcccagctactcaggatggtggtgagctcctgtagtcccagctactcgggaggctgaggcaggagaatggtgtgaacctgggaggcggagcttgcagtgagccaagatcatgccactgcactccagcctgggtgacagagcaagactccatctcaaaaaaaaaaaaaaagaaaaagaaaaaaacaaacaatcccatcaaaaagtgggctaaggacatgaatagacaattctcaaaagaagatacacaaatagccaacatatgaaaaattgctcaacatcactcatgatcagtaaaatgcaaatcaaaaccacaatgtgataccaacttactacttcaagaatggccataatcaaaaaatcaaaaaacagtagatgttggcatggatgcggtgatcagggaacacttctacactgctggtgggaatgtaaactagtacagccactgaggaaaacagtctggagattccttaaagagctaaaagtagtctgggcgtggtggctcaccccgtaatcccagcactttgggaggctgaggtgggcagatcacctgaggtcaggagttcaagaccagcctggccaacactgcaaaagcccgtctctactaaaaatacaaaaattagccaggtgtggaggcgggcacctgttatcccagctactcgagaggctgaggctggagaatcacttgaacccaggaggcggaggtttcagtgagccgagatcaagccattgcactgaagcctggggcacaagagcgaaactctgtctgaaaaaaaaaaaaacaaaaaacaacaagccagacgcagtggctcaaacctgtaatcccagcactttgggaagccgaggtaggcagatcatgaggtcaagagattgagaccatcctggccaacatggtgaaaccccatctccactacaaatacaaaaaattagctgggcgtggtggcgtgtgcctatagtcccagctactgaggaggctgaggcaggagaatcgcttgaacctgggaggcggaggttgcagtgagccgagatcatgccattgcactccagcctggtggtgacacagcaagactccatctcaaaaaaaaaaaaaaaaaaaagtagaactaccatttgatccagcagtcccactactgagtgtctacccagaggaaaagaagtcattataccaaaaagatacttgcacactcatgtttatagcagcacaatttgcaattgcagaatcatggaaccaacccaaatgcccatcaatcaacgaatggaacagaaattgtgatagaatagaatactactcagccataaaaaggaatgaattggccaggcatggtggctcacgccggtaatcccagcactttgagaggctgagacagtcggatcacaaggtcaggagatcaagaccatcctggctaaaacagtgaaaccccgtctccactaaaaatacaaaaaaaaaaaaaaaaaaaaagttagccaggtgtgctggcaggcacctgtacagctactcggaggctgaggcaggagaatggcgcgaacccgggaggcggagcttgcagtgagccgagatcacgccactgcactccagcccgggcgacagagccagactccgtctcaaaaaaaaaaaaaaaaggaatgaattaacagcatttgcagcaacctagatgagattggagactattattctaagtgaagtaactcaggaatggaaaaccaaacatcgtatattctcactgatatgtgggagctaagctatgaggatacaaaggcataagaatgatacaatggacttggggacttggggggaagcgtgggggaggggaagggataaaagactacaaatagggtgcagtatatacttcttgggtgatgggtacaccaaaatctcataaatcagcactaaagaacttacttatgtaaccaaacaccacctgtatgtaccccaataacctatggaaaagaaaaagtatatcagaatttctctaggaaatatgtatttccaaaaagcatatttgataattttacatgtacaagatgaaaaaaaaagcttttgagatttcaaaaagtatttaaggaaggtatgagattttatatatttaccaaaaggggaacatggatttaaaaagattgaggaatttctacaagtttacgatgttacttccggtaggtactgaataagtggtaagtacacaaagaaaagtggcagattcaagttctattgttgtaactggactaaaaataattttttttttttgaggtggagttttgctcttgttacccaggctggagtgcagtggcgcgatctcggctcactgcaacctctgcctcccgggttcaagcgattctcctgcctcagcctcccaactagctgggattacaggtatgccccaccatgcctggctaattttgtatttttagtagagatgcgatttctcgatgttggtcaggctgatcttgaactcccgacctcaggtgatctgcccgcctcggcctcaacaaagtgctgggattacaggcatgagccactgtgcccggccataaatatttaactgtactaactattgagttgtaaacattttcaaaagaaaacaatttcttagttgacactttaccaagtttgagcagtgatggatttaggggcattcatctcaacaaagaacttgggggccacgttaaatttcatctcaacaaggtggaacctgtgtttcctggattgtgaaacacaggacttgatccagggcaaaggtcataatttgatccagtgtgcaaatgtgtcttttttagtcagcatagttccgttcctttctttttctttctcctttctccttttcttttctttcttttaatctctgtcacccagactggagtgcagtggtacaatcgccactcactgcagcctacagtctcgacctcccaggctcaggtgaattctcccacctcagcctcccaagtagctgggactgcatgcatgcactaccacgcccagctaattttgtattttttgtagagatgggttttcaccatgttgcccgggctggtctcgaactcttgagctcaagcaatccacccaccttggcctcccaaaatgctgggattataggcgtgagccaccattcccggcagtattttcttttctgttttttttttttttttttttttgtgtgtgtgtgtgtgtgtgtgtgtgtgtgtggtttggttgttttatttgtttgtttggttggttttttttgcacgttcacagtattttctttttcttttttttttttttgagacggagtctcgctctgtcacccaggctggagtgcagtggcgcgatctcagctcactgcaagctccacctcccaggttcacgccattctcctgcctcagcctcccgggtagttgggactacaggcgcccaccagcatgcctggctaattttttctattttttagtagcgacggggattcactgtgttagccaggatggtctcaatctcctgacctcgtgatctacccgtctcagcctcccaaagtgctgggattacaggtgtgagccactgcacccagccagtattttcttaaagttgtaattagtggccaacatttaaaaatcagattttaggccgggtgcggtggcgcacacctttaattgcagcactttgggaggccaaggtgggcagactgtttgagcccaggattcaagatcagcctgggcatccgagatggcaaaaacccgtctctacaaaaaatacaaaaattaaccaggtgtggtggcacactactacagtcccagctactggggaggctgaggcagaaggattacttgagtatgggaggttgaggctgcagtgaactggaatcacaccactgaactccagcctgggtgacagattgataccctgtctcaaaaaaaaaatcagatttcaaataaaactattaatttccaatttgtcttgaaaaatggaaacactcgggcccacatgtaacgggtggagtaatgactgcccccttttgacaagtcatgccttttccagcttgttatagtccataccactttctattacttgccccacctcctcatttatacagccactgccacgtctatttcatattgatttgttagcaacctggttttgtaactttgttttctgcttcttggctcatcagagaatgagtagctacagaatgggtcagatcaggctatgcctcagggcacaagatcctcatttgtttctcatcagtgaggcccacaacccaggtatccattttatagttggatgaacaaagaaaagtaatgtgcaccaggggatgtagcaagtcaagaccgagtcaaggctagaacccaggactccagcctcctatccacttcagaatgattttcagtacatgacaccacttccccatgaatcggaggtctcctatatgcttggctttagcaggccctgagcaatgatattttccacccccaaagccctctgttggtctgtgctcttgaagagcacttggctctacatggtacctcctagatgactgttttatggattttcaatgaggctacttaaccagatgtcattgctgtcaagtattactgtggaaaatagatctgtcaccaacactgcttcattaaaccatttaatgagaaaggtgtttaatgttttcccctgatcctgacatgcagccataacctttaggattagtgaaatttcctgggcagtcaaatcagactggtgatgtcttgctgccctgacttactgatgttggcaggtggacagaccagggtttttcctccttccttccatatctgtctcaaggcagcatttctacagcactgcgttgtggactgaggtctcagggcagtgtggtggtctctctgtctcaggagtccctccattcagtctctgggcaggagccgcataataagattccacacacccataccactcacgaaggccatgggccttccagggatctcggatcccaggctgttcttccttgggggagtggcctggttctaaaaccaggccttgaactacatctacaaaacatctattgtggattatttattatccaaggggcaagccactgtgctagacggcttgcaaggcctgctattgtagaaggttatgaaacaagtcagttttaacgaacttctttttcttcacctgtacctagtttcttcctcagtccttaaagcagatggaagagttaaagcccacgtggagcaaatgacactctgtttctgatctgattctccccgcctcttagagacgctgtcttggtagtgacctggctgtgggttgttctgtgactgtgtagacctacctcaaaagagggaagaggggggaaaaaggggcgaggaggagatgcttgggtggccaggccattgctggcactcagtctatctcagttcgtacactgtgttaggtgtgaccccagccccttgcaggcaccctgggcttcctgctccagttccccttgttcggctcggatgcaccgggaggctgctgcgccctctccggacaggtgccccgggcctcgcctacacctcacctccccctcccactgtacccccggccggtgcgcgctctgacactcaccggctgcgagaggcagcggcgacggcggcagcagcagcagcaacatcaggactacgggcggcagcggtcgcgggttcagggggcgcaccatggcgagctgtaggcgccgggctccgcgctcccctcgctcctcccctggagctctgagagcggggctccctcgaccggcacctcccgcccccgcctcccgccctccagcgcgacgcacacactctcccaccagggtcctgggcgccgccctccaactccgaagcgcgcgtccacaccacgcgcctccagcgctggtccgagggaccgcgggggtgggggcgggggagggccggcgccccgggagccgccgggcttggtgcggaagaggttgctctttccgaggcggcccacctgctgtctgacaagttcgactagcaagacattgtggaagctgccgctggaaactcgccatctaggagaaccaaatatttctccaagaaaagcaccctttctcactttctggatcccactcacccacacatcaaagaacagacaccaccacaaaagagattttgtaacaaaacttgaacaagccaacacaagggcacttgcatttctagtatttttcttagaatttgcacatctatgatctcgttttttcctctcctaagtgtcttctagggtaagattgggtggttattaagctcaagatgctgcaaagatgggtcgcagacaggtggaatggctttgctgggggagcagacctggggcattagattccaaaattcagccccgatggtgtcgtgagggaagatggaagattaaactctccactaaatagcagagatttccttggaccaaagctcactgaggaaggtgcctggagagaccatttaggagcccatccttttcacatgatgagactttcggagagcaagctactctatcaggattaaacaactaggtagaaacacatctgtgcccagaacacaggacgtctacccataaggataagggtatttattgggcctgggcctgattcccacaagatcccaggataaagccagaagcagaatggcttggaagaatgagaactaagcagcgcatagaaagagagaaggagaagagggtgatgaaaggaagtggagggtttcatcccctaaccctctaacttgaccccctccttacttccacagccagcctggcagagggccagcagggagtactgagaatcgcaatataaacctctgagatttattggctgctgcttctgaatatggccatcctgctgtggcctctggggggcatttgccgatgtaatcagcccagaaagagagtcattccagctgggggtgtaaatcacccttggcaaagctaggagagagacatgtggccctagataaggaaggagactgatgtggcctctgtgcccttccctcccttctcctgcccagggggtgctggttcctgagctgtaatgcactttaaatggagtttgtccttcgttttaatctatatctgccctgccagttttacagaagagctgtaaaagtgaacatctggctactcagcttttgtacaaggcctgttttcccccagctccaccctatctccatgtgcctttcccaagccctcctctccagaaaggtgagggaacatgaagctggggggctaccattaaaggccccatgatgtcaggccctctaccccattgccagagagaaatatgctccaggcacctcattttctctcacacctgctattacaggcagacaatcgttttttgggtttttttttttgaaactgacaatacttaagaaaggaatttataaagcaaaatgtaacaatttcaggctctttgggatgataggaaagggctgagacccatgaaccaacaaagatgtgaggtggtcaaggggtgtctcctctgccctccccctcctccagcccaagccaaatcatgttatgggcaggaagagggtttgggaaaggaagtttgctcagggtgcctactctgatagatactcagtgtctattccagggctgtccccacagaatagaccaagaatgcagtatcaagctgacgggctgggagcaatgaccaatcccacctgtaacaggccagccttttcatgagagaaaataaagtgtctggtgcatatttctgtctgggtacaggggtggagagcctcatatcattgggcctttaatgaggattggagaagctctgcaaataaatatgactccaagactaatattgacagccctccagcacaccctctccaccaaccatgtcctctgtgactgccaacacctgctagataagcagcattgccccttgtggacaatgacaaatgagccagtcctttctacagagatgatgttactcatccatcattcaattcaataatgtgttttgagaatgattatgagcccagctttatgctaggtgcaaaatgattaagacacaaatcctgctcggggagggtgttacaatccactgattgcaactcaaatgcccaaagaccctgtatcttattccactttcacttgtaatctcaattttctcctcttatggtcagattacatggattctaccttctctcaagtcctctctctctccattgagctttaattcctgctgctatcctaatccaggatgttagcagtataataaatagttaagaccacaagctttacagactgcctagattcaaatgccgacactagctggatgaccttgggcaagtcacttaatttttctgtgcttccatttcttcacctgtaaaattaaggataatagtatctatttcacattgtgaggattaaatgagtatagtatttaaatgaaggtgtaggctgggcgcggtggctcacgcctgtaatcccagcactttgggaggccaaggtgggcggatcacgaggtcaggagttcaagaccagcctggccaatatgatgaaaccccatctctactaaaattacaaagattagccgggcatggtggcacatgcctgtattcccagctactcgggaggctcagtggggcagaagaattgcttgaacccaggaggcggaggttgcagtgagccaagatcatgctattgcactccagcctgggcagtagagcgagactccgactcaaaaaaaaaaaaagaaaagaaaaaaaaaggtgtagcattatacctggcatatagcaagcatcgaataaatatcatcccaggtagcatgcaggagttaattattctgtgtgtgaacttggccagaccccaccacccgacctgctgatttggagctggaagtggcactttttgctccttttgctgaatatactactagaccagagtgcttgtagggatggaaacaaaaagagccattttttatttttctaccttgtcaatttcttgagggcagggactgtgtcatattttaacaactgtgatactcagaattggcaactccagatgcatatgtttaaaggaattggtgtttccttaacctatgcctgaacagaacagggagagaatcccccatgcctcctactttatactcctgataaagaaagggaaatattcctccttaatatagtttggatatttgtccccacccaaatctcatgatgaaatgtaatccctaatgttggaggtggggcctggtggaggtgtctggatcatgggggtggatccttcatgaatggcttgggccattctcttggggataagtgagctgtcactgagttcacaagagatccagtcatttaaaagtgtgtggcacctcctcccataactccctccctctcttgctcctgctctggatatgtgacatgtctgcttctccttcaccttctgacatgattgtaagcttccagaggcctacccaggagctgagcagatgccaacaccatgcttcccataaagcctgcagaaccatgagctaattaagcttcttttccttataaattgttcagtctcccaggcaagcatggtggtcagccaggcatggtggtgtcggcctgtagtcccagctacttgggaggctaaggcagaggttgcagtgagccaagatcatgccaccacactatagcctgggtgacacagtgagaccctgtctccaaaaaaaaaaaaaagccgggcgcggtggctcacgcctgtaatcccagcactttgggaggccgagatgggcggatcatgaggtcaggagattgagaccatcctggctaacacggtgaaaccccatctctactaaaaatgaaaaaaaaaaattagcctgacgtggtggcgggcacctgtagtcccagctactcgggaggctgaggcaggagaatggcatgaacccaggaggcagagcttgcagtgagctgagatcatgccactgcactccagcaggggtgacagagcaagactctgtctcaaaaaaaaaaaaaattacccagtctcaggtattttttttctttttctttcttcctttttttttttttttttttgagacagggtctcactctactgcccaggctggagcacagtggtgcaatcatggctcaccacagcctcaacttcacatgctctagtgatcctcccacttcagcctctcaagtaggtgggactacaggtgcacaccaccacacctggctaatttttaaaaattattcgtagaaggccagacgcagtggctcatgcctgtaatcccagcactttgagaagccaaggcaggtggatcacctgaggtcaggagtttgggactagcttgaccaacatggtgaaaccctgtctctattaaaaatacaaaaaaattagccaggcatggtggcaggcgcctgtaatcccagctacttgggaggctgagacaggagaatcacttgaacccgggaggcggaggttgcagtaagccaagattgtgccattgcactccagcctgggcaacaagagcaaaactccattttttttttttgagacggagtttcgctcttgttgcccaggctggagtgcaacggcgcgatctcggctcactgcaacctccgcctcccagctctcaggttcaagtgattctcctgtctcagcctcccaggtagctgggattacaggcacatgccaccatgcccggctaatttttgtatttttagtagagatggggtttcatcatattggtcaggctggtctcgaactcctgacctcaggtgagccgcccgccttggcctcccaaagtgctgggattacaggcgtgagccaccgcacccagcgaaactccatcttaaaaaaaaaaaattcttcgtaaagacagggtttcaccatgttgcccagatggtctcaaactcctaggctcaagtgatcctccagcctcagtttcccagtgttaggattacagggtatttctttatagcaaaggaagaatggcttaatacattcccttctctatggcagaggtcacccaggtcctgggctgagattgacaagaagcaattgcaaaaaaaaaatttatgtatattttttgagacagagtctccctctgtcacttaggttggagtgcagtggtgcaatctcagctcactgcaacctccacctcccgggttcaagcaatcctcccacctcagcctcctgagtagctgggactacagacatgcaccactgcacctggctaattcttaaattttctgtagagacagaggtctgactatattgcccaggctggtctcaaactcctggattcaagcaatcctcccacctcagcctcccaaagtactgggattataggcttaagccaccgcacctagcccaagaagcaggtttttgtttgtttttgatacagagtcttgctgttgtcacccaggctggagtgcaatggtgtgatcttagctcactgcaacctccacctcccaggttcaagtgattctcctgcctcagcctcctggtagctggaattacaggtgcctgccactactcctggctaattttttttttttttttttttgagacagagtctccgtcaccaggctggagtgcagtggcccaatcttggctcactgcaacctccacttcctgggttcaagcacttctcctgcctcagcctcccgagtagctgggtatttttaataaagacggggtttcaccatgttggccaggatggtctcgatctcctgacctcgtgatctgcccaccttggcctcccaaagtgctgggattacaggtgtgagccatcatgcctggcctgtttgtatttttagtagagatggggtttcaccacattggccaggctcctctcaaactcttgacctcaggtgatccaccctcctcaggctcccaaagtgttgggattataggcatgagccacagcgcccagcctcgagaagcagtttttagctcaaaacatttctgttcaatatttctttacctcctgatgaataaataccagtgcaaggacaccaatgccgagcacaccccctacatagcctcatactgaggtctctgggctggggttttagtgcctgctcatatccttatctctcaagccaaagcaacccttatggccctaaattctcaagagcttaccattgaggctcttatagatttaacacccaatacagggccaactctggaaaggcacagtggttttttttttttagacagggtcttgctgtcatccaggctagagtatagtggatggatcatagttcaatgcaacctcaacctcctgggctgaagccatcctcctgcctgaccctccccagtagctatgactacaagtgtgcaccaccatgcccagctaagttgatttttattctatagagatggggtcttgctatgttgcccaggctggtcttaaactcctggtctcaagggatcctcccactttggcctcttaaagtgctaggattacagatgtgagtcactgcacctggccaggcacactgttctttgatgaaggtttggtaacagcaaaatccatgaagtggacaggctctggagccatactgtcttgggtcaaatccctactccaccattaattagctttgagatcttattacttgactaggtgcagtggctcacgcctgtaatctcagcactttgggaggctccaattgaagactagagctcagattgcctccatgaaagttagaagggagagggctgggtgcggtggctcacaactgtaatcccagcactttgggaggctgaggccgatggatcatgaggccaggagttcgagaccagcctggccaacatggtgaaaccccttctctactaaagatacaaaaaattagccgggcatggtggtacatgccagtagtcccagctactcaggaggctgaggcagaatcgcttgaacctgggaggcagaggttgcagtgagccgagatcgcgccactacactccaggttgttaacagagcgagactgtgtctccaaaaaaaaaaaaaaaattcaaattagaaaaaaaaatgcaggccaggcgcggtggctcacgcctgtaatcccagcactttgggaggccgaggtgggcggatcatgaggtcaggagatcaagaccatcctggctaacatggtgaaaccccgtcttaactaaaaaataaaaaaaaaattagccgggcatggtggtgggtgcctgtagtcccagctactcgggaggctgaggcaggagaatggtgtgaacccaggaggcggagcttacagtgagccgagttcacgccactgcactccagcctgggcgacagagtgagactccgtctcaaaaaaaaaaaaaaaaaaaaagaaaagaaaaaaatacaaaaattatccaggtgtggtggcagatgcctgtagtcccagctacttgggaagctgaggtgagaggattgcttgagcctaggaggtggaagtttcagtgagctgagattgtaccactgcactccagcctgggcaacaagtgagaccctgtctcaaaaaaaaataaaataaaataaaaaagagttaatccctctgttcctcaatttctttatcttcataaagaaatgctcataataatgaatacctctttcacaggcttgtgaaaattaaattagtgtgtatttatataggagtttatatatatatatatatatatatatatatatatatatatatatgagtttagagatagccttgtatacagtaagcacctgaaaaatgttagctactattgttattcctgaaaataacatgaatcaaatcatatagtccctatacaatgagaggatattacaagaaatcagtgggcttatattaggccaggcgtggtggctcacgcctgtaatcccagcactttgggaggccgatgtgggtggatcacgaggtcaggagttcaagactagcctgaccaacatggtgaaaccctgtctctactaaaaatacaaaaattagccaggcgtggtggtgcatgcctgtaatcccagctactcgggaggctgaggcaggagaattgcttgaacccgggaggtggaggttgcagtgagctgagatcgcgccactgcacttcagcctggtgacagagcaagactctgtctcaaataaaataaaataaaataaaaaataccaaaaaatgttgacttgggtgaaaatacaattttccatgaggaagataattaagccttagtgttttgttttgcaactcagattttccacttaagactactgactagtgggcacatgtacatcaatctctatctatgttgggacttggttctagccttctggggagaattatcaggaaatggaaatgacccactagggtaggcagtgagttaaggacctctcctcacacttcgaagaggtgcttcaagcagttttcttttctggctactaggaattcctataggggcacgtgtgtgggtggggcagaggagcagcatctttcctttggccatctccacctaacgtagcagcagcttttctctttcccctagaccttctgggctttgagttcaagggattagggagaaggccacagagacagcttcctttttgacagacaggcagtagctaggaatggaagctacagacttcagcaggatggcttggagaaaacagcagtgccctctgctgtgaagcatgcatgtgacactctagggcaagagcatgtgcaaaccttgtcaaataaaaaaattaaaagccagtccaaccactcaggcacgtgcatgggccgccctatggctacaaccccccttccctcccactcactttaaaaaagtgtctctgttccagagcctgggaagagggtatgtttgtctctgttctgtctcagcctaggctgtagagggcttcgtcctgttccgtcctgggctatcagtcctactaggttaataccagagaatgacaatgttcagtcagttctactgccacccaagaccaagtagtgccacaccttactacagataaaggcctattcatattaaaaagctccaagaaaggaaaccctggcatactgcagaagagtacagttaaaaaatcttcctgaagtctaatggatcttgctttgttttattcctatcttcatatatcacaaatctctacttccaaccatcctaaatcctaaaacttgtctttgtgagacgtgaaatggagtggagaaaagacttaaaagtcaaaacccccctaaggctatagatagggaactttttttttttttttttgagatggagtcttgctttgacacccaggccggagtgcagtgaaaaatcttgttcactgcaacatctgcctcccaagttgaagtgattatcctgcctcagtctcccgaatagctgggattacaggcagccaccacgatgcctggctaatttttgtatttttagtatagacgaggttttgccatgttagccagggtggtcttgaactcctgacctcaggtgttccgccagcctcagcctcccaaagtgctgggattacaggtgtgagccactgccaagagggaacctttgagcccagctgagatctgtcatttgccttagagaatgtctagataccacatgctgctgagtctgtggtgcacttttagtaacgcataccatggaatgatctaggaaaggaaagcccaggacattgctgaagaaaactgtttgaaaggcttaccttaattccagagcattggttcattttttttttgagatggagtcttactctgttgcccaggctagagtgcagtggattttggctcactgcaacctccacctcctgagttcatgcaattctcctgcctcagccaccctagtagctgggattacaggtgtgtgccaccatgcctggttaatttttgtattttttttagtagagatggggtttcaccatgttggtcaggctggtctcgaacttctgacgtcaagtgatctgcctgccttggcctcccaaagtgctgggattactgagcactggttcttaagccttaccatgtattagaattaactgaaaagggagatttttaaaacccagatttctgtgccctaacctcacaagttctgatttaagaggtctggggtgaggcctgaacatctgtatttcaaacaagttcagatgatgttgatgatctagggtccaaactttgagaattactggttgtttggtatttgttttttgagacagtctctctctgttgcccaggctggagtgcggtggcacgatctcattgcaaccttcacctcctgagttcaagcgattctcctgcatcagcttcctgagtagctgggactacaggcacacgccaccatgcctggctaatttttgtatttttagtagagatagggtctcaccatgttggcctcgaactcctgacctgaagtgatccacccgcctcggcctcccaaagtgccaggattacaggtgtgagccacggcctaagaattactggtttagagaaaagcatgttggcctcagctatgaataaagatagtatgtctgaagtagtctaacttggtgatctcctctgtagacagatcttctaggagcaggctaggctcacaatcacacctctcattctgtagtgtttatttttccatttttaaaaaagaaagagggggaaacaaagaaggaaaatacaaagaaagaaggtagacaacgctcttgcatagcccgaagcccagagagaaagagttggctggcttgtgagaagacatgaggagttgggaaaaggaatgccagagttccctgaaccaatacaaatctctatgcaactcaaggctgccttatagagccagctccaggactctgccaccagctttcagctctgctgaaacctaatccattcccaggcctggatacaagttggtagcctgttggtttgcagagacatcttttaataatcttgggtttggccatccagaaggcctctttctgctcagggtttctgcagtgtcttttggtgacttgttagcagccagtggctggaatgttatcatgggctcatgtccttcaccagaagggcaatctgctcccgcagctgccgctccccttcctgcactttgctctggcttcgacacctcagcaactcagtcttgtggtcctgatgatgcatagggcagtagctctgtggttcacacagttcctgaaaggtaaggaacagagtaagggattctctagactcctgaactctacctatgaaggataatagagatgctgctgctggcagtggctaaggaggagcagcagtttcttctctgaaggctttgcaggccctgggagttgagttgttaaagtttggctccccgcatgccccaccctttaccatatattctggaaagaagtctctgtagccgcctttaaggatatatagctctgggtagtacaatgcaggatactggttcagagacctgtcctcttcacgcagacagcggcacctttagagagaacccagagatgggtggggtggaaagaaacaaggtcaggatcccaggggccattcactggggaggggggagaggagtagactattgccaacctcaaaaaggactttccaatctccctgtgtttgcaaaaaaaggtccaagtagtaccacccttcctcctttcctccactgcagcctcattctcaatcccttttcctttattgtttcaaacttttcaattttagaaacgtcttccttcaacctccctaacattcttcaaactgtagaatccagtcagtctctgtctgaactggtgtgggaagtccaactcaaaatccatttccatcacccgccagaccccatttagacactcacattcgggggcccctctctgaggagaattcacagtggaacacgatgattattctcttctgggtgtccaaagggacgatgggcttcttcagaaagaagttaaacagttcttcctgactatataagtttaaggctccctgtagaagaagaattttagtaagtatttcctcaggggcttatagacagtgccaatacttagaaatgactgagacgccaacctgggataatgtggaccagaaaagctggactataagcacctttagggcaggggtctaagtatatctctgtatataccctgaacgcctggcatagagcttgtagatggtcaataaatgtttatagacctgaaccactggaagtatagagatcactgcgaggaatgttcatgaatagtaagtgtttgcaaagtgcttcagtccttggattaatgtttttatttctaggtaggaccccttggctcctacagaaaagagggagatagatctaggagggaaagggaaagtaacctgcttaaggtatacagaattaaaacaatgaggacctcagccttgaggtgcttcaaatatgtaatctttgtcctgactctagagttcatagacccctttgtccacagactcttctcaataaagagttatctccagccctcccctactaatggccacaatgtcgtctcacctggatgtgtcctcccagatactcatatggatagcgacaatcaatgacataaaacttctcaatcagaccctggaacttccccgacagtaaggcagccacctggacagaaacaatgactgaatattctgctcactgccactctgagggagagaagggtcaatgacacagttccttacaagcatactcctgttctgtccactgtatgtccagcctccaaagtcaccccatatttgatatgtggcaatgattcagccccactccacaaaagagaatgaaacaggaagtggcccttttagagaaccaaaatagctggcactgacaagataccaaggaaaaccatattcaggctacccatctggggataggcatggctggactcaggagatgcccaaggacttctgcagtggcagaggcagcagctagagagcttgaaattgcaggaagaaatgcaaaatggttccctacccaccatcaaaaaggaagaaagtaagtctttcaggaaaggatatggaagggaaaggttgatacctaaaggaaggaagaaactgaagctacttgtaggagtgcaaattggttcagcctttctgaagggaactttgtaaatacatatacaaataaatgtaatcacactttgactcagcaatttctaacatcttaagtaaacaggaaaagtacacaaagatgtaggcacaattatattcatctcagcattgttttatattatcaatatattagaaataacttcaatattcaataataggggtttggtaaaataaattgtacatgtcagtagaatagagcggcattatatagccattaaaatgataatatagataccttattgatatagaaagatgtctataatgtctcactaagcaaattgcaatactatacgttcatcatgatcctttttttttgttttttgagatggaatttcgcccttgttgcccaggctggagtacaatggtgccatcttggctcaccgcaacctctgcctcccgggttcaagcaattctcctgcctcagcctcccgagtagctgggattacaggcatgcgctaccacacccagctaattttatatttttagtagagacggggtttctccatgttggtcagactcgtctcgaactcccaacctcaggtgattcgcctgccttggcctctcaaagtgctgggattacaggtgtgagctgtgctaggcccatgatcccatttctataaaacatatgctagaataaaatctggggctgggcgcagtggctcacacctgtaatcccagcactttgggaggctgaggagggtggatcaccagaggacaggagtttgaaaccagcctgaccaacatagtaaaaccccgtctctactaaaaatacaaaaattagtcggtgtgatggctggcacctgtaatcccagctacttgggaggctgaggcaggagaatgacctccgggaggcagaggttgcagcaagccgagattgtgccattgcactccagcctgggcaacaagagcgaaactccatgtctaaaaataaaataaaatctggaaggccataggaaaatatgactagtggttatctctggtgatgagattgtgggtatggtgaccaaataatttttgtacaaactgggagacttttgagaatgaaagcaaacactattaataattaccctcactaatagatgaaaatgggattgtaaaatgtaaacgagggtgcatggtcaccctaattgagaccttaattgagaccatttcttgtgtgtgattttttattttcctttctttctcccttttttcttaagtaattattattttttgagacagtctcgctgtgtcgcccaggctggagtacagtggcacgatctctgctcactgcaacctccccaactggggttcaagcaattcttgtgcttcagcctcccaagtagctgggattataggcacacattaccacgcctggttaatttttttgtatttttattagagatggggtttcgccatgttggccagggtggtctcgaattccctgcctcaagtgcctgagatctgcctgcctcagcctcccaaaatgctaggatttcaggcgtgagccaccatgcctgacccctccctttttcccttttacaaaaactatgtatcatttgtttaactaaaaacgaaggagagagaagaatggggaaaaaaatgagtccttcaatataacttcagttgaataaggagcctgtgtgagtgaacacagtgaaagaaatacaaatggaaatgggcattttagggacagaagagaccagatggtagcttatgtaaccagttaccatctccagaaatctgcttactgtttctgggttgacatacttcagatcttggtgtttccctgacacggttggcagcgcacatacctagaaatacacaagagctgaaataacagcaagtattccacacccaagtttgagatcaaagacccttattttgtccttctttccaagtgacccttaaaaccccagaggccttcaaaaaaatcagtgtctctataaagtgcatatacatcaagtccatttctaagaactgatcctaaagaacaaatcaaggatgtgtacgaagttttagatttctctacaaatatattcatcttggtatcattcataagaaaaaattgtaaaaccaaatatcttacaagaagggatttatgaagaaattatgagcagccaaaaaaaaaaaaaaaagaaataatatggagctattaaaatgaaatgggctgggcatggtggctcatgcctgtaacctcagtgctttgggaagccaaggagagagaggatttcttgaggccaggagctcgaggctgaagtgagctatgatcatgccaatgtactccagcctgggcaacagatcaagaccttgaatcttaaaaaaagaaagaatgaagcataactgcttattaatatgaaaaaagatgcccctgatataattattaaatgagaggaaaaacaacagataacaaaacaatataaactgtttttgtagaaaagcaaaaactgtatttgtatatgtgtttgtgaaaacacagaaaaaaatctgtaagaatatgtaccttctgcaattacacagacagtaggggggaaaaaaagagtatatactaagcaatattaccctggttaataaagtttgggataaatttcttcattttctactttttctgtaacaaccaagtattatttacataattttaaaatatgtttttaaacagaaaaaaggtaaaaagtctcatactttcccctgttctggatcttcccagaagaataagaaatactttctctctggaaaggcttagggcctggatctaccactagagcactgtcaggttaccaaagagtacttggtgaggatgcatatttacaccaggcattctcggcaaacagagaagattcagatccaaaatgactcactgaaatacaggatgggtgtagccaaactcaccttggaaaaatcaccaatcaggtgcccctggttagaatcttcctccagcatctgagtgatagtaatgtcacacagagagactgtcttctttaaacataagccctgaagatgacaagattcccaccccacacccaatcctcatgttaaaggtttaaaaaccagtggatggagtgggccatggtggcgcacatctgtaatcctagctacatgggaggctgaggtagggagatcacttgagcccaggaggccaaggctatagtgagctacgattgcaccactgcactccagtctgggagacagagtgagactccatttgtttatttattatttttaataataaataaatattgaggctgcagtgagtcaagaccatgccactgcaatccagcctgggtgacagagtgagaccccatctcaggggaaaataaataaataaataaataagttgattttataaaatatccaaagattttagaattttaattttttattttatttttttttattagagatggggtcatgctatattgaccaggctggtcttgaacttctgaccttaagtgatcctcccatctatttaatttttttaaagttggggagggtaaaggacaaaggctaagtttttcagaagttgctttccacaaaaccaacctgctatatgatgttgtttctgtcagactgcatgtaaaacagcagtaaaatatccataccaaagttcccttgtattctttcagatcttaagaaaaagggttgggaagacggtatgatgacaacatttctctttttttttttttttttgagacggagtcttgctctgttgcccaggctggagtgcagtggcacaatcttggctcactgcaacctccacctcccgggttcaagcgattctcctgcctcagcctcctgagtagccgggactacaggcacatgctgccacgcccagctgatttcttgtattttagtagagacggggtttcaccgtgttgcccagtctggtcttgaactcctgagctcaggcaatccgcccgcctcggcctcccaaagtgctaggattataggcgtgagccactgcacccggcctatgacaacatttctaaaagtacaatatagatatactttatgtatctatgttatataaatattttatatatatatatatatttcacgtggatacagatgtagaaaagacagaaagatggaaagaacaaagaggaaaaagtaaaagtaaagaggaagaagacaaaaaaggcataataaaacaatcctcataccagaaaagcaaagacatgagatagaagatgaacaagattttcatcttaaaaagttcttaccttcctgagctttccttggccagaaaaatacttttttttaactttatctggtattgtgttgtccttgaatttttccacctgcttcagtcttggcctgttcaagttctctggcatcgacggggagcgatataggccacttctgctcacctgtttgggaatattaaaccccctagttcttactcctccaagtgtgtctgcagacctgcagcaacaacatctcctgggagcttctttgaaatgcaggtttccagatgttaggccacaccccaaacctactgaattaaaatctgcattttaacaagatgcccaggtgatttctcaagtttgagaagccttgggtaggcaacctgtcttcataggcccgttaatatctttctacctggactgcatgatattccatctccatggacgtcttaactagccaaaccaaattctgcagctgactgtcttagatgcaccagttcttctaacagaaagcaaacacaagctcagtccctccagttatgtgaccaaaaaaaaaaaaaaaaaaaaaaacataagtccattttgtctctgggatcctaggacattgacaatcaggatttaaggacctcaacaaacctaaagatgaaaagccaagaagaaaaatagcaaaagaagcatcatgcaagaaaaaaggacacactaaaatcaaatagcatgctgaccattataggatggatactatgaaacccatcagggaaaaaaaagtggctcaaacgtcatgaagaactagccttgagaattgcttacacaggaacagattaaagtataagaggatagactgttgtttatttgaaaggcatggtttgggtgctatattcagagttgagggtctatcaaatgacctctgataacaccttccaactaatccacaattctatcctctgttgccacatactttgagatctctacctctcacctagagaacaggcaaaagctccttctctaaacacttatcgcactacctgttatggactgatttaggaggggggctatacaataagagagccataactggaaggcagcttgatgatcaatggtttctggaagaacgaaataagaataacaacattttgctttatgacagctatggatattatgttgtttatcacacacatggtcctacctcttgttcgtgataccagctgatggtaccgtccacattatacgtacccttagactccttccaaacatcgccctatgtccccatccaccctaccccccagacactgatgactggaccatattgctggttgaacacatctatttagtggtctagaataagcaaaaataatctaggccaatcaggttccctctcttggttgcctaacttggaagatggagaaataattaggcagtagcagaagccaaagcccaaaaggaagaagccaagagatacagtcaaggccacgaagccagtgatgcatgaatggatcaaccaaaggtagggtaggaaaggagatatggtgaggcactgaggagtagggtgcctggtctccatgacagacaggacttcatataacttcaattttcccctgagaaggcaggggaaagctagatgaggatttcaaaaggggcttctctagaacacaccataataattatgctaagagccatattactaagagtttggaattaattagctaattgaaacttatctttttttttttttttttgagatagggtctcgctgtcactctggttggagtgcagtggcacaatcttagctcactgcaacctctgcctctcaggctcaagcgatcctcccaactcagcctcctgagtaactgggactacagatgcgcatcaccatgcccagccaatttctgtattttttatagagagagggttttaccatgttgtccaggctggtctcgaactcccgggcttaagtgatccatccgccttggcctaccaaagtgctgggtttacaggcatgagccaccacgcccagtctgtatccatttttaagcattgtatctaataaatttttgccaactcaaggtcacaaaaattgtctccgttttctttggatttttttttttttttttttgagacagagtctcactctgtcgcccaggctggggtgcaatggcatgatctcggctcattgcaacctccgcctcccaggttcaagtgattctccttgcctcagcctctggagtagctggcattacaggtgctgactaccatgcttggctaattttttttttttttttgagatggagtctagctctgtcacccaggctagagtgcagtggcacgatctcggctcattgcaacctctacctcccaggtttcagcaattctcctgcctcggcctcccgagtagctgggattacaggtgcctgccaccatgcccagctaacttttgtatttttagtagagacggggtttcaccgtgttggtcaggctggtgtcgaactcctgacctcgtgatccatccacctcagcctcccaaagttctgggattacaagtgtgagccaccgtgcccaaccactcagctaatttttttttttttttttttttttgagacagagtcttgctctgtcacccaggctggagtgcagtggcgcgacctcagcgcactgcaagctctgcctcccgggttcatgccattctcctccctcagcctcctgagtagctgggactacaggcgcccgccaccatgcccagctaattttttgtatttttagtagagatggggtttcaccatcttagccaggatggtctcgatcttctgacctcatgatctgcccgcctcggccctccaaagtgctgggattacaggcatgagccaccgcgcctggccccgctcagctaattttcctatttttagtagagatggggtttcaccatgttggtcaggctgatctcgaactcctgacctcaggtgatccaccagcctcggcctcccaaagtgctgggattacaggcatgagccactgtgccaggcctttcttcagatgctttatggtttaaggttttagatttggagctatgatccattttgtgttaattttaatatatgatgtacggtatgggttaaagtacttttatcttttaacgtatggatttccaattgctccagcacaatttgttaaaaagactgtactttctccatttgattattttgtatcttggctgaattaccagttacatatatgcataggtctatttctcaaatctctattcccttgtttcaatgttttaggtttctggtagctaatatagtgataattaaggtgattaacatctgcatatagtccaaggacaagatgtcaaaaataaatgatagcagaaaactactttcgcaaacagaaacagctacttcagcggccaggcatggtagctcacacctgtaatcccaacactttgagaggccaaggtgagtccaaatcgcttgagtccagtagttcaaaaccagcttgggcaacatggtgaaaccttgtctctacaaaaaatacaataattagccagatatggtagcgtgcacctgtagtcccagctacttgggaggctgaagtggaaggatcgattgagcccaggatgttgaggctgcagtgagctgtgatcatgccactgcattccagcctgggtgatagtgcaagatcctgtcttctcttaagaaaaaaaaaaaaaaggaaagagcaagctacttctttcctatacacttacatgaaaataaatgtcaactgattgcaaaggatataagtgctaggccatggagagataatgaagatggtactttagttctgtctagctagttagaagtttcccagttcccagaagctggtgtgggaagatcccaggatcatctggcttagatagcattcaacatctacccattttcaatctttaaggaatcaccagagagtttccaaatatgggagtttttaaacactgagaaagccaaaaagaagggaggaaaacttactagattcaacctgcagattctattaaaaggcttaattaaataattattattttataaactgaattgaataattattattttataaactggcctacacactcttgagtacacataagccagcccggcttctgtctgcaccactcttctgctcttgtcaaggctatcaacagccttcatgttgcagcatctgacagtcacttctctagccacattatctttctgaacctcatgtcggcttccgttaagttagctactccatttttgatggctttaatggcacctcctactcttttagttatttttatttatttatttatttatttttgagatggagtctccctctggaacccaggctggagtgcagtggcacgatctcagctcactgcaacctctacctcctgagttcaagcgattcccctgcctcagcctctcaagtagttgggattacaggcgtgcaccaccacccctggctaatttttgtatttgtattttatttttttgagacagagtctagctgtgttgcccagtttagagcgaaatggcgtgatctcagctcactgcaacctctgcctgctaggttcaaatgattctcctgtctcagcctcctgagtagctgggatcacaaacatgcgccatcatgcctggctaattttgtatttttattttattattattaattatttttttttttttttgagacagagtctcgctctttcacccaggccggaatgcagtggcgcgatctcggctccctgcaagctccgcctcccaggttcacgccattctcctgcctcggcccccagagtagctgggactacaggcgcccgccaccgcacacagctaattttttgtatttttagtagagacggggtttcaccgtgttagccaggatggtctcaaactcctgacctcgtgatctgcccgcctcggcctcccaaagtgctgggattacaggcgtgagccaccacgcccggccactttttttttttttttttttttttagacacagtctcgctctgtcacacagggtggagtgcagtggcacgatctcggctcactgcaagctctgcctcgcgggttcacgccattcttctgcctcagcctcccaagtagctgggactacaggcatccgccaccacgccaggctaatttttttgtatttttagtagagacggggtttcaccatgttagccaggatggtcttgatctcccgacctcgtgattcgcctgcctcggcctgccaaagtgctgggattacaggcgtgagccaccgcgcctggccattattattattttttaattttgtatttttagtagagacagggttcaactgtgttggccacactggtctcgaactcctgacctcaagtgatcggcccacctcggcctcccaaagtgctaggattataggcatgagccactgtgcccggcctagttctttatttctagtacaggcagcccctacactagaagaactatgatgcttctacctctgtgccctctcctctgctccttctcaattttctttgttaggcctccttacctatcaaacctctaatagatgctggattcatcagggccaggccctggcccttttctcttttatctcctccctctagccataggtaatttcttctacctgtgaatttaaattttcactctaagctaatgatttccaaatttctatctttagtcaagtcctctgctctgacttcagaacttccaaattcacatttggaagcttgatacgttttgagtacctactaggtgacatagcaatgaacaaaagagtaaaagaaacaaagaagtagactaataaatatactctgtactttttcacatagtgataaatggcataaatcaaaacaaagaaggatgaaaagaaaaacacaggggttgggaagtctgtcaggaaaggtccttataagacatatgcacagagactgaaatgaggaagaaaatcatgcattgccttggggaagaaagttctaggatgaaggaacaacaaatgcaatggccctgggtgagaataacaaggcagccagtgagacagccacatttagtatggtacctttttttttttttcttgagacagggtctcactctctcatccaggctggagtgcagtggcatgatcacagctcactgcaatctcgacatcccaggctcaagtgatccttccacctcagcctcccaagtagctggaactacaggcttgagccaccacaccttgcatttttttttttttttttcgtagagacaaggtctctctttgttgcccaggctggttgtgaactcctggggctcaaatgtcctcttgccttagcctcccaaagtgctgggattacagatgtgagccaccacacccagtgataccatttttagaaacctcaaaaactaatttaaacaatactataaaccaaccagacctaacagacacctagagaacactctacccaacaaccgtagaatacacattcttctccagtacacatggcacattctcacaatagacaatatgcctgaacataaaataagcctcgccaggcgcagtggctcaaacctgtaatcctagcactttgggaggctgaggcgggcagatcacaaggtcaagagatcgagaccatcctggccaacatggtgaaatcctgtctctactaaaaatacaaaaattagctgggggtggtggcacatgcctgtagtcccagctattcaggaggctgaggcaggagaatcgcttgaacctgggaggcggaagttgcagtgagcttaggtcgtgccactgcactccagcctggtgacagagtgagactccatctcaaaaataaaataaaataaaaataaaataaaataaaataagcctcaataaatttaaaaggattgaaatcacacaaaatatgttctctgaccacaatggaataaaattagaaatcagttaacagaaaaaatctggaaaattagcaaatttatgaaaattaaataggccaggtgtggtggctcacacctgtaatcccagcactttgggaggctgaggcgggcggatcacctggggttaggagttccagaccagcctggccatcatggtgaaaccccatctctactaaaaatacaaaaattagctgggtgtggtggcgggtgcctgtagtcccagctactcgggaggctgaggcaggagaattgcctgaacctgggaggcacaggttgcagtgagccaagatcgcaccactgcactccagcctaggttacagagggagactctgtctggaaaaaaaaaaaaaaaaaaaaggccaggcacagtggctcatgcctgtaattccagcactctgggaggctgaggcgggaggaccacttaaggtcaggagttcgagaccagcctggccaacagagtgaagccccatctctactaaaaatacaaaaattagccaggcgtggtagggtacgcctgtaatctcaactacttgggaggctgaggcaggagaattgcttgaacccagggggcagaggttgcagtgagccaagatcacaccactgccctccagcctgggggacagagcaagactccgtctcaaaaaaaaaaaaaaaaagaaagaaaagaaaaagaaaattaaataacacacttgttaataaccaatgggtcaatgaagaaatcataggaaaatcagaaaatactttgagatgaatgaaaactaagatacaacataccaaagcttatgggatacagctaaagtaatgcttagaaaaaaatttaaagctataaatgcctaaaataaaaaagaagatctcaaatcaattacctaaactcccacctaagaggaaactaaatccaaagcaagcagaaggaaggaaataaaaaagattagagcagaacttaagagaatagaaaaacaacagaaccaaaagttggttctttgaaaagatcagcaaaaatcgacaaacttttagcctgaacaattaaaaaaaagtctcaagttatcaaaatcaggaatggaaagtgggacattactaccaaccttacagaaataaaaaggatcatgaagaaatattagtgaataactgtgtgccaacaaatgagaccacttagatgaaatggactaattcctaacaagacaaaaactactgaaactagccaggtgtagtggtgtgcaccggtagtcttagcttctcaggaggcggaggtggaaggattgctggagcacacaggagttcaaggcgacatagtgaggcaccgccccaactccaattaacaaaacaaaacaaaagactgaaaccatgaccaggtaggatgtatcccagaaatgcaaggttgatataacatctgaaaatcagccaccgtatcccaccagatcaataaaataaatgacaaaaaccatatgattactcatctctgcacgttgtgaggctaagacgggtgggttgcttgagctcaggagtctaagaccagcctgggcaacatggtaaaacgctgtctctacaaaaatacaaaaattagctgggtacagtggtgcatgcctgtagtcccagctacttgggaggctgaggcaggaggattgtttgtgttcaggaggttgaggctgcagtgagccgtgattgtgctactgcagtccattctgggcaacagagtgagactctgtctcaaaaaaaaaaaattgatagattaatagacagaaaactaataagcatatagatgtgttcaacaatataaataaactggacctacttgacatacatagaatattctactcaagaatagagactatacattttctaagttgcactaaacatttaccaagatgttctgagtcatactctggaccataaaaaccaatcttaatgcacctaaaaggatttaagtcatataaaatatattcttgacaatcgaattaaattagaattcaataacagaaaggtcctcaaatatgaggtcctcaaaaagtcctcaaatatttgcaaataattaaataacaagcttctaagtaacccctacatcaaaaaagaaaccaaaaaaggaaattggaaagtattttgaactgaataaaactgaaaatgcaacatatcaaaatttgtgagatgcagctaaagtactaaatacccttatttaaaaaggtctcaaatcaatgaccttagcttcaaccttaactaaacatgaagatcaaattgaactcaaagtatccaaagattagagtgcaaaatcaatggaatagaaaacagaaaaacaatggagaaagtcaataaaaccaaaagatgattttttaaaaagatcaatattgataaatctctacccagacttatcaggaataagacagaggacacatataaccaatatcaggaatgagagacatcactatggattctacagacactaaaacgctaataaggaagtatttttaacaactttatgccactatatttgacaacctaattaaaatggacaaattccttcaaagacacaaactaccaaactcactcaaaaagaaacagttaaactgagtagttcctatctgtaaagtaagttgaatttgttaaaaacattcccacaaagaaaactctaggcccaggtggcttcaccggtgaatcgtgccaaacatctaaaagagaaataaaaccaattctatataaactcttccagaaaattgaaaaaaaaagagggaattatttgcaaatcatttcatgatgctagcattacactgataccaataccaaaacattaacatgaaaagctaaaacactgaagatcaatatctctcatgaacatagaggtacacaaaaaaaaaaaaaaattttttttttttttttcagatggagtctcgctctgtcacccaggctggagtgcagtggtgctatctcagctcactgcaacctctgcctcctgggttcaagcgtttctcctgcctcagtatcccaagtagctggaattacaggtgtgtgccactgcacctggctaatttttgtatttttagtacagatggggtctcaccatgtaggccaagctggcctcgagctcctgacctcaggtgatccacctgccttggcctcccaaagtgctgggaattacaggtgtgagtcactgtgcccggcctttttattgagacagagtctcgctctgtctcccaggatggactgcagtggcacgatctcagctcactgcaacctctgcctccctgattcaagcgattctcctgcctcagcctctcgagtagctggtactacaggtgtgtgccaccatgcccggctagtttttgtatttttttgtagagacgggggttccaccatgttggccaggctggtctcgatctcctgacctcgagtgatccacctgcctcagcctcccaaagtgctgggattacaggcatgagccaccgtgctcggccgatgtaaaaattatcaacaaaatgttagcaatgaaatccaacaacatataagaaggatcatatgtcacaaccaagtgaggttatcacaggattgcaaggttgtttaacattcaaaaacgtaggccaggcacagtggctcatacctgtaatcccagcactttgggaggccaaggcaggtggatcacctaaggtcgggagtttgagaccagactaaccaacatagagaaaccccgtctctactaaaaatacaaaattagcaaggcgtggtggcacatgcctgtaatcccagctactcgggaggctgaggcaggagaatcgcttgaacccaggaggcggaggttgtggtgagctgagattgcaccattgcactccagcctgagcaacaagagcgaaactccatctcaaaaaaaaaaagtaattcatcatattaacagattaaaaaaaaaactcacttgattatctcaatagatacagagaaaagggctgggtagggtaacttatgcctgtaatcccagcactttgggaggctgaggcagaggggttgcctgagcccaggagttcaagaccagcctggacaaaatggtgagatccccatctctataggggaaaaaaaaaaaaaagaactagccaggggtgactgtgtttgcctgtagtcccagctacttggggaggcataggcaagaggatctcttgagcccaggagtttgaggatgcagtgagctgtgattgtgccacgcactccagcctgggcaagagagtgagaccatgtctctttaaaaacaaaaacaaaaacaaaaaacctgttcctgctaaaatctcctggcaaactaggaaatagaagggaacttcctcaacctgatgatgggcttctcaagaaatgtatagctaacatcatactcaatgtataaaaagctgaatgcttttctctaagctcaggtgtaaggcaaggggttgtaagtaatttttaagattacaaaggagttctaagaccaaaaaatttgagaactcttattctagtagaagggaaaattggtaatataggagtggggaaatactgcagtagtacacatgaggagatgcttccatctgactcggtttttgcagtctttacaaatgcctacaaggccctacacgatctgtccttctgctaactcctctctgccctcattttctacccttctccacttgctccctccgcttcagccacactggccttcttgctgtcccataaacacgccaagcatactcacctcaggggcattgcacttgctttgccttctgctgggaatgactcattcctcctgacatctgcttgttggcttcctcgctctttcagatgtctgctcaaacgtcactctcaaataagtctcctctgacctatgcaacctatcaaaaataacaactctcaccctgccctactccaatccagggactccctataatctccctttgctttttcaccatagtatttttaccatctgccatattacaaatgtatttgtctgtctgtttcctcataactagaatgtaagctcagatactactgtatctctggcattagtgaataaatgaatgaatgaatgaataggacacagtgtgaaggaagggctttagataggagcagggacacttcgtgctctgtggcaagagcgactgcagattatatgggtataaaaggagattgattgctgtatctggtgagaaaagaaggcagttttcttctgatagcatctgttttctcttcacaacaaaacacttcaaactgcatatgactaaagtcatccttgatctcatccttccttcacagcctgcacccaacccttcaagtcctgttgattctctatccaaaatatatatatctatgtatctttttacttttttaatttttttgagacagggtcttgctctgttgcccaggctggagagcagtggtgtgatcgtggttcactgcagcctcaaacccctgggctcaagccatcctcccacctcagcctcctgagtagctgggactacaggcatacacaccatgcctggctttttttttttttttttttttttgtagagacatgttgctgaggcaggcagacaaaatatattttgaatgcatccatttctctgtctccatagtcaacaccttagttcaggctaccaccaactgtagctaggactaacacaatggctcctactcttacctgcttccaactctttttttttttttctcctttttgaggcagggtctccctttgttgcccaggctggaatgcagtggcacgatcatggctcactgcagccttgacctcctgggctcaagcaatcctactgtctctgcctcccaagtggctgggactacaggcatgcactaccacatgcaactaacatttttttatttttagtagtgatgaggttttgctatgttgcctagactggtctcaaactactgagctcaagcaactctcctgcctcagcctctcaaattgacaggattacaggtgaaagccaaaccacccgttgacttccaactcttaatcctttctaatctgttccccatccatcaacaagagtggtcttcacaaaacaaatcagaccatattattcccctgcctaaagccctcccttcagtagcaactcattgtacttagaatagaatccaaacactcaccatagcctaaagaccctgcgtgatctacctcctgactacttattctttcccagctcacataacactcctctcattcactgacttctcagtccctccaacatgtgaagaccttttccacctggggcctctgtacctgcaacattccttcttcatgaaatgctcctgcctctactcttgtcatatatgattccttcacaattagagtggccctaacttaataccagcttgtccgggactttcccagctttagcaatggaagccccatatcctagaacattctagtcccaggcaaacagagagttcatcacccgattcttaaccaaatatctcccacttgtggagatcttcccttattattctccatttaaagatttccttttgttagcctctatttcagacctcattttgtttccatcattacacttggactatttgcaattactaaattattattattattattagaaatggggtcttgctctgtcacccaggctggattgcccaggcatgatcatggctcactgtagccttgaactgctagactcaaacagtcctcccacctcagcctctggagtagctaggactacaggggcacaccaccatgcctggctaatttttatttttttgtagcgatgggggcttactgtgttgcctaggctggtctcaaacttgtcgactcaaactatccttctgcctcagactcccaaaatgttgggattacaagtgtgagccaccacacccagcccaaaatctaaattattttgtctgttatggcagacatttacaatttggctgcctaacatactgtttcagtaaaatctaaagttagagaggcagtcctgcctcctcatgaggtggccaatgggagacagatattcccttttccatgcccttgtgaccaactagatattcctgcctgggattttcaaccttaaagaagctcaaaaagcaaagggttggtccagactttttatggtggctgcatcacagtagagaatatactaggtggtagcaaatatccatgagcagcacagtctatctagcagcaagcctgatcatgttccatggcagggtgccagtaacggtggcattgagtgtctagccagcaagtggtggcatcctgagctcaatgttcctggaatagtattttggctgggccttactttgttttccagccttccttgtaattctgagttcctcagtaccctccagaaaaatcccttttctgcttgaggaaactagaatcagtttctattatttgcaaccaagaactctaactagaatatctattaacttgaaaaaaatttttgttgttttgatgcatccctgacaagaatataaattctagtctgttttgttcaccatcgtatcaccagtgcctagcacacttcccaacatgtagcaagtactcaataaatattttttaagtaaagaaatgaatgaaaaatcactaaggttacgacaatctccaaggaggtcactgctttatacaagtatctatttatttccgtttattattattattattattatattttgagacagggtctcactctgtcacccaggcaggagtgcagtggcgcaatctcggctccctgcaacctccacctcccgggttcaagcaattctcctgcctcagcctcccaagtagctgagattacaggtgcataccaccatgcccagctaatttgtgtatttttagtaaagacggggtttcatcatgttggccaggctggtctcaaattcctgacctcaggtgatctgcccacctcagcctcccaaagtgctgggattacaggcgtgagccaatgtgcctggcctattttttttttttccatttaacatcaaagaggtaaaacagtaacaaaaaaaaatccctattccttttcttttttttttcctttttgagacagagtctcgctctgttgcccatgctggagtgcagcggcacgatctcagctcactgcaatctctgcctcccaggttcaagtgattttccttcctcgggctctttagtagctgggattacaggtgcatgccaccatgcctggctaatttttgtatttttagtagagacggggttttgccatgttggccaggctggtctcgaactcctgacctcaagggatctgcctgcctcggcctcccaaagtgctgggattacaggcatgagccaccgtgcccagccccctatcccttttgtaacctaaaacctactgctatgcatattcttataggatgggccatcaatcaaaaatgactttatggccatgcatggtagctcacacctgtaaccctagcactttgggagggtgaggcaggcagatcacttgagcccaggagttaagaccagcctgggcaacatggtgaaattgtctctacaaaaattagcttggcatggttgcatgtgcctgtagtcccagctactcgggaggctgagatggaagaatcgcctgagcccaggaggttgtgacctgcagtgagccctgatcacgccactacactccagcctggaagacagactgagactgccacaaaaaaaaaaaaaaaaaaaaagaaaaagagaaagaaggaaaaaaagaaagagaaaatgactgcataagagttacaatctaagaaaatgagcccataaaaggacaattttaaaacattttttatttaattatttaaattttctgtcaaggctctattgtccaaatatttttcaaagaccatcaaaatgcactttgggaggccaagacagggggaacacttgagctcaagagtttgagatcagcctggacaatatagaagaccctgtctcttaaaacaaaaatcaaataaatactcatagccctatgccactcttccacctaaacaaaactttcagagcagtggtccccagcctttttgatactggggaccagttttgtggaagacatttttttccatggatctgggtggggatatggtttcaggatgaaactgtttcacctcagatcatcaggcattagttagattctcagattctcacaaggaaccggcaacctagatccctcgcatgcgcagttcacaaaagagtttgcctcctatgagaatctaatgctgccactgatctgacaggaggcagagcttaggtgttaatgctcgctggcctggcccacctcttacttcctactgtgcggcccggttcctaacaggccatggacctgtgttgatccatggcccacgggttgggaaaacctgttccagaatatttcctggggtcaatctattttaagtccatgcttctatactgtctatattatgcaattcagaatgatatttctgagactatgaaagatcttcaatcaccagagaaagattcaattatgttcactgtactgtacttaatttcataaaagcagatcaacataacttagacaagttttcaacaatgaaatagaaaataaaaggattttttaaattaacattaaattcaatttgctaagttaataccagctgagacttaactatattaattacaacattctgcaaatgtgaagactaacatatttgtaaaagtgatcctaaatcttcattttacattgctctttttttcggaagccctagaaaccttttccccatgccgactattcccaactcactgtttttctatagatctactgcccattatcagcaagtcctcaaaactgttttatgttttaggaaggtcactgtcaattctcccaacacccatcctgccttcttcagattgtatcttggttttgttttcccacaaaccaatgaaattaaaaataaaataggacttaatactatgttatagaacataacgctcaaaatttagtgtatatcagaattacctgggaaaattgctaaaaacaggctctggggtcaggtagatcttagtttaaaccctggctctgctgcttctaactatgtaaccatgggtatcacaccttacctcatgacccaatgggctcccctcaaagggagacaacagtcatatttcagggtggatatgagaatgaaatgtgattatggatgtatactgcttagcacatggtgcctactatactctaagtagtcaataaatgggagctcttgttattgcgtggccctcatttttcctttccattctagtctctgtactgtcttcaatactaaaacccattgtattttccacattcttacaatgtccactgacaacactttggagagcatgacttcacaatacttccactaagcttctctagaactccacatcaggctctcaacaaactggtattaaaaaaaaaaaaaaaacataaaaatacttcattcttaaaacaggaaatttgactgggcacagtggctcacgcctgtaatcccagcactttgggaggccaaagcaggtggatcacctgagatcaggagttcaagaccagcctggccaacatggtgaaaccctatctctactaaaaatacaaaaaattagctgggggtggtggtgggcacctgtaatcctacccacctgggaggttgaggcaggagaatctcttgaaccctggaggcggaagttgcagtgagccgagatcacaccatcacactccagcctgggcaacaagagcaaaactccgtctcaaaataaaagggcgatggggggaggtgaggggaatttaagaaaacaaaataaaaaaataaaaataaaaacaactgcaatcatcatctattattatactatcaagagctcaaacatggcatgccctcaaactaactaaaacctcccctggctctcaaaattttttttttttttttttgagatggagtctcgctctgtcacccaggctggagtgcagtggtgtgatctgcaacctccacctctcaggttcaagcgattcccctgcctcagcctcccaagtagctgggattacaggcacctgccaccaaacccggctaatttttgtatttttagtagagatgaggtttcaccatgttggccaggctggtctcgaactcctgatctccagtgatccacctgtctcggcctcccaaagtgttaggattacaggcatgagccactgctcccagcctagctctcaaaactttctaaaccagccactttctaccttctcagcaactttcaatcacattactgctcttactttactgagtccacctaatgatatctggctttttagccaggctttgaatcatcgtcgacttttctgctgccttcaccatacctattcttcctcaaccccttgttcatccaccattggcaatcttcaacccttactatcatccctggagttccaaagtctccaatctcgcttccaggccagaacattcttgtaggaagacacttcgaacaagtgccatgcatgtctacctgataatgccctcataggaccttacaaatatcatcttactaggcttttagtaattccacagtctccaaaagtcaattataaccttcttcacacacttttaagactctcgcctcgcactctcctctgaatcatcagattacttcaatgtttactttgcggaggacatcaaggccattgagcatcccctcacctatcagccttcttcataactccacatagtttagtcgtatactacaataattaagcacttacactacacaataatagttaagtactattaattgataagtattgctctacatgttttatgtgtaattaactcattcgatcctgacaacaacccaagaaattgaacacaaggagatcatatgactcacctacagtcatatatctaaaagtggcagagtcaagctatgaatccaggcagtctggccccagaggctacttctcagaccactgcgctccactgactcacatgctcttaacttttcccactgagccctttccttcaatagggacttcgaatggtggtcagatagggttagttatccttagctgttatgttttaacttttccataaaggagaatatattcaaggatgatttgtgaaattaaagatttataaaatgacttactacaaagctgcagtaaacagtgtggcactggcataaagacagacatatagaccaatggaatggaacacagccaagaaataacctcttgcatatatagttaaatgatttttgaaaagggtgccaagaccattcaatgaagaaaggagagttttttcaacaattagtggtgggacaactggattttacattcccaccagcaatgcacaagggtcccaatttctccatattgtagccaacactgctttgttctttgtcccaaagagcaaagttaaagccttctcttataccatatacacacattaactcgaaatgaatcaaagacctaaacttaagagctataactataaaactctttaaagaaaacatagggagctgagcccaatggctcacacctgtaatcgcagcaccttgggaggctgaagcaagaggatcgcttgaggccagaattttgagaccagaagagtaacacagcaagacctcatctctatctctacaaaaaataaattagccaggtgtggtggtgcatgcctgtagtactagctactatggacactgaggtgggaggatcccttgagggcaggagtttgaagttacagtgagctatgtgatcgcatcactatactccagcctgggtgagaccctgtccctactattttcttttaaaaaggggagggggttgggggaggcacatgacattgaatctggcaatgatttctcagatatgacaccaaaagcacaagcaacaaaaaaagtggataaattagacttcatcaaaattaaaaacttttttgcaacaaagggcacaatcaacatagtgaataggcaaccaacggaataggaaaaaagatttgcaaattatttatctgataagggattgatatccagaatatataaagaactacaactcaacaacaacaaaagaaacaactcaattaaaaaatgggcaaaggacttgaatagacacttctccaaagaagatatacaaatggccaggaagcatatgaaaaggtgctcaacatccctaatcattagggaaatgcaaattaaaattacgatgagataccatttcgtagtcatcagatggatagtatcaaaatcaggaaataacaagtgttggctatgatatggagaaactgagacccttgtgcattgctggtgggaatgtaaaatgaacagttgctatgaaaacagtatgagagttccttaaaaaattaaacacagaataaccatatgacccagcaattttacttctgggtatataccctaaagaactgaaagcagggccaggtgtggtggctcacacctgtaatcccagtcacttgggaggctgagaagggaggactgctggagccaaagagttcaaggctgcagtgagccatgatcacatcactgcactgcagcctgggcaactgagtgagacctgtctccaaaaaagtaaaagaactgaaagcaaggacacaaacagatatttgtaaaccaatttttatagcaacaatattcacaattgccaaaagatggaaacccaaatgtcacaaaatgtgatatatacatacaatggaatattattctgccataaaaaggaatgaaattatgatacatgctacaacatagataaagcttgaggacattatgctagttgaaataagccagttacaaaacaaaaaaaccctgtatcattccacttatcagagatatctagaataatcaaatttatagaaagtagaatggtggttgccagaggctgggagaaggggaaaatgggaagttgttttatgggcacagagtgccagttttccaagattaaaagagttctggagattggttacacaacaatgggaatgtatgtaatactactaaactatacacttgaaaatggttatgatgataaaggttatgtgcattttacaatttaacataaaactgattttttttaaagagaatgaaattctgatacatgctacaacactgattaccaatgaaaacattacactatgagatatatgccagagataaaaggatgataaaattccatttatatgaggtacctagagcaaactcatagagggcagaaaatagaatagtggttactaggggctggggaagggggagaagatggggagttattgtttatggggtacagcatttctgcttgggggccaggtgcagtggctcacctgtaatctcagcactttgggaggctgaggagggcagatcacctgaggtcagatattcaagaccagcctggccaacatggtgaaaccttgtctctactaaaaatacaaaaaaaattagccggccacggtggggcatgcctggaatcccagctacgcgggaggctgaggcaggagaatcacttgaacccaggaggtggaggtgcagtgagacaaaattgcgccactgcactccagcttgggcgacagagcaagactatatctcacaaaaaaaaaaaaaaaaaaaaaaagagagaatttctgcttggggtaataaaaaaatcctagagatgggtaagtacactcacaataaaatgaaggcacttaataccactaaactgtatgcttaaaaatgattaaaattgtaaattttgttttaccataacaaaaaatgtataaaaagaattaatatataaatgtgccacctgtatttgtgtcctagatctctcctttctgattcctggctaatattattcctatatgtgtctacttcattatcagtcccacagtggctactgctctttcttcccagcctttctcttcactttaaacttagagtcattagcttccattttctcctctatacagctgccccagaaatgtacatttctcatcctgatagcttcaactcctcatttagtatttccatctaaatttcctccttagcatctataactcaatgtccaaaacagaacacatctattcccgctgaatccacccttcttttcaaattcattatactgttgtcaccatttctccagttactcagggtaaagtcaaaaataatatcctcccaaacacctatgtccctttttctttctttctttctttctttctttctttcttttttttttttttttgagatggagtcttgctctgtcgcacccaggctggagtgcagcggcacaatctcagcttactgcaacctctgcctcctgggttcaggcaattctcctgtgtcagcctcctgagtagctgggattacaggtgcccaacaccatgcccagctaaatttttgtatttttaatagagacgaggcttcaacatgttggtcaggctggtctcaaactcctgacctcaggtgatccacctgccttggcctctcaaagtgctgtcctttattcaaatcgtcctgtcattcatagcacctttttttttttttgagatggagtctcattctgttgcccaggctagagtgcaacggtgtgatcttggctcaatgcaacctccacctcctgggttcaagtgattctcctgcctaagcctcccaagtagctggcattacaggcacctgccaccacacccagctaatttttgtatttttagtagagccaaggtttcatactgttggccaggctggtctagaaatcctgacctcaggtgatccacccaccttgacctcccaaagttctgggattacaggtgtgagtcaccgctcccagcctatagcacttttttttttttttttttttttgagacagagtttcactcttgttgcccaggctggagtgcaatggagcgatcttggctcactgcaacctctgcctcctaggttcaagcgattctcctgcctcagcctcctgggtagctgggattacaggtgcccgccaccacacctggctaattttttttttttttttggtatttttaatagagacagggtttcaccatgttggccaagctggtctcaaactcctggcttcaggtgatctgcccatctcaacctcctaaagtgctgggattacaggcctgactcaccatgcccagccagcacttttttttttttttttttttgagttagagtctcactctgttgcccaggctggagtacagcggtgcgatctcggctcactgcagcctctgccacctgggtttaagttcaagcgattctactgcctcagccagcccagtagctggggttacagatgctcaccaccacgcccagctaatttttgtatttttagtagagatggagtttcaccatgttggccaggcagctctcaaactcctgaccacccgcttcggcctcccagtgtgctgggattacaggcataaaccaccacgcccagcctcctataatttttattatagtatgttgttgtaattgttctattttattattagttattattgttaatctcttactatgcctaagtaaaaaactccatcacaggtacatatgcatagggaaaagcatggtatatatagggttcagtactgtctgcaattttaggcatccactggggggtctcagaatgtattctctgtggataacagaggactactgtattacaaactgctctttaaatttttttttctattttatggaggtataaatgataaaatttgtatatacttaaggagtacaatataatgatttacgtatatattacatgaggattaccacaatgaaattcattaacacatccttcatcacacagttaccatttgtgtgtatgtgatgaggacataaactgcttttaatattttatttacaacaagcctattaaggaggtagttgttttatcatgctctccattttataaattaaaaactgaggtcaagtggttgtcttgtgaacagtcataccaccaagtaaataaaagaatgaggctggatacggtggctcacacttgtaattccagcactttgagaggccaaggtgttggcagctgcaactccagagggcttgctgctgtcatcaaactggctgcagcagagaggtatggatagggctgcatgatccatggagctagcgggagcccttccccttctgagttggggcaggagctcccctggtgctgctggagctacacaaactgcagctgttaacctgggcctcctgttccacggagcaggcagaagccctgccctcctgggtgggcttgcagccgcccaagttgtggctgcagatccgagcctccctgtggtcttgtgggggccgggagcaggcaggatccctgccttcccgggtgcagctgcagctgccctcccaggtgcaggacctaatagtctctgcagcctgcacccttgggggcccaggaaggcctccccaccacccccatatccccacttctctctgctcttggcacccactccaatctcagagtggggttggggcaagtccaggtgctgttacagtccgggggcggatctgtgtgtgcaccctcagggcagcaccctgccaccttgaccccctctagaatttgggcacggagaagcaaaagaggggaagccaagtagggactgagggtggtcagtgctggcctttaggtgcaccttggtgtgagcagcctggtgccatggactgctgagagagacagacaggctcctgggtagaagggaggttcctgtaagtccccaccttcaggacggggagggcttaaaggctggggaccgggctgctagtcccacccactggatggggatttgtgctgccttttctcacagtccatgaaccaatcaggaagcactttctcccctctgaggtccataaaaggcccaggctcagccagagcagggtagaggatggagaaaagatcagacaaccaaagaggagagaggagctatgctgtctgctgaaagctgggaaatcaacagggaggacctgcctgcagagaggagccacccactccagggcctcctctctgctgagagctgaatacgggataagacaaactgcctacagagaggagctgccccctgtgggtctcctctgagctgttctaacactcaataaagcttctcttcgtcttgctaaccctctacttgtctgcttacctcgacgcaggacaacaactcaggcaaaggcaccactgggcagaaaggtttctggccagaaaagcaacaccctaaagatcccgcaacaaaggcaagaggattgctggagcgcaggagttccaaaccagcttgggcaacacatcaagaccccatctctacaaaaaattttaaaaattagctgggcatggtggtatgcacctatagtcctagctactcaggaggctgaggtgggaggattacttgagcccaggagttcaacactgcactccagtctgggtgacagagcagagcaagaccctatctaattaattaaataattaaaaaaaataaaagcatgaggactagaatgcaactgttctaactccactataccatactggccttgtgaaatgaataaattttaaagacaaacccatagccctacttgtttcaaagcaacaaagctgatttagaaatgctaaatgtaggccaggcatggtagctcatgcctgtaatcccagcactttgggaggccaaggtgtgtgaatcacttgagtccaggagtttgagactagcctgggcaatattgtgaaaccacatcgctacaaaaaatacaaaaaattagccaggtatgatggcatgtgcctatagtcccagctacttggaggctgaggtgggaggactgccagagcctggggagattgaggctgcagtgaactttaattgtgccacgtaccccagcctgggctacagagaaagaccctgtctatctaaaaaaaaaaaaaaaaaaaaaaaaaccaaaaaccaaaaaccaaaaaaagctaaatgcctcagaaactatctttggcatatcagcatataggctataacccacatgcttcaggtatatctatcagtgatatgggaaagaaaaaaggaaacaaaagactgtattataaaatacctgaaaagtaatgttaggtatattctatacatttatacattaccattatcctggagacattacttatcctagattactttgatggtgatccactcaaactattgactggaacctgttcaccagcagtaagaagatttctgtagtgacctgataacctatcagtcaggtaaccctacagtctaaagataggttacgccaggcgtggtggctcatgcctgtaatcccagctctttgggaggccaaggcgggcagatcacttgaggtcaggagttcgagaccagtctggccaacatggcaaaaccccgtctctactaaaattacaaaaaattagccaggcatgatggcgtgctttgggaggctgaggcaagagaatcacttaaacccaggagacggaggttgcagtgagctgagataccaccactgcactccagcctaggtgacacagcaagactccatctcaaaaataaataaataaataaagataggttatcacatcttgttgatctctgtagctctagcatttagtagagtgactcatacatatcaggcataaaatgtttattcaagaatgaattgttggctgggcatggtggctcacgcttgcaatcccagcactttggaagcctgaggtgggtagatcacctgaggccaggagtttaagaccagcctggccaacatggtgaaaccctgtctctactaaaaatactaaaaattacccgggtgtggtggtgcacacctgtaatcccagctactcgagaggctgaggcaggagaatcgcttgaacctgggaagaggaggtcgcagtgagccaagatggcgccactgcactccagcctaggcgacagagcgagaatctgtcttaaaaaaaacaaacaacaaaaaaaagaagaatgaattcttaattaaactaaatttggcctggggatgcctctgtacttgagtctttatataccaagttgcaacctaacttagtacttaaactaactgaaagcctaatttagaagtatacttttgtatcaaaaagctgagtctcaggaaagcacagcagctgagcttcagtcaaccacaagcaatcaactgtttaaaccatgttcaaataaggcaaactcaaggctgcaaccaactgggctgtctctgtacctcacttctattttctgtacttcatttccattttctgtccataatactgcctgaccacatggcaaactggagttttactgaacatgttctggctatgagggttgctggattcactagttatttttttgctcaaataaactctcctaagtttaatttgtctagttcttcttttaacagaatgaaggaatatg

SEQ ID NO: 132 - DNA, 107807 bp, Homo sapiens
tccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggatcacctgaggtcaggatttcaagaccagcctggccaacatggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagagcaaaactcagtctcaaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcatgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctcaattgtataacagcaatcactgtgatgtttctagaactattaacagatttagaaatttctgataataacacagttgttactctaagatttgtggttgccttgactacaaacaccagcagtatactttatttctgtttaatggccacagttggaatgcaaactcttcagaaagcccagaatgtgagcatgcattatacactctgacttttctcaaaattgaagcaattcaagaaattatgagaccacattttaaagtagaatttaagtattagagcaggagaaaatgtcagacataaattagcccaactgcttccatttactgggggcagagggacaacaaccaccttccctcagctcccactgtgtataggcactttacctccattatcaggtggattttaatcctcaaaacaccactgcagcgtgggcattatacttatttttaagttgaagaaggtgatagtcagattaaataatttgcccagccacacagctaatggcagagcctgagtacaaaccaagctccaattccaaaacatgctctttccacttcatgctgctttttccaatatcacagacaagggaacagcacccgaaggatgatgtgatgaaatccaaggtcatggaggttttcagaggcaacagtatgattatttccactactgcacactgcctcctactaccaacctgaagttgcactgtttgttccattcctctcctcatgctcaggcataagagctgttttccattctttcaacctctaaagaaactctaccttttttctggtttgcaatgaaagaaggcagtgagcatttaaaatattatcgagagtgtgtatgctcaaagtaagagactgggaaatcagaaacaagacatcatgagaaaaactgatggcatcattacatttccaccaaattattcacagctacctagaagcttaaagagtctatgtcaatattaggtttgaactaccataattgttcagagtgaataagtttgttctacatgaagctggaggctgagctaactctagagaaggtaatcaatataataacctgaggttttgtccacatacaaactgatttattaggaggagtcggtggaaggtacgaggagattcaattcaacctttttccccctgagtggggaaggagaagacaggcaatgggtacaggcagatggaagaagcatagtggttaagcacgtgggcactggagttagcctcactagattcacaatctgcttagcagttgtgtaacctggggcaaatcactaaaccttgctaagcctcagttcttcatctgtgaaataaaaagcacagtgcctagcatgtaagttctcaataaataatagctattgtcattattaaattggctgcacataatcatgctagtttcacaaatactaacagctaatataacatttgcattttagttcctaaaactccttgggaatacagttgaaataccagttagtatcaaagagctgacctctgatgagaaataaccagcaacactccttcttgaacttgcttttgttaaagattacaactcttgcaaatatttttattgtattattctactatgtcttactgatattggctggaagttgtaactttatttttaatacgaaatttatttcctttgtaaaacttggatagaaccactaagcagtccagagtccaagtccttccagacaaatgctccccctgctgactttctgtgcagctgcagggacatctgagggctagacaaattgaagacatgagagttgggggaattattacagagaaaatggaaagaacagatgaacttgaacctgattactgtgtatagatgtttccaaaggtgttactctcctgttaagttttcaagatatgaagtactttgttgaagagggcagggggtctgtccagattagttgacacgtagatcctcctttaaaatgtaaagtatgtgcagaataataaaagacatgaagggtataaaataaatgagatcaaagacaataggatttttggctatattttaagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttggaagaaagaagagaaaaaaaggaatgataaagagtttgtacaatagagaagcagttttcagtcccagctcttcatcttgtaaagctagtaaagtgaagattataaaatttacttacaagatgaaggttatagcacatagctcacttttattatcatttcaaaggtcataaaatatattttattattaactcagaaaatctagttctttattattacagataacaagagcattgtatattatttgatgtacgtattttgcagtgctttttatatgtctgttttcctcttgttgctaatttactttcattaacttcacgcctcctcttacatttcctcaaaaggtatgatacgcttcttataatgcacttttataaacactaaatgtgcagcattttacagccatttcattacgctaaccttgaaatctgtcttgtgcaacaaaactatttgaaatgaatgttaaacattttgtagctgcattaatggagggaaagatactggaaaatgacaggtctttttaactcaactataaagtcttgtcttattttaatagatcctttataaaatgtgatgggattgacccatcagtcactttttatataacctccatgtgaaatgtgagtttaagtggctatagtttccctaatgagaaaaggtaaatgtaaaaatgcctatggagcttcttccctgtaggttccactgcactttttctcagtgaaaggattgaggcgcttatgctaaacaagggaataaagtggtggaaattccatcaaatcttttgtctaagctactactgttttgaggcgagaatgttgaatgcaagcttgtgcattccacactgattccactgaagctccttttctatctctgctgaggtatgcaggtactgttatagcatttttatgtgggtaatcacccaaattctccatgatcataggtatatcatgacattaaccacaaaattgccaaagtcaataaccatgtagacaagaggccatgaaaatgaccattttgcatttagatttattttcagtcatgtcaacaaccaacagctgagtcattcagatcaaccacatgatgatctgagtcagtactaaagtggccaaaataaccagattatgatgtgcaggcttgattttagatcagactgacacagccacagtccattagcctcaatacaatggcacagtgtaatttccataaattactgtatttttctccacattgtcaagtagacaatgcataaactaccattagtattcacagcagcaaaatatacctctttccatatcaaactgtgattctggaattactccaaagtcagttttctccttggtctggcaaaacctcatcattccaaataaaaatgacagtcacagttctgtcccaaatgaacaacagataataaacaataattatacaaatatgtttggttttcatgccactatatttctcagtgtttggagaaaatttgtaccttctataacttgcacaccattttggattttcttatacaaaatacgggtattttatactacaaaaatgtgggtatttctctcctagtgtataagtttaaatgttttattttctattctgcctctctgtgcctcagtttctttatctgtaaaatacctctgtttgcttatctttaaaatagtacctaaccatagggatagagaattaaaatagttggcacaggtaaagcaattagaacagagtctggcacacaagaagtgctcaataagtattagctataattgttatcatttttcttcctctattactatggatgtttctttggaatgttaatcttttatatagcaaaattatttctagagtcagatcagttcagaataaattaaatgtatgtggcaacaatgaagaaagactctgaaaggtctaaatgcataatcaaaacaccctgtatacttttagcattcagaagtgtgccacattcttttctgactcatccagatgtttttacttctgattaaaagagaaatgttcccagatgaaatcctgagatagtgtaactgttagaaaaatctactgcaaagcagattttcaaattcaaaaagctaaaagtgatcatgttcaggaaataaatacgggttgtctcaggaatccagggacgaacaggaactacagatttaaaaaaaatcaagtcagtttgttatagttaaccaataataaatatttatcaaaatacctgccaaaattattcagagtgtagcatctaaaacaactgagttttccagaggccagaaaaaggttaccttgggacacaggaatttaaatttgctttaaagtggtgaaatgctggtacagacagagaagagcttgatttgccggctctcagcccagaactaccctcttcccacagagcctggagatatgccaggctcctacgcctattcttgactttatgacagagtgggttctcttcctgtgagtttttctgggcatgggagaacatagcgtaactaggatggagctctgccacacagcagaattatcctaaggatgatgtggcaatgttttataaaacctagggagcagattttcatttctgcagacagagccagccttcagcaacactgtgaaggagatgaagtttcctgagtacaagccattacccatcactgagcattcaattccctcacactgtccaataacttcttatggtccctgtctctgaggaacactcatgatgcaggaccaaacttgcaaccctgtctgcaccttgagagttttataaagtgctgctgcttagtcccaacccccagggttatgatttaattggtcttgaagcctaggcaaggttttttgtctttttgtgttgacgtgttttgactgaagctccctagatgatattgatatgcaggcagaactgagaatcactgatgtagaagaacaatgtttctcagtttggtctgcagaccacttgcagcagaatcacctgtgatgcttaagaagtgcagattcttgggcattcagctattctgaatctgcattttaacaaacacctcaggtaatgctgatgcacagtaacatttaagaacaaaaatttccccttattaaaacttacccatcttctttcccattccctactaactgaataaacagtgggtgctgttgaagtaatgtgttacattttgatcaagcctcctgaaaacaacacagagcgtgattccaatagaatttctccatcagaccaggaggatgattttgttttcgttttctgtgtgtgggggtggaagggggtgtggaggaagcaagccttttgatgcctctaatcccactatacaggtagtttcctacttcacttggagtctgccctgagtggttaaggcttagttgtcaaaggagaaagtttctaatctcctgggccccaaaagctatttatatgaagatgatgagaaatattatcatctagctccttgccttatggatgaccaactccacaaaatagcaatgtctttgttaaatttattaaactcaaagtgaatagtgctcattttccagcacctacccatttatcttcaagtgagaagaggtttttgactatgtttctctcatgacattaccttgtagcagtggttttcaaccttggttgcactttgtaatcacctggtgagctttaaaaaatttaaatgtctgtgtcctacctcccaagttctgatttaattggtgggcctgggcatgagtttttttttaagatcctaggtgattttaatgtggagccaaggctgaaaaccatttgcttctacaggtgtgcccagcaaacttcacaggaagagaactcaataagttaaattattacctgtggaagcaggagatggtaaaaaaaatatatattttttcctgtaattaaaaggaaaaatcctgctaggagtgcacttgtagtcccagctattcaggaggctgaagctggaagatagctagagcccaggagttcaagtccagtctgggcaacatagagagacctgacctcattttttaaaaagaaaatcctgctttgaaacgtgtataggcctgacaagtattatgcatgcaccatcatagtatgccatcatgacatggggtattgttgttaacatgtgacctttgtttaatgttttaattccctcacatcatctatttccctccttcatcagctatactgaaaccactcctctttccagaaataaagaaaaggatttcttaaacttagatctggcccctctgggtctggatttgtttttgttttgttttatagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctactccattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacatattctattttaaatgttagttgtctattgagatgtattacaattgtatcaagtatttgtgtacatggtgataatttcattttcaggacagctgataattgttttaatttcttgggtagacgtattccctcagctcctcataggcaaaatcttattgaggaaacagtaaattgttcattagcaaaagttaataaagctatgtaaagtctgtcaagaggaaagatgaaaggagattgaagcaggaaatgatagaaggataatatgagggacaaaccactttcacataaaccatcaagatctttattctgtggtaactggactattaaggaagaatactagtagagtttttaagaactaaaatgttttttcagttaccccaacaagaaaaatatgctaatttagattagaaaatggacacattctataatattactactgcctgctactgtaaccacagtaactagttgtagcaatgatccagaagccacttgggtagtaggtggagtagttagtcactctctccaaccaataatcaagttattggatgacagatataattgctgatttttcctcaaaggcccagagtaaacagatggtggttctaaacctcctttttaaataatcaataagaaatacatttctacatgtattatcatgagatttgtccaattacttcacagtaaaccaggaagagtacatttcttgacattacagcaattaactacaaacagttttcactccctgaaagagaatgtattagtcctgggaccctttcaagaattctcattgattcaagatatccatatctcacctataccacctgtttactgaccagatcataatccccaactgggaggaggggtccaatgttggtccaatgaagaccctctggaactaatctggccttgaccctcactactatggcagtcccagaagcttatttagaaacaattttctgcccccatgaaatcactcacatttatcggggctagaagccagggatttccatctgatgagtagtcaacacataaccagctccatggaaatctggtttgatatcaaccttcaacagagcttatgataaccatcccaataggcatgaagtttctatatgaagtaattaaccacttaggatatcaagacaccagaagcttctatatgaagtaattaaccacttaggatatcaagacaccagacttgaaccctcagataagagatacttgttccactggaaagcatttttctttcaaaaacaattagaggttagaaagttgtgctttaaatggtaatcaataaacggcatcaattcccattaggctttcaaaggccattcatccatattgcaggcaaaaggaggctctctggaaagatgaagagatttattagcccagaggcagaaagtgtgaccaaatattcattgccctcatgcccagaccccatctcccacttattctgtgtctttctcaaaaactaggaaagcatctactaaatcattcaatcatgatttcattaaagggcatcatattaccagagctgatttgaatcaacatttaattctgagcaaagctattgccacattctgattggtttgtggtttctaatgctcatcaattcctagccaatgagtaattcatatggaaattgagctgttttgaaaatctgattacacagggagctggatatttctaagtataaggaagtacaaatcattttctagttctggcatgccactttttctgtttccccaaatggtcactggtggcatcattaaggacttggtggggtggttcttcagggcagcacacgaatgttgattatctaaaagtggaactataaaagcagcatagaaaaaccaactcctttaacctgcttatactgaaaatgttatctagacccaacaaagactatctttgatattcgtgcaatacagggttgtggggccggcagccaattggtctccaagccatttaaatccaatggggcaaagaaggcagccagcaagagcacatcatcctttatttagggacttgactgccacagtcatgtcacttccccttcattcttcagtgatgtcaagtcataaaggcaattttaaaaactaactcctggccaggtgtagtggctcacacctgtagtcccagcactttgggaggccgaggcaggcagatcacgagctcaggagattgagaccagcctggtcaacacggtaaaaccctgtctctactaaaaatacaaaaattagctgagtgtggtggtgcatgcctgtaattccagctactcgggaggctgaggcaggagaatcgcttgaaccagggattcagaggttgcagtgagctgagatcttgccacaacactacagcctggcaatagagtgagactctgtctcaaaaacaaaaacaaaacaaaacaaaacaaaaaacagtaactcacatacacacacacacacacacacacacacacattggggatctctgatagcatgccttatgaacttcagaggatgaaacaagatcacatgcaacatttacaaacataatatgaactcatttcttcccgtgctcactctatactaatactacagggaccaaattgtaataacataagacagcctagggccagccctctagtccttccactaagagataggaataaataaaataaaattcttttctaattgccctgcagacatttttacttgtcctgagtaaagctgccattaaaatgatggtatttttaaatgattcatttgtttctctcattttctgagctttccctagctgtcatcttacaatcccatgatcagtggaacagagggacctgttccgtcaggaaaggcagggagcagaatgcatgctgctagaagagacacctggaatattactatcaactctcttgatttgaaaactgatttccttagacagcagctccaaaactatatatcccaaccagacgtagaagcacatatgccaaaaaaacaagtggacggctttattgttgttgcccagagaaatgctacaatgatttggaaagctgcactgaaatgaccattctccactaggttttggaaatttaacctgatacagattcatgttaaaaggtggcactggaagaaaaagtaattccaaagttctctctgcctgcagacctttaaaagtattagaaaataaccaggatgctggatttctttttttgtgaaaattgatattaatattttattaagatgcattcaaataattatttatacatttatatgcataaacacccaaaacattttatacatggaatcatataacatagtattctcttgccattatttgtttgttttttaaaactcaaataagtatagatttacttttttttttacttcatagtatttaactttacttcaactctattatttcctttatcaatttcctcttgataaatgtttaaccttttgaaaatattttggtgttaacagtggttcaataaacattattttccattgatgtaatagaattattttaaaatgtttttaaatatttgcccttcagttagatcccttaaagcacttagcctgtgatgtgacataagccatgtaatgcccagctgcagacaaagctggcttcacaaagttacagaatgtagtaggcacctggctaaggaaaactctaccccacaaaatatttagcccccagtaggcactttaacaggaatcacattttttcccctttttacattaaatgtctgatggtggaagaaggggacatgtttgttctaaagttaatcctaatggaaaagttaatggtccaatattttatttataccataatggacaatttttctctttctcatttgctgaactttatgcaaggctcttgtgtttatttgggcacaactccagaggccttcattcttattctcacctgactggatggcccagccaggtcatgtataacctgtgatatgcctgtgcatatacctgtgtgcgtaggctgctgaggccctggtatttggtttagtttgttgcttactttgccgttgcttggtttcctgattctctaaaagaatataaggcagaaaaatcccagagagatgtttcagagtttcagaacagtaccgttgaagatactagtcacactgaagtttacaaaagttacatataagagaacaaagacttctttcatcatttagacagagttggtttgacaaaggttttcagcaaatcacatcaccaaataagaaactaaacttgctgacttagcctattgcactaaccactaaactcagcttcctcccttagctacacagggaagaaacacaggggggaaaaatgccaccctttttgaaacaagcaaacttttggaaaatggccaggtctggaggctgacttgtatagtgcatcattttatgagatgtataccacacccagaaaccttgcagaaatcatcatgacagagatgagataatctcaaaactttctgattttatgtggcgatcatttgccatgctggtagaaggttttatgagaacttaaatgctctcttctggaaataggcagtaattctagaatcccagaaaatttaaatccatgtcaatttgatatgtttggacagttgacagggaaatagtactgttttaattccatgtatatagggcataaagacacatattaaaataagaaataaggaccagatcagaatgaagcaccataatgttaatgaaagcaataagttcaagggataattttataaaactgtcattagagtatttgccaaagagagagttgcattatctctatcatatctcttatttcactataccagagcctgcataactgcagtgattattttaggacttaagacaaatactttatttattctaagaacacattgatatacaacttatatatcacatataagaagtcaattgtctctttttgtattagttttgatcagttagctgatgaagtctttgagtcttaccccaatgccggatgccagatttcttttccagatacttggccatatccccattacagaaagtttgggggataaaaggaattcttttttaaaaatgaaatgtttaacattaatttaaacctctttaagaaagtaaatataaaagaagaggagtagagagagtggtgacttgctccagtgccctaggcaaggcagaagaattgaactttattaggagaccactaaggggactgtcctgcctcgtgagttacaggtattgtaagccctgtgaagcacagctgaattactcatgaagaatgttttgtctcaacacaagactctgattattgtcttggtcattatagtttttcattttttttaagcacaggcagcgaaaggaggggttctgccatgctgatttgaaaaggagtccctgctaatagcatttcgattctgcttacacattcacaaccacacacatacacaaagcattttcaactgggtctacatttcttcaatatttattggctatctataacagggcttttgaagtatatgcaggaagggagaaaaatctttccacaagcgcacctatgcagggtatgctgacattttgacataatccagaaaatcaaccattaatctttaagctttattataattgagctatgtacacaacagacctccctgacaccttaatccatccccttgccttaggaaacacatcaaaatgtaaaaatcttttgttaaaaatttttctcaccaaacaccatggtgaatttaagatcttaacagacaatatacctggaaagctgcagccaaattttatttgtttgaagacacatataatgtgaccaaatgtttgaggatacatccaaaccatgcactaggggaacacataacagcaacagcaacagatgagttgacactaagggtagtaggtcagggacatctgctgtacatactacttggcagtttaaaaaaaagaaaactgtctttcaattttgacatggctgttttgatgctgtcttatttttttttaagtcttactttcctatgttatataatacacagcaagagccatagaccttataggtcaagactggagacagagcaacagccacaggtgaggatgctgaggcctggccaaaaaggcctctggaaaagggaaagatgcagtaagaccaccgttggcttttcccatccttcagcagctaggaatctgtggctccatagctcttcctttcaggcaagtctcaggctggctggaaaggacaatctccaagaaagtagaggttgacctgacaactatgcacgcaactgaaaacacatctaatatctgcctccaagagaaaggaaagcatttagcaataaagacaagctaataatatgcctgatattccattatttattcagcagtctttcagtaacttttgagccaagcttcatgctaagcactgacgatcatacatcttataaacaaaattaaattcctatcttttgccaaattacctgaaaatacctagacaggctttttcaccatatttggagacagattaacttaaaatataggtatctcacataactagatgactttccctccagggaagctggtggtgtttatttctatggagctacttcccagcatgggccaatctctgggtatgctccatggtgacttagcagcagggttaatgattccctgtaacctcagtaggaagatcagctagtttatgaatgaaacagaaatggcctctaccctcttggagctcacaatctagtggaccattaattttcaacacacattcacatacattactacacaatccacacaacaatcctggggcagccagaacaagtatcattacacctgtttcatagaggagacaaatgaggtacatgacattgtgatttgctgaatgtcactcagctcaatggagaaaagctggcactaggatcctgatgctctgagtctctaatgcagcacatgttaaggcatctgtatcatctcccggttgatctatgtttttattccccttgatagatcaattagaaaaggaaatctatgcctacttttaaaagacacttcccatgctctgacaacttcaaagggttccaagataagaaggcaaagaaaggcatctataaagctagagtgaatgccataaatggagcaaacctctattattacatggcttgttatagtttctgacgtgctaagggttatgtcatgtgtgtagatgaaactagaaagaacaagagaaagatgaattgtttctagttccacatccactgatgactttcttatttttctttgggtaaagaatatttggtctcagtttcttcatttatcagggagaatattccttgctctactgtccttatggggttggtgagaggctaatatcacaaaagctctttaaaagtatgaaggtgtctacaagtcccaagaaacattaggaaaagggcccagcaatagagcaattaaaacctaaagactcagggggagggagagcatcaggataaatagctaatgtatgcagggtataatacttaggtgatgggttgataggtgcagcaaaccaccatggcacaagtttacctatgttataaacctgcacatcctgcacatgtatcctggaacttaaataaaataaaataaacctaaagactctccagacacagttctgtagagatgtgaggggtacttcacaaaaataaaataagataatctctctgctttcttgatggaagagatgtgggtttgttttttgtttttgtttgtttgtttgtttgtttttctggctttgggaagagaaagaaagctcattcaatattttccccatcctcttgatcccacttctacccttaaatataaaatattactattgtgctcatctcctagttgattcatctttagctattcctttgtggcctgcagattcaacaacttcaatatgcacaatttagagctgcccttgaagaccatctagaaactttaggtgcttccaaggtggcctgccggccatctgcccaaagtaaccaaccatatggattttattaaactatctccattagtcctccaaggtaacctacttgtttatgagagcgtttcacagcccagaaagcctaagggggttaagtctccattctttctgaggctgccaactctcacagacagcatcagggtaattaacatcacacaggacccccagatctttgtaagaactctgaaactctgtttcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaaacttgataagaattttttccccaaaagcctactagatgatgtcctgcagtcagattcattctagtcttcaacatcattcacactttggtcagagagtaaatgtattgaatgtttatcatagcaatttaggcaccaggtatacagtacaggaaacattgacagaacccttaccttcaaggagcttgcattctgttggaaggagacaaaccataaacacataaaaaatagatgtatagaataattccaggtacggataggtgctccaggatgctataataaagaatgacttagggttagaaaaatattttaaactgggagcttgggttggatggagggtttagggaaagactcattaaggaggtaacattttattagagacttaaatgataagaagaggcagctatgtgaaaatctgatggaaaagtattccaaacagaagtcatgcgaagtacaaagtcctggggcagaaacaatcctggaatgtttaaaggaaggaagaaaaccactgtggctgaagaatagtagcctacattagaattatagtgatggagactgtgtgaaggaatcagatttatgattcattttggaggtagagtcacagaatttgctgatggattggataacatttatgagcaaaaggaaagagccaaggatgactctcagattttgggcctacatcccttttcagtaatcacttatgaaatctatagtcacaagggctgaaaaggtatactaggactggttaagaaattttccaaagcgttggagaacgttagctgtctgaagggaagattgccgttgttataactgttttaaacacatctattgagatataattcatatatcacacaattcatccatttaaagggtataatggttttgttatatcacattattagtttttttaagttgtgataaaatatatttaacaaaacttgccattttaaccacttttaagcacacaattcagtggcactaattgcatccacaatgttatgcaaccatcattactaattccaaaatattttcatcacttcaaatagaaactctataaccattaatcaacttctcattccctcttctcccaggtcctggaaacttctaatctatttcctgtctctatgaatccacctatctaagtacctcatataaatggaacaatatgtccttttgtgtctggcatatttcacttagcataatgtcttcaagcttcatacatgttatagagcttcattcctttttaaaggctgaataatattccactgtatgtatatgccacattttgcttatctattcatctgttgatgaatacgtgactatttgtgaataatgctgctataaacattggcatacaaacatctgttcaaatccctgctttcaattctttggatatacacctaggagtaaaattgctggatcatatgtcaattctatgtttatctgctataacttttttttttccaagatggagtcttgctctgtcacccaggctggagtgcagtggcacaatctcagctcactgaaacctctgcctcctgggttcaagcaattatcctgcctcagcctcccaagtagctgggattacaggcgcatgccaccacgcccaactaatttttgtatttttagtagagatgtgtttttaccatgttggcccctgacctcgtgatctgcctgcctcagcctcccaaagtgctgggattacaggcgtgagccaccgcacccgatctgctataactttctaaaagtctattttgaaataaaatagatgagggcatcttctgttctgttttcttctcattcctgtttaaacaatctcagtcttgaggcaatagatgtttctgcttcagtaggaagagggatgctggataactggtgttgggggcagatctgtagttaatatcacaaagtttcatcttgatatcatgaatgaagttgaggaggaggtatatgtatgtatgcatgtgtcaaaaaagatctaaagccttgtctacaccacacatttatacaaagccttggacattttagttagtggccccgacttttagcaaaaacttaggggagcatgcttcccttttctgtgtttgggttgcaactctggtgcctcagcaggattgcactagcatgcaggcaaaggatgataaaaatggaactcattgtcctccctctgttttaaatggtttagaatgttacctgttggaagagaggggcttggatagagataatctattgcatttctctccagtcctgattgcatgaatctatctataagctgccctcaaaactgatcttctatctgtatactctgtggtgacctaatgaagatgtccctgaacgtggttaacttctatgcctagagaaatctgaattccagaactgagtcttaattcccagttttatcaaaattcttatgtgtttatagcctgatttatttgactctcaactttacttcctttgagtctggtctgggttacagactattatttttatgagaaatattttattttgtttttttttttaattaaggtatgttacaaataaaacttacatatcctgtcattcttggcaatatgaattcaccttgagggcattatgctaagagaaataagtcaggtattgaatgaattatctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtccagtacccaatagttatcttttctcctctcctctccctcttccaacctttcatcctcaagtagaccccaatgcctgttgttcccttctatgtgttcatgtgtgctgatcatttagctgccacttataagtgggaacacatggtatgtggttttctgttcctgcatcagtttgctaaggataatagcctccagctccatccatgttcccacaaaagacatgatctcgttcttttttatggctgcatagtattccatcgtgtatctgtaccacattttctttatccaattggtcattgacgggcatttaagttgattccatgcctttgctattgtgaatagtgctgcagtaaacattcatgttcatgtgtctttatggtagaatgatttatattcctctgggtatacacccagtaatgggattgtggagtcaaatggtagttttgcttttagctctttgaggaattgctacactgctttccacaatggttgaactaatttacactcccaacaacagtgtataagtgttcccgtttctctgcaacctcaccagcatctactattttttgactttttaataacagtcattctgactggtgtgagatggtatctcattgtggttttgatttgcatttctctaattatcagtgatgttgagctttctttcatatgcttgttggccgcatatatgtcttctttcgaaaagtgtcttttcatggcctttgcccactttttaatagggttatttttctcttataaatttgtttaactgccttatagatgctgggttaatacctttgccagatgaatactttagaaatattttcttccattctgtaggttgtctgtttgttgacagtttcttttgctgtgcagaaactctttaagtttaattagatctcatttgtcaatttttgcttttgttgtgattgcttctggtgtgtttgtcacaaaatctttgcctgttcctatgtccaggatggtattgcctaggttgtctatcagggtttttatagttttgggtttcacatttaacagactatttcttgtatcagtcagtaacattgattttccaacccactgggtaaagaagtctgtcctggacactctgggaataaaggaaatgccattcatactgagcccagtatgcagaaaataaagaagacaggtgatttcatcaggaacagtttctaaaaaagagggcaatttaaaattatttggagggagaaaagaattcaaaaatagttcaagggggatgtgagaatatttttgtggccaagaaagaaaaacaatgaacaataagaccatggctttatatcacattaaaccatggccactattgactaaggtagttagttttctctagtgttcacattaagatttgtttgtgagaaatagcatatgtatataaatttgggggagaaggatttaggagagataaaaacaattagtttctgagaaagaaattattgctttggaacaactgtatcatagtagaaatcaatatatagactgccaagggtaaactgggaatcattcctagagatcaaggtgctctggacatggtcttatttctaattttaaaacttacattttgcatgtgaaggtgaggttcattaaaaatgtgctctccaaagaatactttgctttcctttaaatgagcttcgggaatcaatgttgaaaagcaaaatccatctacacttttggcatacaatatcaaatgaaagaggattttatagcaaatctttcatatttaaaagcaacctcattacattagacattgtttcaaataaaataaacagcccctttcctgaacatgctagtatgaataagataatcataaaaagagtcaaattaaagcccctttgccaagaagtttgaagtttgatttccaaatgtttgtattcgccaccttcctctgaacacacacacacacacacacacacaattaagtacttatgattagcatattattgaagtttattatatatgaaagtcagagagaataaactgccccaccagccagattcttaaaaacacttttgctccattttcttggcctgggatttcagccaactgtacaaacaggaaggttgggaacaccatggtcaataaccaaggaaaaatataaataaattcaaggagacttggataaattcatacaatacggatacgtggaaagttgttaaagttaagggacaggtacttgaaggacactttcacgaaggacactttcacttttagagttgacatccagaagacaaccatggcttcccatagtccatagtcctgtcttaaaacattcttatctggaactgcccaaagagcagacctatagggactagcctataattttttacaagattgtttacaaacacagttgtttctcagttcgcaagaattgagactatttagcctgaagaagatatgtagcagcagaatatattagaattgtcttcaaaaatttgaagggtagacattttaaagatcgactggactgttccgtggggccccaagggacagaacaaagatcaaagagtggatattacagggatagagattttagatcaatgtaagaagaacattctaatatagcaatccatagataaaatgagctatattcatagatagtgaggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttaaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctgtgtgttcctgtcagggattgagaaaaaggaaaaacctttcctctaatcaacagggaccagtgggagataattgtttcaggggctggaatctgaggtcgaattggcactgtcgcattgatgctttgccaaaggtttagggagccccaaatgaagatctctatagggaagctcaagtaatggtatctggctgaagactatgaacaataacacaccctgaaaactaaaagtaagagcaaaattaaactgcaaagagagaaatcatggccaaaagccttgaaaggtttacaattttgatcttcttctcctctgatccagataatgcccttccttttccactgcccatttactgggtgagtcttgagtgaccaggactgttgtatttatgtctttatggatctttcagagagccccctgattcctatcctagaggactgcaggtggccaggtccaagtgctggttatcagtggagatcttcaattagtatgacctaggtaaaggctgtgggtaaaaggaacttcttagaaaaatatggagcagatgacaaatatatatcaggagcctggaaactcctgccctttggagagaagctctctcctactttcctttacccgacccttacttccttttctctttccttcctttacctgctgggtcttgggtattcaggactgttatgttagtgtctgtacagaggcttcagggaaactccccacaagcactcttacctgaaagaatttagatgaatagccatagatattagtcagcatgggaaaataagagccacagaacctggaaagaagtagggacataagcaacttcataaaaagaaagaagaaaatggagtagaggagcagactggtcaggagcttggcaacttatgccaacctaaagaagctgtcccactggccctttctgagacctaagggtctcaggtggtgaggacttctatgttggtgtttttacagaggttttaggatggacaaaaagaagagctacccttcacaaaggaaagttcattaaaatatggttggaagctatgggcaagagaaaggtccttaaaaatgaaaagggacagaatgagagattgcaccaagagctttgaactcttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggatgtaaatgttatcaggaaaagaaacagattttaaaactgatacagaaggaaaagaaccaggagccaggaaattcctgccctgtagccagaagcacaaccctaatgcacaactccttattccttactccctttctctttgcctatttgacctgctgggtgtgggcattgggtaatcaatgcagttgcattcatttacaaaggcactgaggagaccaggggtccaaccttccccacacagaagacttgtgggtggacagccccaagtgactgaatggcagggtgaagcctcctgagagtaagtggaggtgatctgtgaggagaatatgagctgcataccctcctttagtatctttaccagcgagagttagtgagggcacatctttaagaaaagagtggtatggtagatagtacccagactgaagtgctagctcttaggcctaaaagaaagaagtaggatttctgtaatcctttctccctccctctcttcttccctcccttttgttaattctacattgccattgccattttaacctgctatgggtattaggcaaacagaagtgtgatcatattcaaaggcacctatccatggagtgggcataaggtatcttttgaatacaggcaccggggtggcgataggagagttccaattctcaagcaggagagaaatgttttccagcccagagggcagattgcccagcctttatctacatcagcagttgggcacagttgatcaattttcgaatcagtgcaggctttgctgattaaggctatattatggacattgctcagcttcatatgtggttaagctggacctgttaacaaggtacatagagtatttccaccacaaattatttggatatctgatggatatttaagaggagccatcccttctttctaactttctttggagtgccatcatctcccaaacataaggatcctggcttctgcagaaaagagaactctgcccttcccctccctggaaagtaatactccgccttttatgaagaccagatcagtttttataaggctagggttcaatattttttcactcttttctactaggacccttgctattaccatggatacctattttgccccttgacactttggagatgcagtacagtatccattgtaccaggatctcccaccttgaagctctttttactggttttttgttgttgttgtttgcttgtttgtttgttttgtcttccaggcaatttccaggcttgcctatcttccagaccaaagattaccaaaagctagttaaaaatatttgttatctttaaggctttccctttcttccaaaatctttgactatacaacacagcaggaccctgccttaagtaatccattaatcagacaattcacaactgatgaaagcaataaatagtaattactcacattggaaacataatcttccctagaaaacagagatcccttagtgcatttagtgcatttgggtgctaacagatcattaactacttgtcagagaaacctaggaggagggctttcagaaataaacataaaacaacctatgcatcaatagaaaaataaaatttgattttcaaaaacgaatctaatttatggcacagcttttttttaggaattcccctgttatataacggaagacatactattttctaggcaaagcagcacaaatcagggaaaggaacatttaaaagtgttggaaaacttacttgcctatgttgagccaatctatgtaggtatggttacatcattctagaagtctggtagtcaatctcggagtctcctttacacacactggtcattttttcaatacttttggatccatgtcttcctaatgctgggctaaatattcagcatgtgccatgttgctaaaacagaaacaatgagaaacctaaatgttctgcattccttgattttgagtttaaatttgtaacgttattaatattgcattaataacctattttgcatatctgtttgattgtaccatcttaaacattcatttaaacctggggaggtcagcatgactcctacctgcttctcactaataacatgcttttcagcgagtagataatgagtgacctggatagaaatcagtggaaatgcagattgccttcaggtggagaaacaggcaggaaatccactttctccacaacactgacaagcagttttgaggctgaaggtagagaaagtaagcctcaaagagagatgactgtttaggaaggctcttaatcaaatattctgttgtctttacatgtggtagtatgaaggaaaagtcatcctaatggaaattaaatcttgcaagtgactttaaaaatcttgggttaatagaaataagtgatttaattatggagagaaaaacagataactcttggctactgattatcctaatgggttacaggcctgaataagcattccttagttcgttgaattaactactgttagtggcacacaggtaaggataggggtgggaagtagtgggcagtcaaaggtctgccattgattgatcagagctgggatagaaggcaatcaggtgagtcttaaaggagaaccacataattttttttaagtattaatggcccactccacttttctggaataacaaaatatattaataataatgcccttgctcaagatatagagggcctgtttttcaagttactgtatttctttggtaataacgtactggcacagaaacagggacttatgtgaaatgtatttcaaaccaatgtctgctaataaattatcccacaggccataggtttcacaggtattagaaaatgcatgagatttgggccggatgcagtggctcatgcctgtaatcccagcattttgggaggccaaggctggcagatcacttgaggttaggagtttgagaccagcctggccaacatggtgaaatcccatctctactacaaatacaaaaattagccgggcatggtggtgcacacctgtaattccagctgtctcaaaaacaaaacaaaacaaaaaaaaacacaacaaacaaaaaataatacatgagatttggaaatgcaacctgggctttcagtttctctcttctaagttctttacgattcaacatggcttccttctgcagtttgactatttatcttcactgaataaaggtgatagctgtatcagaaactcaagtcaaaccaaataatggtgtgatttgtttactttggagggttttcagactttggttttgtttctgttcgacggtggtaataaaaacataggtctgaatataaaacaacctagttttctacttgattcttgaaaaagaaaaaaaactttgcttcagctcatgagtctgtttcttattttttgttttctaatggagtttgacttgcaaatctgcaatttggcagcatttatttctgtttggggcttttggtatagcttggctcaagtccctggttactgtatgacagcaaccaagccaaatggctgtaacattcaatctgcccaattaaaaagcgttggttccatgccccctttggtgactcagatcaggcaaatttactgttgttttaatcttgattgtactcaattattcaacccatctctcagagctgatacagataactattttttaaaaaccttggggaattgtgagtgttgtcacctggctgctcactccttttggaattcttcccttggaaataagagtcagagagagtaggtctaaacaacttaatgtagcaactcacagagccagaaaaagataatcaggctacgtagaaacttaaggagtgcaccttttgttttttccacaaatattttcttctatctgctctttttgaaataaagtatggttcttaaataagaacagcaagaatattcttccatggaatacctagactcaggagttcatttattttcaattttacacaattaggataaatgtaaaggaaacagtttctgcacgtgcctaaggaattcttgcccatacaaataacacagcttacctttctctagagaggcttccatgagcacaggctgggggagctattccagagctacatactagctctgaatagagcagaagttaattccccaacctacccccctgtctctcaacccagatgatagccagccctccaaatggtgcaggcaggatgtccatttgatgtagtcatcacctccataatcagagtaaactagaaaaatattataaaatagggaaagtggttcttggtgctgttttctgccttttagttcctctctgcttttccttaagctgtagacctatactgtccaatatggtacccactagccacgtgtaactatttaaattgaaaataactaaaattaaaagtaaatttaaaattcagtatttcggtagcactagccacatttcaagtgctcaatagacatgtgtggctagaagctaccatattggagagcagagatatagaacatttcagaaagttctatgagatgttgcttccaactattagttcttttagcttcttgagcataaggaacatgttttccacatctccattccttacagcaggtaccacaattcctgatacaactatggaattggggagaaactaagtgcttactatgttgtcgtgagctatgtcaaattcattataagcaatctctcatttcattacctcaagaacactataaggtgggtcctattaccatccccatttttcagaggaggaaactgagtctcagtgaggttgaattatttgcccaaagtcacacagttaataagtacctaaaccaggtctttataacttcaggatctatactcttaacaactgctgtgtacaccaaaagaaaactgcacataactacaaatttcaacatgggacagacaggccccttccagagcattggtgactaggtggcttctccacagcactcatgctggccaaggcagaataaagacaatttgagatcagggcctgagcatgaagattggggacttaaataagtgtgctgatttgtgtttgcatatggctatcagattaagtggctatctgactacttctctaatgaaatagcagcaaattagtagttttatctgccattttgcatatggagaccattgccttgaccccaatggtaaagattagtggaacctaatcatttcatgaagtcaacctcacttgctgcacttatcagaagcttctgtaacttgagcttccatggcgtgcagtttatgccaggacacgcaaatgccagaaaatcaattttcctgcagctttcacagtcagtgtgtttgccagacaaaactgcagccagccaccttttttaaatcagcatagcacctttagaaataatacttaccagaacgctcctaacacagcaaggaggaaaagacttaaatctaaacccaactgttcaaaatcgagagccacaggagaaggtgaaatatgaatatattgaaagtgaacattttagtggccccatttggcactgtaaagtattctctgccaagcatctgttgagttaactttaattctaatctgtgccacagtaggactgaaaacacttaatatgataccatacttcctgtcacccacatgtgcccaggccctcacgtgcccctgacatatcggggtggcactccacattgcctgcctgccccaagacctatcttgattcttcttcctctggtattcttctggcacacattctcaaataaaccaaaccacacaaaggcagtggatgtggggtcatgttaccttcccatttgccatgagtgcataatctactttattgaagacttactacttgccaagaactgttatgggtgctttacatgaattatctcatttagtagtctatctccatttcagagataattattagagtcttagagaaatttaagtaacttgaccaagtcaaacagaaggcatgatctctaatggtagcatttagggcctgtgacaagctagtgagttatcatattggtgccttttacctcggagcatcttgcacaggtttcaaagctgaaccaagaaagaagatcaaggttatataaaatcatgtcaaaacaacaggtcaaagaagtaaacttcactcaattcactagttttggtcaatgtagctactaacgatctttccactgggaggcagtgcagagtagtagaaaaaaacaacacaggtttttgaaagccagcacacctggatttgaatactaattctgtccccctgcatctatgcaaacttggaattataactttacctctctaaactctggaagagagaagaaggagaatatagactttggtgtcaaatgagctgggtttaaatctcagctacgcatttattcattcagttaatatttattaagtacatgctatatgacagccattgttgtaagggctcaaaaccaaagtccttgtaatcactgtagtgggtgagacaaaattaaacaaattctgtaaataacatatatgtttctgttggtgttaagtgcaatgaagacaaaaagctggtgaagagacaaaatgttggtgtggaggtgctatttcatcttggctgattgtggaaggcctttctgacatttgatcagacaccctgaatgaaaggaaggagcaggccatgaaagtatgaggtggagttgcgtggagagaaaagcattccagatggaatagcgttagcaaaggccctgacatgggaatacacttggtaggtttgaggaagaaggtccatgtgctagagtgaagtaagtgagggaaagagtggtaagagatgagagcagtgaagaagacaaaccgtggtaaaaattctggattatattctgtttgacagaaagtcacttagccgactttgagcagaggaatgacatgatctaatctatgtgtaaaaggatcaatcagactgctatgtcagggcaaaagttgagaagcagggagacagaccacttaagaagtgattgtaggccgggcatggtggcttatgccaataattccagcactttgggaggccaaggcatgaggaacacttgagcccagaagttcaagaccagcctcagcaaaatagtgagatctccatctctacaaagaaatttttaaaaaattagctggatgaggtggcacatgcttgtagtaccagttactcaagaggctgaggtgggaggatccctgagcctaggaattcgaagctgcagtaagctaggatcacacaagtgcacgccagcctggacaacagagagagactctgtctctaaaaaaaaaaaaaaaaaaaaaaaaaaaaaaaaaaattaattcaatttaaaaaagaagcaattgcaatatttcaggtgaacaatgattagcttgaattaggaggagggtagggagaagtggttgcattttgaatatagattgagctgacaaggtgtggaatgtgaggccaaagagaggagtcaaggatgactaaaaggattttgacctgagcaactggacaaattggaaggtgctgccattttctctgatggagaaccctagaggagtagcaagcaggggtgggggagaatcaagagatccattttggccatgctaagttggagatacctatgagatatctaagtggagatatcagttaggtagatggataaatgaatctaaactttagtgaggtcagagctaaaaatttaaccagctgtatcaccttggagaagtaaaataacttctataagtattagttaacttctcagtaaaatggagataatattggtttcacaaggttgttttaagaattagcaatcatgtatataatgcacgaagcaccattcctgttgcatgtaagtgcttaataaatggtagccctctcattgtcagtatttatgcactaattggtagctagttgttgcagctgtaggaccattgttgattattctaaacacatcgttgaatattagaatcacttaggaagcattatttacaatgttggccccgcctcaggccaattaaaccagaatcacagaagcagtcatcagtagcttcccaggtacatagtatttcctgctgacaagctggctttaacagaacttctcttcagattagttccagctcaccttttaggaaactaacactccccccccaaaaaaaaaaaactctaaatggaaaatttgggctcttttggataaccccaagcaaattgcttcttcttttcttcattgcttttttctccccttagtaagaaaataattctccagggacctggaagtaacagccacagtggaaacaaaacattgcaatttcaggatagatttttcttcttaatagaagaacattttcccgctcatttcctaggacctgtattgtcaggtttggcctccacactacaattaattgattcaagaataacaatagtattgaacttctcttttgaatatcttagtaatagaaaataaaaatacatttaatccaattggtcaatggtaattggctttggattgctggagatgccgtttcattgaaaaatagaactctagaaggctgagggaagtgaccttggagtgttcaatagtgatagcagtcctagaagcaatccttgattgagagtcagggaatttgaggctttgctctagttagtagtgaaagggtgtggcagacacactttctttgtgacccattctctgtcttgaaaataggttctgcaacttttacactgttggtgggactgtaactagttcaaccattgtggaagaagtcagtgtggcgattcctcaaggatctagaactagaaataccatttgagccagccatcccattactgggtatatacccaaaggattataaatcatgctgctataaagacacatgcacatgtatgtttattgcgacactattcacaatagcaaagacttggaaccaacccaaatgtccatcaatgatagactggattaagaaaatgtggcacatatacaccatggaatactacgcagccataaaaaaggatgagttcatgtcctttgtagggacatggttgaagctggaaaccatcattctgagcaaactatcaaaaggacagaaaaccaaacaccacatgttctcactcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacatatgtaacaaacctgcacgttgtgcacatgtaccctagaactgaaagtataataaaaaataaaaaataataaaaaaagaaaataggttctgcaatctaaaggtgaaggtacatagcaaagtcaggttttcaacacacacacacacacacacacacacacacaaacttctcctccatacccaattaatgtgtccaccattaggctatcattcctttagctgtggtttgatcctatgaggagatcacacttttgtatattgttcatcatttctacctcagtgtgaatgtttccaattcttttctgagcacaggatggggtggggagggcatcttttacctgataaggcaaatgaaagagaggtggtactacccacgcaggggagtggaaaatgaggagcatctgtgaaaataaaagttgactcacagtcttggcttataacagccatataagttcaatacataacgttatactccttatatattttcattctcaaaataaggagaaaaaaataatttgtcaacttctggtttaaaaggtagggttttcatgtggactaagggtaagacactttagtctccaatcctacatttcagggagggaataatagaaatatcatgccccttgaaatgatgctaaagtataagcatcatttcaatcagaaagcagaatttctgtgaagtcatcccaaccctaccacatggcttaacctatctaggaatagtgtactgtttgagagcagactctggagcctgaatgagttcccagatccaccacataccagctgtgtggcattaagcaaactacttaactcctctgtgcctctgtttctgcatgtttaaatggggtaatatataatagtataatctatttcatagagttgttgtgagaattacatgagttaacacatgtaaaacccttgaaatggacctggaacaaaaagtatgtattcaattaaatgttagttatgatgggttttcttacttaaagatggcttaatcaaagtccatatagcagagtttctcaaccttagcaccgttgacatttggggccggataattactggtggtgggggctgtcctgtgcattgtaagacatttaacagctccgctggcttctacccactagataccagtagcactcctctccccaagttgtgacaatgaaaagttgttgccaaacgtctcctgagaggcaaagttgttgcttactgagagacacaggggtagagggtactgtttcccttcctccattctcccagaatagagcaatggtaccttagaaacattttctgaaagaatgtgttgactctagctttcaaagtcacatggccactggcactattttcaacccattggaatatgcttagtctgactcagcaagagaagcagaagattaatcagaacagtaatctgactttgcataccagagagggacactagaaaggtctcaggaaacttagctgattgtcacctgcacctttggaaaggagacatcagaaatagcccttcttgaagtggaaggaaacatgtccctggacttgtgaacacagtttgaaactgttaagcaaagtcatttacatttgagggcaaaacttaatgtctaggcgaaaggtgacctccaactccaatgaagttatctaaaagcccagccctcaaaataactcagtcaggctcataacacacaagtagaaaaactaagaatagaaaccagaatttctttcccttcctttcccctgtgttcaccaatacacagtctcatgacagctgctgattgtctgaagcaaaaggacacagacaagcagtacttctctgaatgttaaaaatgtgcaaacctaagtgaaggaagaaagtgaaattggggttttggccatgcttagaaatgatatcatttgttgtgtgccttgctccaaatcaaaatggaaactatttcctttactttagggggaaaactgtaaaaatcaatgattcctttttccaaatgcaccttattagagctattgacttcttcaaaacataagtggaagaaaaaaatgtgtccgatgcatttggcaacccagatgtatttttcttcttttgcctcaaattgctctgatcactttacatggtgaagtatggacactaagggcctatagcagggttacaatgagtgacaagaatgttcactaattccagtgccttagtgagaggggatttggagttaatttacaatttaccccaacttcaaaaaaagcttggacaagaagcaaaaaatgtttttggaggtgagttgccctctttcatcaaaaaggatattgtcagtgctaaagcaagcaaaagaggctggggttatcacggggaaagatctatctgaaacctttctagttgacttggatagtgtcccagccttgttcctcattagctgtgtgacctaagataagtagttgagtcaatggcaaatctttgaatttctgtattggagactcttcaaggtggagttctggttaggccttatttggaaactgcttagcaagcacacagcttttttcaggcttgatttatactgagggggtagattcatggaaatgagtgagtaggctaaagcccactatggcacctcttggcattgccactgcacttaccctcccttaccctcagttccatcttttataaaatgggaattcattctttcattcaatatatatttatggggcactactgggcacacacactgttctcagtgctggggagtaagcagtgaaaaaacaatagctactgcacccacctcacagggctgctgtggggtttaaatgagatggtgtgtgttaaatcaccctggcacccagaaagctttatggaaatataaagtttaaagatattcagctatctcctgcttctagtcatgacaaatctaaggcctctctgaataagggagtatttgaaaagttgtatggcaggtaattctcaccacaaaaatctcctcttcatgagtctaaaccaagtgcttgagatttccacagttggagtcttaacttaaagaacttaatttctgtagacctgagacttgtgactacattaaagaacttcagaatgggcccaccccagccacaccttacccctcccttatagtcctaccccacccaccctagtaggacatgcaagcacattgtcctcttccaatcccatcaaacattagaagaggcaaagaagaaaggaggaaaagagggggaggtcaggagctctccagagctgtggcatcattggccttctttccttctagcaccttgccttgtaaggatcacctatgcatatcctagtattggtcaattctgtgaggcaacatttgctcctgaatgttagagaaggcacacaaggcacacaggggtcctgtaagtgttccgttcaggcagatggaggcccaaagccacccttttgaatttttaccacctagacacctgagcctttaataaaagcagaaattacagaggacgctaaataattcagaagaaaaagcagattgtagtttataattatattatcttaaagatacaatctaaagaaaaaatggaccaaattgtcaagcaagaagtagtccacaataaacttagagacagcaaaatgagtgaggaaaagtcatttttgtttgaaactcttgccatatttccctttcttagtgtctcatacacaaggcagccttctccagcccttgaaaggcaccttttataatgccaagaagcccactctcctttttggggtatgaatcccctattcaaatcaaaatgaccccttgctcaggggtaacagaagccattatactgttagtgaacacctctatgaggaccatgactgctgataccagaaaaggggtacaagttatatctctgagggaggcagacagtgaaacagggagaaagtggtagaagatgagcaccccaaagtcaaatctagcccctttgacatgtatgtacaaggctagtcctgtacatacaatgatggaaatggacaacataggcatggtggcaacagtgttcaaaaaaataattacatgcataaagctggcccattttcctttgaggaacactggaatacaaagtgcctaaaagtatcttccccgacctctccttcattacatgttggggaatagagatgttacaaacaccaatactgtctttacaaattatgtaatactttgtctgcattctgacagtaaattaatagcataaatgaatagcatattatgcttctgttgataaacatgcttccaatttattagtccattttggtaattcagttaattctgcactatcaacatatgggaaagtggatgttgaaccctgtcaaactgaggaattgtgctcatgtcaagaccacgagaagagatggttccattgtcctttatgttaatgtcactatatcaagcatattgtgctcaatttgggaggccacattttaggagggactttaaaaaaatgaaaaggtatctagaagattgtgaccagaaaaggtgagttgaatggaatttgtgtcataaaagtaacaaatgaaggcccttaaaatgtttagcctgcaaacaaggcaattaacaagtgacactgtggcagtagattccaggctgtacatcgtgtcgggaagagagcatactgattctctattgctacaaagagaaaaattaggaccagtaggtgacacttcaattttaatattcactcattccaccgacacatagtgagagtttactgtgtgccaggcatcatgctacacacccgtggtgcggtgacaaaaaaagacatgatccctactctcaaggggctcagatttggctggggataaccattgcaaagcaaaataatcagtactccctacaatggagaaatggaaacagagaggacgtactgcccaattcaagcaggagacagaagtaggattggagaggagaggctttcattaagaatatcagccaaaccaaaggaactttctatcaacttgaattgtcccaccatggaataagctacttcctatgcctcctctgagctagggagtgcctcttcaccagaagcatttaagcaagaagctatcacttcaccgggtgagaggctcaacaaaatggtttttaaggcgccttctagctctaaaattctgttattctactgactccaagtggatatactattgaccaagtggatatcctattttatctcacaggaaagcagaaaattttattcaccaagtttccccagtagcagtgttctggttaatgaggattttaatgtataagcctcaacttaactgcaaaacataaatgtaaaaggaaaagttgccatcctgcccattctcctacaccaacaaaatttttaaaatccaatttcaaatgatagtaatttttgttgatggcagaccctggtcattcaccaggcatatgtctggagatccaaatatacaaataatacttaagcatgtgatttctcccataaaatgaagtaatgattccgtaaatatggcactgaagtaatttataataccattaaaataaattctgtcagtaaaacaaattatactttctttattataaagatatataatgtttttcccacttcctgtgtttcagggattcttctaagtatgtattaacccatttaatttctcccaataaacctttgaagtatacacttaaaaaatcatcccattttatgggtgaggaaattgagacacatagatgctagataatttatgtacttagcaagtgtgattcaaacccaagcagtctgactacatgttcttaagcactgcactatatagttactttgaacttacataaagaatagttttatcactagagagctactatatgcacaatgactaggagtgaacaacaccgttgcaaagagacacaaggtctaagtggtaggcttctgtgtaccagactcacagggcccaagattcaaatcttcacatcaacaaaaagacagatttcttcatatatttgaccttcatgatgtattacgaatagttagagctacaactgttgaatccattaatgctaaggctctaccatatctgctatttgggattaatctgttccttctccatttatgtatttctcctttggattttggttgctaattatctagcagtgcttgagaatttcttatggcctttctttataaccattgtttgttcctttttaggtacaaaatggtgctctgtgggatgaatgaaatgaatggtggtgggttggagaaaaatgaacttgttattacacatcctgcccataaattgtttaacttctcccagatgacagagctaagattcagtcccttttattgccttctttatttcatccaaaataagacagaatgcaaaaaaaaaaaggaaagaaaaaaagaggaaatgctagttttctttcttctttatggtctgaatgttatactgacacttaaatactagttggaaagataaacgtttcagcttaatttctcctacttatgagtcatttcttttcccccttctaatctttttgagaattcagtcatcaaaaagagtccaatcatttctgccactaactgacttgtcatttaatgcattcattaatatctgccacatgtacaccatgtgcatttaaagggcctgcttcaagcactgctatttattctcctagaaatgcatcattacctaaaggaataaaccttttaacctgtatcagcaatcaaagagctcaagtaaatgatgaagtaaatgagtccaaattatagtgcacttggatcagaattcatggacccctttgcccttggcttataaatttatctttggaagcaatggcctgtttgcaaatagtgtaaaagacaaatatgtctgaagtctccccttcctggacccccactttgtattcaggtctggttgggccaagatgaaaaacacaaaacagctctttataaatgcacaaaaatgcatacccactacagggttttctataatgccaaaaataatggaaattatctaagagcccttcaaaaggggttgggtaaataaaacatagtgtgttcgtagattgaagagctatgcagccattataaaggaaatatgcttattctagtaaaagtataaaaaggtgcaagggaatagtaaaggctaaattcagtatcgtggttacttttggcgagtagagaagaatatgtatttagggaggggtagataagcagactttaactaacttcataatgtttaatttgttaagctttatggcaggtacacaggtgtttttacattatttttatatctttctgtgtatcgaattattgattattttttaattccttgggtaactaactaggaaatgtctactgaaataaagtccttgacaatgtatttcattacaatgcttaaaaattgtcttatgtgtcaaaagaggataatgtaatatggaatgagcataaatgactatgggtgagattttaatcttagaaggccttgattgttagggattatttggggggaagttattgatgtgggcatcaaaggcagactaagtagcatttaaaaagaggattgaaaagcatatatccaaattggtttagcaaggtactcagtgatttttagaaaaatttcagctctagaattctacagtgctataaagatagtgctggtagccatttttacctgaacttctgatatctttgaccagcaatctggtcgtcaccatggtcaagcctaagcttcagttattaagaaaacttatctttagtctgtcatgtatagagtaatttgctggctgccaagagggctagcaaaattaataaggtatggactttgtcctcaagaaacactcaagtaacaggggaagacagacacatagtcaactcaccctactgcaattaagctctatagcaaaggtatgagcaaatggctttgggaggacacccaaagaagcacttcgtgggggcaggaaagggttaggaaagacttcacagaagacatgacatctgctctggatcttgtagatgaataaggtaatttaagcagaagcaaaagcataaccaaaggcataagacatggaagtggcttatttcagtgaccagtgaatagcccagcatgacctaatcacaggagagtgtaaccaagatcataagcactcttgaatatcatacataagagtttggatttttttttcctgtaggtattagggaactagccgaggattttaaagaatgaagtaacttgattaagtttgcattttggaagaatcactagaggataaattgaagagagagatgaagcagggagactagttaggaagcaagatagtctagacaaaacaacgatggagcctgaccaagggagggcaatggtaatgagaatgaaaagaagatgagaggacagattttaaagtcattactatattagaaaaaacatggcagaatgagggagtgagggaaaagtaaaaccaaaccctttagcttggaggttaggtggtttactgatagaatgtagaaggaaacccaggctttacaaggtatataatatagatttagttgggaaaagtttaatctgaaaatgtctacaggaccatcaggtggagatgtccatcatcagggcttgtttgctatcttcccaaaacacatctggaatccagccttttctttctacctccattgctcccaccctagtccaagccacagtcatctcccctctggaatatcagaatagcctcctaactaatttccctttcttccactctgacccaactcatagtctattctccatatggcagtgagagtaatctttaaaaatttaagtaagatcttatcacacccctcctcaaaatcttccaatagtctcctataacaggtagaataaatccaaactttttaccatgacctacagggccctacaagatctggcctctgattatccacctaagctcatttcctacgactctccctttttctcatttaatttcagccacagtggcttcctttgctataatttgtgcaaaccaaatgtgttcccatctcagtgaagagtttcactgactctgtgagggcttccatgagggtctgattgccataaacacaatgcttaatgtccctggtgatccagctgggcgaggtggctcaggccggtaatcccagcactttgccaggtgaaggtgggaggattgcttgaggccagcaatttgagtccatggtgatagttctggaagttccagccccccctggaattatttgggcaggtccaagcaggccccaagaaagatgcaacacagccggccaaagtctagagaagagcaactaaataaataatcaagaaagttggggtgggggccaggaaaccccacaaaaagacatttgaaaacatggtatatgtttatggtttctgccatgctatctcaacctctggtcaagtatcaccttagaatttttttctaggattttcattcctaaggacctagctcccaagtcaattggaagtttttgagtcattgagtctacaattcttttatagtctccagaatgactaacatagggctagaggcacagtaagcatttaatatatgttctagggaccacctgaattgaaatgaaatttaatgggattatatgcaaaattcaaaaaggtaaagatgaaggagacttgacttggcagaaagaactaagttttggtttgacctcaacctgagttgatggaaagactctattgactctattatattcttccagtgcttctcaataaaaaaaaattttgttgaaaggatagaggaatgactaaatatattaatgcaaattcaaacagcattggtagaaaataatgctccaggtcaggtgctcacgcctgtaatcccaacactttgggaggctgaggagggagattcacttgagcccaggagtttgagaccagcctaggaaacatagtgagacctcgtctctacaaaaaaataaacaaaattagctgggcttggtggtgcacacttgtagtcccaggtattcaggaggctgatgcaggaggatcacttgagcctgggaggtcaaggctgcagtgaactaagatcacagcactgcactccagtctgggtgacagagtgagacgaaagaagcgaaggaaggaaggaaggaaggaaggaagggagggagggagggagggagggagggagggagggaaagaaagaaagaaagaaagaaagaaagaaagaaagaaagaaagaaagaaagaaagaaagaaagaaagaaagagagagaaagaaagaaaaagaaagaaagaaagaaagaaagagaaagaagagagagaaagaaagaaaaagagagaaagaaagaagagaaagaaagaaaaagaaagagaaagaaagaagaaagagagagaaagaaaaagaaagagaaagaaagaaagaaagagagaaaccaaacagaaaagaatgctctaaaataagaagcaaaagtttgttgttgttgttttttcattctgttctggtcatttatttggggtaccgtgtctatttctatacactctaaatagagacagacattaccaactacaatgtgcctacgagtggaaaaccaaagttgtgagagttctggaaacaatatcagtcagagtttcacctgatgaagagatgagaaggggacataataaaggcctttcaataattaaagaaccgttgtacattaaaaaaaagaaccgttgtaaaaagggacagaattattttacatagctctaggggatagtaccgggggtgggggtgtggattaaaatactacctattgaatacaatattcacaaactaggtggcaggatccgtactccataccttagcatcacacaatattcctatgtaacacatctgcaaatgtaccccctgtgtctaaaataaaagttgaaattgtaaaaaggaatgggagttatagaaaaacaaagatcatctcagaataaggaggtactttcttacaataattgatatctcatgctggactgggctgactaaaatagctgtacactaccttataatggtctttgattaggcatatcctgctacgattagataaacatagcaggatattgtagaggagattttttcattgagaggaaggttgaactaacaaagtgtttttcaaataagattgcaaccaattagtggggccatgaaatccatttagtgggtcctgagcaacattatttaaaatgaattagaatagaatagaaaatatcagagagcatcacacatagcaaggatgagtgtggttttgagaacttgttttggaaacaatgtttacgtatgtatgaacgtgcctactaggttgcagtgtaacgtgttttttattactgtggattgcaattaaaaaaaaaaaactactgcactaaccctcctccagactgaatatctggcagctctaagaattcttatctctttggtgcagagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaaggtgggtggaataatataacaatatccgtgttgttatagtattccacctaccctgatgcattttgttgtcattttctttcttgtggattttgaggtaacttttaaaagtttaaaatctacaatattccatggagttaaataagacggtaaattatggtttcatctatttaatgcatccattttttttaatgttctctctctgtgttgtcctctctgactgtttgttgctgttttaattttacagttcaacggctttttcaatttaaatggtaaaagccaagttatggtgccatatgtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttatacgttaacgatttcctaagcatttgtgcattttcttacaagttatgttttatcgtttcaagaaatgctgttaacctggcagtattaaaactgaatgagcaaggcctcttggacaaattgaaaaacaaatggtggtacgacaaaggagagtgcggcagcgggggcggtgactccaaggtcagcctcaatgtcaccacaaccgggtacccttagtgacgagtaatcggcaagactgttatcttattattgaggagagagcacaagactcacacataaagtggaatgaccaggttattcccctgcctggcagctttgggaaccaaaaagactttagggcactgcccacatttttgatctaacttgggtcccttcttcaactcccagacagaggctccaaccacaccctttcccttcctttacccaccagtttggttgccttatgaaagccatgatgtgggtttcaatgccctaggctttcaagagtccaaggctttcctgtgagactgtccccgcctgcctcagttgagtggtatgaaaaatcagatccatctactgaaaaatcagggcatagccttttgttttctaggttgtgatggttgctcacagaggttggttggttgagtaagggtggcttcttcaattatgtgtctgagtgatgagatgttgttctctatatgtgatagcccatttaagcaggccccacttaacttgaaagccaaataacaagctcggtttcaagttaaatggggtctttcttcaataggccaccccatatagagactttgcagagacattttgtgtatttaagcaagtgcgtcgcctaactgtgatactatatgtgtgtatgaatccctgatttagcttctccttagccatgttcttggttcaggtaggtctaattgttatccaggctgccatcatgagaaaacccatcttacttggcattcctttgacttctaatgctctttggagctagaatgaatgaatagccatcatccaagcaacaagaaataggggcaagctcagaagccgcgatacaaagtcatggaaacacacttcgggtaagtacaggagaggacctgaaaatagaatcctccttggcccaaggggcatgagaattatattgaagcatgtaaactcacctcttgtacgaccaagatcccatgggcatcttaaggtgaagaacagtgtttcccaaccacagaccaacagacaggcaagccaaaacttttcttcttcagagacaatggttgcacttctgctcctctctttccctctctatccctcaggatcctgatggaaaagttagtttgccagtctgcaaatataatatgggtttggaaacactgatccagaacactttcaaagaaatcaattttaaaagaactttcttcagcaaataatcttaccaggcattggcatggccttttatcgtaaaaccttgattaaccagaactcacctaaccagtaccccaactaactgaattgccccttcagtacttcacattgatgagaaagcagcaatagtattccaaaaaagaagactgcaaggaattgatttttttaaaaaatacttaccaagagatgacctatggttgggtcacattcggctctttctcctctatcttctctccatctggattgaccctcaaacgttagaggctgcttccctgaggcgagaaagtagatagaagcattttaagaaaaactgttattagccaacaatgaacaaaatggttgttcttattgaaaattccattcatcccttatggattccaattaatcaaggttttactatgtgtcaaaaagcagtaactttctttcccaccaatgtgaactgatgacactgacaatttagccaagcttttggctcatttcatatttacaatggccaacttgatggccaaagtatttagcacctgtctttttctcatgttatttgcacggagaacctaattgtatcattgaagtgagttgcagaatgaaaattgagctggattggatgcattgctctcacgaattcatcattcatactcatcatggttaaaaaggagccatggactgtaacaagatgactctaaaacatccacatgatgccaagtgcccagaagttttcagataaccagacgtttgatgttatataaacaaacaaaaaaatctgcacatatttggctgactttttacttttcacccagatgttttggtacatgaagaccccaaaactttagaccagctattttttcattacaaccagcaatcaagctttttttccctcagctagtactgctgcaaagttttttatcaagtaactttattgacagctcacgatttccagattatctgaattttgatatgcaaatagaaaaatatttcagtagatcctaaatgttttcaacttctctaaccatagtgctacctgccaggcatctttcaaatcgctttccttggtcattcctacagccagtcttttgaaataagtcaacccttttctcaactatggataatagtatgatcgatcagtgctgcatacccaacgattgcttattccatttctggattaccaagaagcttgcctttgtcttcttccttcttgctacctgctgttttctgagagtgagcaagagaaggggcaagagatgaacgtgaatctggttaccactacgtattagtgatgcaaaaaaaaaaaatcaatggagaaggaggtagaaatagcagtaaaacctcattaatttgaagccctctaattaataatttgtgataaactagacagggaccagtctacaagttaactttatattatcaggcatgaggacaagaaaggtttgttaagcaaatgaagagtttagactggaatgtcagttgaattttttcttaagagaacaaacccttttcaaatgttagaagcacttattagatataatcatattcgttacatatctataggctaaagtagctctcacgaggatctccactaaggcaatgttttatagtcagtttgaattacaaaatagacttaaagtaataaaattgtcattctttaaacctattttgtaatgcaggacttgctttactcattcagacaatcctttccctctgttcctccaaatcagtgaggttttactgtattagcaaaatgacttgagatttacatctcttcattgtgtcccatctcgttaacatgaaaattgactgttgaatataccatcatttcacagagaaagtgcgatccagagatggtgatgactttgagaaggtcacacagctaatgctgtcataaatctctgctgactttcagagtcacctcttgtgataatattgcagatggcaatttagcactaccacctatccaatgagcaatgtgaatctgattgcaagcgatatgtttccataagaatcaggttcattcgcaactaccttggttactaggcaaaaggcatatttaagctgttccagccctcagtactgattactaaaaatgacaataatcacaacgcctgacatttataagtgcttttactttttcaaaaacactttcagacctattatctctgaaaccagaagagggagaaatacctgtatcacttatctttctgtctctctctctctctccaacctttaactaatgataaatgggcaattatattaagtcattgactttttcttccctggcatgagacattacacattctgagattagtctagaaaagttaccatactatggaaagaaacagcaaattttcaggctgtcgtaaatgtgcatgagcttaaactaataaaactaatgttttattattttattttatttttatggatacagggaattaaaaacaaggtcagtctctgaggcagcccctgaaccatacctacaagctgaaaccagaatactccttggctttcccaatttcccaaacctgagctaataggacctaaacaaaacagacttgatcatttcttgatgaactgtaaatgcacatgcaaggatcatgtaaattagaactgtgctttgggaatttttaacctgcaaatcacccttttgtgttcatgctttattacaatgtgtgtgcagatgcagtaattaagagccagtaggttgtttcagtgataaacccagatcaccagggatttgtgacatagccagtgaaagtctatcattgtaaatcacagcagaatggaggatttatgtacagaactaccacataggcacatcagcctccttctgcagctgcctgtcccctcaaaagtttatgttcttatccaccctacttcattcccttaatcttgggtaaagggcaccagcttcgctttcccatctagccttaccttacaagatagggtagggtcagtgaaacgagctatttgtgactgaggtggaaagttattaacaaaccctacccaacctcaccacagaattataccagactttagtcctctctagggattaaaatagactcccagtttccatatattccaagatgaaaatcagcacatgtgtgctcttgggaacattgtaacaatatttaaagggaccattctgagccccttgactgcaatgataattgtaggataggtgggtgccttaacttgagaggcatataaggaaatgagggaggaggatgggatgtgcaattgaacctccattatttaaataaatggtaagatgctcattatgacttatagaatattgatagagaaatgcagttttactatatcttcaaaaatatataggaactagaataaactgaccaatgtgatgctaggaaaaaacatagggaatttgtttaaatcgtttcaaaaaatgcctgcaattaaaatcagtggtgtttcctttcacatgggtgctcttaaggtacctaaaaagagtttgttctctgaagaaattaaaacatgttcctcctccctatcactagctatctttgtttttttaaatcccatgcatttgcttagcaagtcttctcttcaaagatagtaaaaagttacactctcggacagcccatttccaaaatccctcagcttcatatttggtggcacatagatgaatgaggttatactgtatttcccattggtatacatgagatcttcagttttgtgtgtatttcttcttcttccatgtatgtctacaattctcctctcctatgccaccgtctcttaaccacttctcttccacacccagaattctttgactttcttgggccgtgggtaatggatatgaatctgcatctgcctttgcctgcaacaaaatggaccttttattggcaggagccatccctaaaggttgacatttcggatactcagggttaagatggatcccaatgactctttattgacactgttatgtgtgtaggcaagaatcattacagatcgatggcacttcctgggtcttagcagaagttcctgtgaatcctcaagactctggtttgggatcgaggagtagggtgagtatattgtgctcttcgttggtttgcatgattctatgctggtactgcctcctggaagtatgaagaacctgacagttttctttcctggtagtcactaaatttgctccttgaacttactcaggtcttcctcccaagagcaaatcctcactttctctcaagtgactgcttcaagcaagggacctgttgccttaagaactgaaccagtccaatggctgccaaaaccattgattttgccaaatgatattaaagaataaattctaccaccggaaaaaaatgtaatccagaaagaaaacacttttaaaaaataattccattctaatgattttttaaaaaatgaactatggccttaacatggtttctatgattaggacattattatttgcctttggtgttatcctgataacatgaatgtgtttcttattgacaaataatgaccaaatgtccaacaccagagctacagaaagagccacaggaatgaaaagcctgaaggtaagaatgctgttatacaattgccaagaggaaagatgccattgcagtggcagacagtgaaatggtgtatgtttattccctttctgccctttgaagaccaaatcatttggtttcctttcatttgaagagaaggttatacacaatctctgaaaggtaggacagccatggaaaagaaacatgaaaaatttgatgcaattgaaatatatttggtgagggtgggagttggggttggtggaacagggtgggggcaaatttcttttacgaacaattgaattccattctcttttgactttctagagagcggtatagcatttggcccttggcacatgaggctgatccccattgatcagaagtggcaaaagtgttgtccaagtgctggattcacctttttgcctaatttcatctagcattgaagcaaatgtttttcaaaatatatacctaaggcaatggcattcatatatatatatatatatatatatatatatatgactatttgtatgtcctgtctaacatcactgctggaagggcagatgtgatgtgtagatgctagaatgtatgctaatagagggtggtatatgccctggcatggcaaacagatctgatttcagatctgatatatagacttcacttgttgcaatctagctaaaactgattatttttctatgagtcatggtcaagggatggctattggagaataaagaggatgttggcacccatcagattgaactctcaatgcatattttgtctaggatcaggggaatgagttaaatgtcttcagaaacatacatcatgtgagtttctggtaccgatctgtttctctcttctcattctatgcttctctaggtgccattggaatgaactaaagaaaacacacttatatatgataaaacccaataaaatttgatagtttgatctttcaaaggatcttaaaccagagttttcaagtgaatcatgccaattatgtatttgagaaagtgtctatggccatattttgttcaaaacttagcattttccctgagccccttctctctgtcagggataaattgagtaagaggtcttcccagactattgggttcaactactagatggagaagttgaacagaggtccagtttggcagtttagtagaaatctatcagtgaaatacacaacctatggaatcaaggggtctactgctctgtatttgagaggttgtaatttagaaatgtcactggctttacccatgtgtgtaagagttgcttctggggctgctgctgcagcatagatgctcatcaataggtttcaatcactagcattgttaggcccttagtgaaatgactcacagctttcaactcttaatgttatatgcacgcattattgaattttctctttgcacttatattaaattattatcccaatagcaaggagttaaataggtttgagctatatttgtgaactacatgaatataaatactctctcagagatggtttctagcagctaagcactgcataactgcaaatcattgtagctgcccttgttaaatgaggattatttaggttgccagagttcagtaatgccagcagccatatatgcacatgctcccacgttgtacagaaagcccaggctgatccaaggatagaaggattgaaataaaatcctcattttcctggaatcctacattcaggaacccctgtgaaaacaaagggatagagatttgttttaaaggacttcagacactggtgtactcaagggcatattctgaactgccatggccttaaacagctgctatatggagagataaatcccttcattatacatatcccaggttaatctacagaaaagaatgtaaagtaccacatagtaaattctttaatacagcaaatattcttcttttgcttgatcatcaattggcttcagctaaataaagcaagaccaacctgggcagagatgtctgtgactgcctgcctgtacatgcctgttatgtcctgggtgatgctggggcttttccagagaatgctagagaagcaagtgagtgattgggaaagatgctttgccatcatgaaaacctgaaacatcttcagtaaaagagttagcaaaagagaggatggctgttctccctccattgggccaaagacatttctaaaaagttgttcccaaaagatcactagataccaagaagcaggtgttagtaacttagagcaagggtttggttaagggatagggtgagggaggggcttccagcttaggccgtgataagtttccattctcgtcatccagataatgtgttatcagagcagatttctaattgactatgcaaatgcaccacccttgctcatacatttcttttacttctctgtgatctctttgtctttctccataacctacatatttacacatatatctatctctcctaagggcaccattgaggatcttctggaataattaattaaacagacatttgctctttaggtgtccctgctctgaaaggagaagtgaagccatttatagtagtatatatcccatagtatttcaggggactaaatcatactacaacctgggttctgatatttttcaggcccagaaccatattgacagtatagattcctctctttacccttccaggatcaccagattatttcacagaatcaacttggtaattaattgacaagacccaattttccttcttttcccctaagctcagcaccctcatatcactctcttcaccatttctttgttcatgataaggaatccaacctggttctaagctactatttgctatttactattttaggtatttcctgaaattaaaactttaaaataaattaagcagttcttttgaaatacatcaaaagttttatttattttgttttttaaaaaaattaagttttggctgggcgtggtggctcacacctgtaatcccagcactttgggaggctgaggtgggcggatcacaaggtcaagagattgagaccatcctggccaacatggtgaaaccccatctctacgaaaaatataaaaaattagctggacatggtggcatgtgcctgtagtctcagctacttgggaggctgaggcaggaggatcacttgaacccgggaggcggaggttgcagtgagccgagatcatgccactgcactccagcctggcaacagagcgagactctgtctcaaaaataaataattaataaaaatttaaaaaaaaaataagtttctactttcacagaaaaaaaaatcaatggcattcttatcctaaagctgtctccatatgtaaggttggccatcactaagataacattgattctttaaaatggctggttggtacaacccaggaactgagcctggaatccaggagaccaccagctggcaggtggaggccttggattgtgagcagtcttagtagctgagttagtggcaggtgtggatggtagagataagcagaaatttttataatccaataatgttttcttcaaaaaatgaactcattatcaaagtattatgaattacattactatcctccatataaaaaacagacagatgtaattccatgactgttccccacactcaggaatcatcactgagacacaattcagcattaacttcacatacttttaaatgactatctaattcccatttctctcactctctccatctgatcagcaatccatatgcatttttatgacttacatgccacaaaatgttttcttaggggaaccttacactcttccaccccacctcaaacatttttttagacaaaatagaacaaagagttgtagtttataaatatttactctttgtttcatttcccatttctcagaaggatttgtattttaacaaatcatgtcacttgaagatgtgaaattctcacagtggaatttcagctgccagtgagataaatatttttggatggagggatgttcccagtccccatgaaattatgtcacaaagcactcctgttttttccctaagcctgctgactcatgtctttgtcttaagacggctctactcagcaaaaagttcatagcaagcccttcagaggggagagtgcctgactaatttccacgataggaatctgacctactttgtttaattctttctgttctctattgaggtgagtacaataaatatttctgacttataattctcttaggtaccagttaagggcctgcagtaattgctgtgaaacattacactggagacattgctgcaccacagtaaaaggccccagctgcaaaatacacccttgctagattgatagttatttggagtatgggggtccctaaaggaaaataaagtcatcacaaatatctaagcttgaagagcaaaaataaagagggatgctacccttttgtgtattccattggagaatgtacagaacacagctcaatgtatattaattggcctcttgacccaccccataagttgctgcacaggtttgtgcaaattgcttaacctatctgtgcctcaatttctttttgtattaaatagacaccataaatctaccttcttagggtgatcattaaacctgaacaataattataatcataataataagtatgtaaatatactagattgaaaaacaaaatactaaaagagttattgatttgacaagtatttattaagaaaaatatcctaaatggagatacaaatacatgagccatattccctgcccttgagaagcacacagtgtagtgggagacataagacataggcataaataataaggcaaggtagaagtcatggaagagacagaaaacattgaagagcaaaaatggcttcatggagaaaatgacattcaaaatgatcaaatgcccacctatttccacttccttcaaaatacctatgtgtaagagtgtgtgtgtgtgttggggagagggtgtcaataccttcagttggttaggattgggctaggtaacacatctaataaggtacagtaagaaagaaaactatgtggacaaaagcagttttcctctgccgtctcagaaatttagtctaccccacagcaacatagagttctaggagatttggattttaaagtactttcttttcttggcatctattgtaaccttgttaagtggtattatctgtgatttctgattacagcttttatgtttgttggctgtgctgctgcttgaaatgtttgtttttctccctcatttttatttagaagttcccaaaagcacattggttccctgccaggtttcataaaccctgtgattatttttccgatccaaggctaaacttctaagagtaggtcatttgtcaaaattctctaaagtcctgtggtatctcacaggaggtctggatactcaaaggcagcatttgttgcctgtagcatctcccggccccgacccaggtgtgacaacaaaaaatgactccagacattgccaaatgtcccctggaggacaaaatggcctctggttgaaaactattgctctaaagtaacctacactgtaatggtttaagccatgggagtgaaaagcagttactagccagttcgtggaagccactagatggcctaaggcagggataagccattgttcagaagtaggatgctaagtcaccgatgtactgagcctgggttttggcaagagtggacagtggcagcccagcatggacccctagcacaagaatagccttccctcctccaaaacctgtttctgaaatgctttgtcccaggacttctctacattcttaaaaatgattaagaatcccaaatagattttctttatgtgtgttacatctattcatatttaccacatcagaaattaaaactgaaaaattgttcatgtattcattgattcattttaaaaaataataaacccaatatatgctaacataaataatatactttcatgaaaaataactatttttctaaaacaataaaaagaatagtgagaagaatggcactgtctatatttctgtaaatctctttggtatctggtataatacagagaatgagattctcatttctgcttcttcaatcaatctattgtaatttcacccatcatatggcctccaggaaactccactgtatatcaagaaggaataatagtgagaagggcacttagcattattataaaaatagttttgacctcacagatcttttgatgaaagggtttcagggatcctccgggggtccctggaccacactttgagaacaactgctctaaactgacatgccacacttttatgaatgtagttcacttaagggttgataaatttcttttgaaactaggatctctaggagcagtgaaatctccctattagaccttagtgtgagtacctttaatcagactgctctgttcctaagatctggtgagcagcagtactgaagaaactgaatgacgtaatttgaagaacatattaccgggagggaggacaggaccgggtaagggcttagtcaggtagcagtgtgaggacactgggccctttgcaataagaaaagaggaagcacagaaaggaggaagaatttgctttgtagtttctcctgtggtcctgatgagcccagtcactcatatgccattggaaagcatcttcccctgtatcctgagctaattgccacattgctgagcctggtgccactgcctgacttaaggcatagcattgcaggagaagtggtagtgatgagacaacaacagggaagaggaagagagagaagagcatcagacggtggagaatagaggagaagacagtgccaacactaaactcagggccatcgatggcctgtctgtcatttgaaagcctgacttaactttcactgccagtaatatcttaaagaggctcaaagttttatttgagtatatttttgttgctttgcattccaagcaactggttagcatttgagaagcctggggttccgagcattggttgaaggaacttgtttaaagtataaaaggatctcaatttcctagtgagatacaaaatccaaatattctggctgccaggtcctacgctaaccaagaaagttacctccctgatattaaagatttatagttattcaaaccgcaagtactctgaaattgcattatttttaaatgattatatctttctcagactatctgaagataagatagcccctctgttttaaacagcaaatgagggaagaaaggaaataggttttgggactttgtatgatagagaccagatctctgtgactatagcaagtcttattagtgactggatatgttagtgggtccaacttatccaaaataggctaagaaatttttacagcatgttcacagttccataaatttttctgctgtcctctttttaagttagtgacattcagaccaacatgcactaatatttggcaatattgctcccatgaatgtgaacagacagtttattgcctcagaattatgccaccctctctacatggtgcattttttatcccaagtcattaaagattcttcatttaaaatctaatagctctagaaagaagacaggataaaggtcattattcccattttacagctgaagaaatttataagggagaaaatctttatcctagaaccagtagggtttcgggcacttgcccagtggctctgaatgcagtccttatgttttaagcagtgaaggactaaggagcagtggcctggcctcctggggatatgtactagcctcttagttgaggaagtcttatcttactagaacaattaaactatttctctacagcgttacccaacagtggcagagtcattttgctggtttaggccctgccatattaataatccattttgaaacaatctggtttgccctctggtgatctaagttgaccacagacatatggccatatcagaaggacagccaatcagtaactcaaaaacaatccatagaccagtttttacattgttgaaaatactccccttatccaaaacagaggtccacaatatacctttaatactaagaccagtatgtgcataagaatttcgactacatgtttgtggagtaagaacatgtacgtggtacagttctttctgagatcattttcagctgggcaacagacttgtgtgataaaggacaattaattagaaggcatgttatttatgtagaatctattttcaattctgttcggatttatccatttgtctcggtccacaatatggaaacacttccccttctgggtctgtccttttcccgactcctccataaaatttgctttctgtctggaagtacaacaagacacccagttagatcaaacttaacacatctccttcacaaagctactgcaagctgccgccgacgattgtcacctgaggggagaccctcctcaccacacacaacctatctgaggagtgcctttttttctatcctcattatttaacagtgtgtgccgattactcaaagcgatatgggcaggccctggtaaatatagcgttgctgtagtgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctaccctaaaacggctttccttcccaacacacactccctgacacagtgggacccctttataacaacagtgctaaaggaataagacaaatgccagcctcagaggcctgccacatgacatcaattgttgactctatagaacagttatgatgattaggaaactcaatctggcctactgcatttccaaagttataaaataatgagctgtgttataagggggttttactgtatttcacatttcaaaagttcaaagagaaaatataataacaataacaacaacaacaaccaaaaaaaagaaagatttatttgtgacagtactttctcttaacctcttacagtgtcagagactttgtagttataaatgcatttggttattaatatattatgtcaatcccatctgaaaacagtcaaacgaataaataacaaagactggtctctgtaagcagaatgattagcctcctgccagctgctgttgtattgagttcagcattaatttggatctcgaatctcattaagtctgtcacacttctctcttccaaaggtgtcatttgaatctctgtacgtaatacttttaaaatttagtcgcatgctccttaaaggtatacatcgttaggataacatcacattgataagcatgaaacactcttccccgcctccttcctgccccccttcgctcccctaagaaagttcttttttagtttcaatttttgcctttcctttttttggactaatatcgtggtatcagttaattcatttcatgaaatgccactcattttccccgtgcaatgaaccattttgctactggttttctacatcccacatcagggaattctataactcttgtgaaacttaaataatacatggaacttgaaactgttcttcttgtcacagcttacatgggttatgtcaaaggacctctccccccattaaatatcatatacatataaaagtctaatggcagaggaagggttaccagaaattggtctatttcccaatggactgtggaacatccttgcagatagcctcaccagtctccttaaagagataatccaatatttcatatgtgacagaaattattactacttgtctagctgtcattcatcctaaaagagtgactatttgcaaggttgttgtgaatatgaggcattcccacaccccgtttctgaatgcaattcaatttcaattggaccttttattaaagtaaacaagtataggactggcttctatgaaaatgggataagaaggacacggccatattgtctttacttttaattatttaaatgataccaagaccagctgaactagagtgttaagtgtcagcaatggccatcatctgtcactgtgttgtcacttaaataagatgctcaaaattcactggcttaacaatttgggtattccattcaattacattcagcagcaaaatggttacataccctctaaaaagactacaaaatgctattttattttatttctttttcaaagaaagactcctggcccttggtgtgtcctacctcaaggtagggctcaagacaccaacttttttctttccattgttcagcagttcagattttgctttttcatacaggcagatagcttagtcagatttgcacagtttgacctgaaagtcactgaccggcttcctcaatttttcccccttgttacaaagaaagcaaataagtgtaatttttaaaaattattctctacattccctggagtaaaagttaaaaatgagctggatttttaaaaaaatcatcagcctcctggaaaagctttctgatttgtatggagccaatctaggacccgatggatcctctgacactctccttaaactctcaggaaaatggaacggagccaattctttgtgctgtgcccttgttccagcaacacaaagacttgctgccctgattttaactaggatgaagatttagcagccaatctccaaagggagcattttctcagccactaggggaaagaggagagttaaccctttttaagcaaacccttgcaaaataactcctcagagaaaaatagcaggaacctctaatattatcatgtcgtatcttaaagactagtcgttcacaaagtttgtcacagggagagcaagggagaaaggggtgttgcggggcagagaggggaaagagtgcttcaagttcccaaatgaaaagagtgttacatttatagagattatgtcaccgctcaactctggcaaatggtgtttatcaaggctggcagaggaataaattatgcttgtgtttactcttttgttcccatggccaagtgctgttttattaattgttgaacaccattttgaggcactaaggaacgtaaggagtcaagatgaaaggacatttaggtgaggatcaagactgttaacagaggcacaatctaccgtcttgctggtcattgcaaaacattagccagttgccagaattgagtcataacacttacatcaatgtttagttattttacaatttagaactcccctgtactgttgtaatatattataatgttccattgcctttgttttccccaagatctaatcacgttgttcatttctcttaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggggtacggttaaggtctagtaaactaatcagctttactttactgtatgtcaatctctttttttcttctttttttttttttttagtttggtttattgttcaaagcattgtctctttgcaaccatttgattctttgaaaacaatggttgtgctttcttgtcaggcagtggtgcttttctaatagaatggttgtaattaaattgtggtctgtgacccaaaaggaaatacaattctccagaacatcattgttcaatagaaaatatatgcaagccacatacatgagccacgtgtgcaattttaaatgttctagtagtcatatgttaaaaagtaaaacaagtgaaattaattttaatgatacattttatttaacccaatatatccaaaatatgatcctttcaacatgttatcaatacaaaaaaaagaatgacaaattttacattcttcacgctaatcttgcaaatctggggtatattttatgcttatggtacatcttgactcatactagttacatatcaaatgttcagtagtcacacatggccagtggttattgtattggacaatgcatctctagagaaagcagctgctctggaacagatattaaaattaggggccgggcacggtggctcacgcctgtaatcccagcactttgggaggctgaggcgggtggatcacgcagtcaggagatcgagaccatcttggctaacacggtgaaaccctgtctctactaaaaatacaaaaaattaggcgggcatagtggcaggcgcctgtagtcccagctactcgggaggctgaggcaggagaatggcgtgaacctgggaggtggagcttgcagtgagccgagatagtgccactgcactccagcctgggtgacagtgtgagactccatctcaaaaaaaaaaattaggtacacaggtgaaacactgccacctcaagtaatacagcacttccatagggagaggtggttcttttaagtaaacagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccaataattcagaatgttcaaatgcaagctcgaattagaataatgtctccattctggacgtgtttaaaagaatatagtcttgttactttaaagtgcatctgtcatcactaaaatgcctatctgaagtggaacagaacaataagcaacttcataccccttattttaggcaattttgacctcatgagtaaatgtcaatatgctgggatttctacaagtgcatttgtgttttgttgttgttgttgttgttgttttgttttggggtttttttggggggtgttctgttttgttttgtttttgaggcggaatttcactctatcgcccaggctggagtgcagtgacgcgatctcagctcattgcaacctccacatcccgggttcaagcgattctcccgcctcaccctcccaagtagctgggattacaggcacttgccaccatgcccagctaatttttttctatttttagtagagacagagtttcaccatgttggccaggctggtctccaactcttgacttcaagtgatccgcctgcgtcagcctcccaaagtgctgggattacaggcgtgagccaccatgcccggctgcatttgtgttttggccttcttatagttcacactgtggatttacatttagccaatttttaaataatatttcattcaaataaatcatttgtcttggtcatggaaaacataattttgtccagtgaagttgctggttgttccttcttcctgccttttgccacaacatattcagcacactgcaccaatccgctgacagtgttcccattgcattggtggatgtacaatacatggattcatctgtaattgcattgtttgcatgcaagcatttaatgtttcaatgtgcttaaaatgttttactcttgagtaggtgccataggcccattacaatttggggcatatgtttttataggataatattaatacatgattcataatccattttcaaagtgatccactttctttctgtagcctacacatagacaggcttgctggacatgagcaatttcaatctaacttaattatcccaaattttgaggtgctggcctccaaataaataatacacctgaaatttgtgtagcagtcatccaagtgttctcacatctattggctcatttgagataagatggatcaggcaattatcagtaagacccagcccatgaagtgacttactcaaggcaacacagttaggtagtggcagttctgggactagaacccagcccttcttctgcctatagccatatctttgctaaaccatgctacttctaaccacccatggcctgatgtcccccaggaaacttgaaatcctaatgggatcctgtcaaatggagagcagatcttgagtttctgttccacttgtccacaaaaaaagtcttgagaaacttcaccaagcctccatatgccccattccttatgcactccacacaagattgaatattcaatcactcctactttccccagaaagaatctttctgaaacaggattacatcaaggctcagggtcacatgacctccagactctttatcaacgattccatctgagaatttatgtccctactatccaattactatagcctcagactcttattaaagccccagagcagtattcatcaaacattagtgtgcatgcaactcatgtgggaaccttctaaaaatatagatcctgatccagcaggtctgggatggggcctgagggtctagatttctcacaaactcccaggtcatgcagatgctgctggtcccaggagtagaaagattctagagaaaataaactcagagaatgtaacttaagaaaagaaaggaaggaagaaaagagggatagagatacaggaagaaagaggaagaaaggaaggagggaaggaaggaaggatggaggcagggaggcagggaggggggaaaagaaagaaagagggaaggaaggagggaaggaaggaaggaaagaagaaagggagggagggagggagggaggaactgaaaggaaatgaaaggaaagaaactgggatcagcaaacctttgttaggacataatgttgccatccaaaagtggcggcctggaacatcaaacctgaggggaaagtctcagaaactaatatgccacaacttctggctttcctttactcatctgagttgatccacttttgtgaagcaaaattcaggctacttgaggcaacactcacattttaatagactcccatgccagtgtggttatagcccaattacctagcaccttggcaaccatctccagggtgaaagaaaggttgggaagagcatctgcaaacaaatctgtcctccaagcctgtacaaagtctccagacaagaagcaaaagcctcatacgacgccaggaaaacctcacttgtgttagtcaagaggcataaagcaagctgctttgaaacctctctgttgtcctcagccaatttggtgatgtgattaggggaatgttggttaagtgaagagtgagatcttcacccactcatcttttatttcccaagaaggtctggaatatctcctggtgacttctaatttgttacctagttattaggcttccagttctctgagttggcctaaatctgtcaaggtctatccaggggcaccgacatcaagaggtaccctgagattttacttctattactaattatcagagcccaccttgggagtttatagtaccagtaattgttcaggaaaaatgactcagggcaaatcacctgcaaaaatgtgatctagtgaaatctggttaataaaagggcatccttgaaagatgagggagtcgtttctcattttctatgggtgatagtcacatcaggattactgggcttattgtgggaacatgtgcctcggcctcagatcatgtttagctcccactagggagcagaaagcctcttgactacctggtgcctctctgggttactgaccagccactggaagtgtatcctcccaagcatgccttggcaggtgactgcccatcaagtgctccagattcactgcaccctagggttgactgtgctaattgttttaggaagttatttctcatttcctaattgcagttcagaagtacttctggcttctttggtttcttcaaaaatatttttgaaatctctgtcctttacaagacctcaacatgcctgaagttaggggaaaagattttcatttttcttgtaggagttttctgtttagtcatcctaaaaatattagctttgtggatgcagcccattttcaaagtgatccactttccttctgtagcctatgcataggcatgcttactggagacattttgctgctgaaaagaattcacgttatgttaagtatgaaaaaaaaaagcattctggataaccaaggtgatgatgttctttctcccaagggacttttacatcagtgataatagttcatttgaccccatttaaaagtggaaacagaggcactgagaggttgggttcctttcccaaagtcatgccactagttagtgatgtcccatgcccactggggagacagggggagactttattctttctgccagatacaaaacttctccaagcttctgcgatacatatgactcaggacttaggggtgccaaggaagaggtttgtctactttcatgttagtcttattctaccatccttggatgcttttggccttcaggtgcatatttgacattcttcttacagatacttttactacagggccagtggtagatcataattacgtcattcttttgggataaaattcggtgttagcttagaagaaaaggaagtgtttcattagtgcagaatgaaaggataaagagagggatgtaaacttgaagaggaggtaagaaagtgtcctacagtattcagaatcaggggcaaatgaatcccctgcactagttagtgcctccaaaaagaagacactatcagcatttcaatcaggcctatatgtcagggcaaagaccgcattgatgccaagtccccttcatgggtatcactgctctggcctcttcctagaatctgctgtctctttaaagtcccagagctattttcagactttaataactaaggttgtaggtactaagagaaacaattgctcacttttctagcaataagcaaaatattttcttctcacagttaaaatggatttcaattcagtaagccatagaacactgtttaccctctgtcctgggtgaacaatcctttgtcatagtttctgcaatcagaatacactcttttagttcttgtgaatatctgtattaaaatgccatggaaactttctggtatacctacatcataagtgattaaagccttgaattaaacttcctgcaacacctgcatattccttagtacaatacatatagtagagaatgtaaccagacctgtcacctaaagccagtcaaataaatgaggtgcaaccccagaaatgccaatttcagaaaacagccatagttttgtccaagatagactgagccattataaacttctcaattcctaataggaagccccttcaaatttaaatatccccttgcctttgcagatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgtaaagaaagaattctgtttctgtgctttggctagatgtttaaaatttacttggatgcagatgccaagaagttattcactaactgacttcccctagaagctttgccaatgatgtaacagtcaccttactggtgactttcacaaaggattactcctctccccaccccaactgcaactgtagtcaggcgcagacccctagcttaagcaaaaccatacatccaagaacttagattagtttaactttaggatcttccattcccattctttgtctcctccaccctttgggactcctttccagaggcctgccttggctctaaacttgatcttcaattctcccatctccacaactgacctcccacagaagtacctaaattcaagattattgaccttcaaaaacacttccaattactttcctatgccatcataacatatatgtcctagtactcttaattgcttagctaagttttgtgctgctgcttcaattaccaataataattcctaactggaaaacgtttattccaccaaggatcactaatctagagtgggagaagaaataatgaatttagaactatactgattttagaatagttctgacagagaaatgaaaagctaattatctagtctgatttgtagattctgaacacgtaatacaactttatccaacaaataaagcaagtgtttaaatgtacaccagcttatatcataatcaccttagagaacagaggataatgataggaggaaaggagaggggataatctgcaactgaaccaaaaaagaaggaaagtgcagctgagatgctagagagatcaaggaaaaaagatatctggggttagggagttaggaagcaaggaacgcaagagcttaaagaagaagaaaaatgggagtgggaaaggaagactgagaaaattctgaagtgaaggctgatataatcacactgtggacagcttggcttactgtaggcatcatcataattactaccattttcactgtgctctgaaatgctaaatagctgttaaaccactcacacttcataactcttcaactgctttttaaaattaagacacctgttgcagtcctaccagaagacaattgattctccggagcaagttcagtgactagattagagtgatgaaatcagttcaagtaccaaacaatgtccctggatcctccaaaacaatagatttatgttttaacagccacttcaattccttacccctaaaggagaagctaatctcagttgctgtcacagataatggagcactattttggtgtaggtgggattttggggtttttttctccttggaagaaggaggaaacaaagggggctgcttttagtatttctcaaattggactataagtagttagatattttgcttatacatagagtcaaccttaccaatcaggtcttcaaaaaggccttgtatttcaaatgccacactctccctgtgcacaaaagaagaattcctcttggtctctgcatcagtattcttgccctgttaagactcacatctgatcacactcagtcaacagaacaatcttcaaacaggaaggacaaatgtatttaaggaaaccttagtaagatcatggcagaaatgttgcaggaaatcgtctccctcctgttggatgagggaaagggtcaactgtgacttcagaagatgaacgtagaggagaacaaattgagaagcaagaagcaaaaccattattcctcagaattcagactcaatcaagcaaaagatgcattaatatgctatctcacaagggtcagaaaccatttgtaacacaaacactaccaaaacctactgttactgagagagttactttcaaaacctgagctttttagcgactctgaaccatacccctccccttttgtcctcactctgttggactgaggttcctgggaccaatttattatcagatcacttggcagacatgaaactcagcagctgaggtgtgggagttctgtgcactcccacagctgaattcagattctctcttaggagagaatggtgggttgcactaagaattaatgaaacctgcctccagaactaaaagtgctatgaagtgctaggagacttcctgcacacctaagatcaagaatcatagactagccatttacattcggtgaaaacatggggcactcagattttctcaaaaggtttccagggagagcattgttgtcaggagaagattgagggaggctttagggggttgatcactgtcccaaacctactgccatatactcaacctcctcaatgctgagggttcacaaattcattcaaatgggcaagattccccaagttctctgacagccattgttattgtaaccatatgtcacctgcacaggatggttgtgagagggcatacactctctgcttctctttgccagatgaggaaggagcaatcttggcccctaccctcagagggcttacagtcttggtacaaggtagatgatgactgaaaagaatctgcattcatttatgtatattgctctgctcagagaaaatacttttaaaagcccaaaaggaagactttccctttgccccttcacttggacttgctcttcctaatacaatcgggggtgggggagttgactaaatttttcttcgtgcccaaaagctgtgagcctttgcaattgaggagtcataccgggaccctgaaagcatatagctgctgagaacctcagaatgaccactttcttgccagcctttccaccttctgagcaggaggtatttgcttatttgttgattcacaatgccctagctataaacatgtaaaagaacctacaatgacaacctaagaaaaatcctctccccatgtcagcagctttggaaaacttaccccaggagtggtttcactgagcttcaatcctatagcaaaatggttgatttacaattttcctaataaatattcattaagcctgaacaagtcaattaaagctctggtggcagctcacacgaggcttgaatataagcagacagaaggaaacaacttctataaatattcccaaataacattacagtcttcccccatgagagtgcaagagtttatctgaaagattgaaaaccctctctgaacccagtgaaggcctctaaggtccacatttcctcccatttactgtacagcttcagaaaagcttgttgcatcctcagtctccacttcctcaattattgcaatatggtttctaccaccaccactgtacaggaacttctcttgacaaggtcatcaataaactgcaatccatactttatagcaagggttggcaaactttggcacacaggctaaatccagcccaccactggtttttgttaataaagttttactggaacacagccacagccattcacttatgtattttccgtggcttcattcactctgcagtggcagagttgactagttgcaacagtattgcccaaagtctaaaatatttactaacttgctctttacagaaagtttcccgatcactactttaccctacttgatagccattattttattttatctcttttcagaatttgatgccattaacctcctccagtttggaaatctctattatttttacttccatgacagcactctttactgggtttcctcttaccctgctactgataatttttcttctgcttcctggtctcctcttctatctcttaatgtcaatgttctcccaagttctaccacatttccccctttctttacactccatattctcttcttgtgtgctatcccatggtttccatctccacttacattatgatgtgtttcaagtttttatttctatctcaaaactctctcgtgagctccgaacaagtataattaaatgtctataggagcccccctcacttggattatgctataagcatgtcaaacttgacatctccaacacagaaactattgtgtgttctcttgccctcgccccactgctaaaccagagctccctataagaatccctctcttgatttaaaacaccattgatggggagtcaaattaaatataaaaataaaactaatggactttaaaattggtggatatgacaatctgaaaaaaacagacttgcactcaaaagcagaagccacagtacaatgacaatggaaaagcagatgggttagtttaacaccaacttgtatagctataagatgtagtgaaaagtaagcatatggttctttgtatattttggatcgccaaatcataatatgatttgcactcttgcggaggaaaaccatctagggttatcaccaaggaaggaatgtgcaagccctgagcatgctagccaagggtcccaaatcactccccagaacaaagcaatacaaggaggtggttatggtcactctgagggagatattagatgaaacctgggtggaatcaaaaaaggaacaggtggggagtttgcatgttcagtttatatatacccaagcatatgtatttctgtaagtgttcagagaactctaagcaacccatgttttagatttttttttttttttttaccttttgctatggactgaactgtgtctcctccaaaatttgtatgttgtactctaatccccaatatgactggattggagatagggcttttaggaggtaattaaggtaaaatgaggtcttaagggtggggtaccaatctgataggattggtggccttataagaaaaggaagagacagagatctctcagtccacatgcatgcatggaggaaaggctatgtgagcacacagcaagaaagtggccatctacaagtcaggaagagaaccctcaccagaacttgaccagtctcacaccctgatgttgaacttccagcctccagtactgtgagaaaattaatttctgttgtttaagccactcagtctgtggtattttgttatggtggctagagaagactaaaataccctttccactgtcacagagagttgggtcatacagacacaatggtgggagaggggatcaatcaccactgtaaatccagtcaccaaattcagaagcctggaaatcaactctgcctgctccctccctcattcttatcttgaatcaagttccaatgattcaatctctctgatatctctgaaatccatctacttatatgagtccctaccttagtttgaacttataacagtttctatgtggcctaatataatatcctcttagctgtccctcttgtttccaggtttttgtccctccaattcatgctccacactgcaaccagagtgacttttcctgatctcatcactcctcagcattagtgggtccctattgctctttggcacaagagtaagctcttttttattattatttatgtgtttaattttggttttagagagacagggtttttctctgttgcccagggtggagtgcaaaggcatcatcatagctcactgtagccttgaactcctgggcccaagcgatcctcccacctcagcctcctgagtaacaaggaccatgcctggctaattttttttaacttttttagttaaaaactaagtcatactatattccccaggctggtcttgaactcttagcctcaagcaatcctcctgctttggcctctcaaattgttaggattacaggcatgagccaccagctctttattttaccataaaagttgcttataatctgccacctgccaatttcttcacccttgttgctattcactaagacctagtcatatgcaactttttatttttattttttgtttcaaactcattttaggttcagggagtacatgtgcggtttttctatgtagttaaattgcatgtcatttttaacattaagggtttggtgtacagattcttttgtcacccacataataagcatagtaagtgatagttttttgaccctgatcctcctcccaccctccaccctcaagtaggacccagtgtctattgttcccttctttgtgtctatgtgtactcaatgtttagctcccttcgtaagtgagaacatatggtatttggttttctattcctgcattaatttgtttagtataacggcatccagctccatccatattgctgtaaaggacatggtctcattattttttataacaccatagtagtattccatggtgtatatgtaacaccattgataaggatttaggttgataccacgtctttgctattgtaaatagtgctgcaatgaacatacacgtgcatgtgtctttatggtagaacactttatattcctttgggtagatgcccaaaaatggaattgctgggtcaaatggtagttccgctttaaattctgcaaactgctttccacagtggctgcaccaatttattttcctatctgcagtgtataagagttcctttcttcctgcaacctcaccagcatctgttattttttgactttttaataatagccattctgactggtgtgagatggtatcttattgtagtttttatttgcatttctctaattatcagtgatgttgagcttttatcatacgcttgtgagccacatgtatgtcttctttggagaagtgtctgttcttgtcttttgctcattttttaatggagttgttttttgcttattgaactgtttaagttctttgtaggttctagatattacatctttgtttgatgcatagtttgtgaatattttctcccattctgtaggttgtctattttattgatagtttattttgttgtgcagaaggtctttagtttaattaggtcccatttgtcaatttttgcttttgttgcaattgcttttggagacattgtcatgaaatctttgccatggcctatgtccaacatggtatttcctaggtttctcctagggtttttatagttttaagttttacctttaaatatttaatccatcttgggttgattttcgtatgtggtgaaaggaaggggtccagtttttaccttctgcatggggctaccaagttatgccagcataattttttgaataggcagtcctttcaccattgtttgttattgtcaactttgttgaagattagatggttgtaggtgtgtggctttgtttgtgagttccctaacctgttccattggtctgtgagtctgctttcttaccagtatcatcatgttttggttactgtagccttgtagtagagtttgaagtcagataatgtgatgcctccagctttgttcttttgcttaggattgctttgtctattcgagctttttgttgttgttgttgttccatatgaattttagaatagttttttctaattctgtggaaaatgtggttggtagtttgataggagtagcattgaatctgcaaattgctttggacagtatggccttttaataatattgattcttccaattcatggaattttttccttttttttatttttttattttttgagatggagtctcgctctgccacccaggctggagtgcactggtgcgatctcggctcactgcaacctccgcctcccgggttcaagcgactctcctgcctcagtctcctgactagctgggactacaggtgcccgccaccacacccagctaattttttgctttttggtagagatggggtttcactgtgttagccaggatggtctagatctcctgacctcgagatctacctgcctcagcctccaaaagtgctgggattacaggtgtgagccactgcgcctggccttttttccattttttttgtatcatctctgatttatctgagcagtgttctgtaattcttattacctccctggttagttgtattcctaggtattttattcttcttgtggcaattgtgaatgagtctgcattcttgatttggctctcagctcagatgttggtgtacagaaatgctactgatttttgtacgttgattttttgtatcttgaaactttgctgaagttgtttatcagatctaggagctttggggcagatactatgaagttttctatgtataaaatcatattttctgtgaagagagatgatagtttgacttctctacctatttggatgccttttatttctttctcttgcctgaatgctctggctaggacttccagtactatgttgaataagagtggtgaaactgggcatccttgtcttattccagttctcaaggggaatacttccatcttttgcctgtgcagtatgatgttggctgtgggtagaaatggtaccagctcttcattatacacctggtagaattcagctgtgaatctgtctggaccagggctttttctgcttggcaggctttttattactgattcaatttaagaactcgttattcatctgttcagcgtttcaatttcttcctgagattctttcctcagcttggtccatgttactgtttgtacttctgattgtattatgaaattcttgtggtgagtttttcagctctatcagattagcgtggttctttttcaaaacggctatttcatcttccatctctagtatcattttattggattcattaaattctttggattgggtttcaattttctcctgaatcttgatgatcttcattactatccagattctgaattctatgtctgtcatttcagccttttcaggctggttcagaaccattgctggggagttagtgtggtcactgaaaggtaataagacactctggtttttggggttgccagagttcttgcactggttctttctcaattgtaagggctgatattcctttaatctttgaatttgctgtccttttaatggagcttttccttttatattctttgacgtccttgagggtttgactgtggtataagttggtttcagttgactggcttcatttctggataatttcaagtggccaaggctcagctcagcacccctgggctgcatgctgtaacagtgggggactaggaccagggccatggctttgttctctggaccctcgagttgagcatctactgtgctggaggggctgaggtgtttccattccactaacaatactccaataggggaggaggatgctggcaaaagcatttcattggggctgtggcaaggggtctatgtgcatgtgctggtggcagcagggcagtagcgcagtgagatctacatgcacgcacatgctccagtagtggcagggtggtggggactgcatgcatgcacttgcatcagcagtggcgatgtggcagggtccacgcatgtgagcactggcagcagcagcacaatggggtccacttgtatgcactggcagcagccacatggtgggatccatgtgcacaagtgcactgccggtggtggtgcagcagagtctacatgcatgcaagtggcgatagggcagcagtgtggcaggacccaccatgggtcagcaatggggcagcagtgcggcagggttcatgtgtgtgcatatgcacaggtggcaggacagtgaggtctgcatgcacatgctcacaccagtggtggtgaggcagtggtggcaaagtccatgggcactggtggcaatggagtgagtagcaaggtccatacgcacacaagctggcaaagcagtgggggtaggctgcaagcaagtgtgtgctggcaaagcaatgaagggaggctatgggttgatgcacgttggcaggggcccatctgctcaaaccctctgatggttagctgggcctgccagtgaaggagctatggcagcagccaccaggaagtgcaccagtttggcatctgaggctgcgctgcaaacaggtgtggccatgcagggatgctgggagatggcagcagacaggagggtgttcagatcagacttgcccattccacaatcaagatagccctgttctgtccaggtccaacagtcaacaaaggccaaagccacctagaggaccgtggcaagcctcaggggatgggcatccctggccatgttccattgcagccattctcaaaccaaaccctcggggctccacacagtctggagtcctgtccctgccacatctccaagtacctatccctgtcagcttaaatatctgttggggtcttgggtctcctgcagctaagattccaatggtcctttatgacagtgggccacttctcacctatttaactcatcctttccccaggagccactgagggccaggaatgagccctgatgtttggcagccctgtgcagggttcccagcttcctcccccttcagcccagggtaggtgtcctccctctgtccactctcaacgtcttccttctgaagattcactcagagtgtgctagtcttcttgatggtctcatctctcagtgggtgatactcttcctggttgtgtcttgttggccatcttggttctcctccatatacaactatttaaaattcctggccttgccatgtcttttcatgttttcatgtttttgcacatgcttctctatttgcttttatgcctgactagtttgtactctgtctttaagactaacttagcattgtttcctctgggaagccttgtctaactgtgttagggactttcctttttgctcccatcacagtagtacttacctacctcattgtgctgtaatgaaatattattttccctactgggtcatgcactgagaccatgggaagagtctcttgtagtcatttacatagctggaacagagttgtaaaggtttgatgggcaaatgaatgaaatgtggaagtggggaaaaaaacaggcataacttaggaagtagtgttgacagagaagaggtgccaccttatatgatacaaaatgcaaaatctcccagactttctgtccaaaaaggcccaacttccacataatcaatcggtcagcaaaagcagttgtccataactggtcatcttttccaggtctctcttctcccaaaagaagctctaccttatctcccaccagccaggcagcctaaccttcagattcccttggatgtggagtatctcttgcaccaccactatggatgccctccctggccaatgccaagctactgcaccgcagctaggtcctaaattgattcataggacactcaggcatgcaaatctaatctcctttgtgaggcttacccactggatagtggaggagaaatagaaattgtagtctaaacgaatagatttagctcatacacagtggtattaagttcagtcaatgtcgaagtcatagtgatccatccctcatattccccttcaatcaatgatttactgcccagctataaggagtgtagttggctgacagctgttagcatcttcagaatctgccagggatttagaatatggatcatactcttcttgggacatctagcaactaatgactgagcaaagtggtgataagcaaggtcacactccctgggggtgatccccagtgaatgaccaagcaaagcagtggtacaaaagcctagctattcccacccaacatgggacttctctaatgagcaatctttgctccagagagccccctcgggctggcagagactttgtcaagacacaaccaggaagagcaccacccactgcatatcttctgatggctccccctcctcaatccttctttgtctctatttcttcacaggtgttattccctaataaatttttgcactcctaattcctctgaatctgcttccttgagaagccaacctgtaacttttggtgccagaagtggcccaagaaaggaagccgtaagatgctgtgtggatattggattcatcagcacctgtctggcattaaggaccccattcctggtggaaagttatgcacagagagcccctgacacaagacagagtcccaatgtctaaatatttctcctgtggtgtttcaggagaacacaccagtaaggagaattcattagctcatggaatgactcaagcatttcaaatgtatgcgagaaatataagtataaagaaaatggaatcttatacttttatttagttacattgatgccctgctgaagggcaataacaactaaaaactaaatgtgcgaacacaaaatctctttagtagcttacaaagaagacctaatttcatgcaatgggtgagcataaaaagttgaagacaaaacccagaatttgatcattagagtggctgaacttcaaggataactgaatgctcaactgaggcagatatgttatgccaaagtcgaggtcctagttgtgaaaacttaggaccctgacacaggggatggggacatctaagtggatgctcctgaagattttgactccccagccctctcaaaagcttctgagcctgtagaaatgcctcatgcttgcccaataagagctagtacttcttctgtataagaagacactacatagatctttccaccacaaagcagcaggcctatatgcagcaaaacatttccacaatcaagctggacctgactggggaggaaaaggactatatcccaaaggaactgccggcaggtactgagaggaatcaagggaggtcccatgggactatgttctgaaggtgcttgaccaaggagagctttcttgtaagaccggataagggagagtttgttggtttggggccactctcttagaatacaagacttaacaccctaacagagacaccagaagttggtgtaacttgctgctaaggtggctcctataagcctggaaaaaaaaacagcccatactgagagacgttaaaattcctgaattgctgtggcacatgccagagaaagaaattaaaaggctgggagaagcgggcatgttggagtggatatgaagccagaagatccactggaggattatgtcacataggagaacccagaagacacatcattcacctagcccatcaggaatactggtgaaaggggcagcaagatcaccaagaagttcagtggtggctctcctctgcaggccaaagcacatgataagagatgtgattccttgatttgttgatagaaatggaaatgattgccaaacctcccaaccctggcaatagagaccaagtgatagcactccaccaccagaagcccaggggtttgtaattattaaaataacaatacacaattagattggcaaccaagtgggcctgatatgtagagatggttaatagaacactgcatccctaaaggcaaaatagatagcagccaaaagggtattgcttaacatatataattttttaaaagagtaagcataaatgagcaggaactaggtcagtctccccaattaaaacgccataatttctagtttagtttccagacctgagctaattttccatcccagaacacacctattagagacatggcctccagtgggaagatccctgcattacaagtctttccccccagtccttaccaaaaggaccccacagccatctacttggcaaatttactgtacaattattgtacataaggtacatttactgtacactagaaaaagaggcatatccagatattagacctggggtctgagtggacactgatacttgcagacatgaagcatcatcatgtccgcttgttaaaggggggtcatctgggtgtcaagtaataaaaaaaatcctagccaaagcatcacttacaatggagccactgtatctgctgactcacatgatggtcattttcctggtccctgaatgtacagttggaatggacatatttggcagttgaagtagcccccacatcgggtccttggccataatgaaggttaaataggaatttctgaagctgctcctcctcctcctgcaagagactaagataataaaccaaaaccagtatcaaatctgaaggaggattatggaaatttttgccccttgtaaagatttaaacaatgcaagggagagcaagatggccaaatagaagcctttaccaattgtcctcccctacaaaaacaccaacttgaacaactatccacacaataaagcaccttcataataaccaaaaatcaggtgagtgatcaaagtacctggttttaacttcatatcacagaaagaggcactaaagagggtaggaaagacagtcttgaattgctgatgctacccctccccaatccccaggtagcagccaggtagcacggagaaagaatctgtgcccttgggggagggagagcacagtgatttggggacttttcattggaactcagtgctgcctatcacagcagaaagcaacatcaggtagaattcaaccagtgcccacccacagatggagcatttagactagccctatccagaggggaattgcccatcccagcaatcagaacctgagttccagctagcctcactacagcaggtcaaagtgctctgggctcctaaataaactggaaaggcagcctaggccacaaagactgcaattcctagacaagtcctggttccgtgctgggctcagagccagtggattttgggtgtatacaaattaatgagacaccagctggggtagccaaaggagtacttgtgccatccctcccacaaccctcaacggcaaagtcacagctccagaagagactccttccctctgcttgatgacaggagaaggaagagcaaagaggactttgtcttacaacttggataccagctcagccacagtaggatagggcactaggcagagtcctgaagcccccagtccaggccctagctcccagacatttctaggcacgccctggccaagaagggagtcctctgccttgaagtaaaggacccagttctggtagcaagcatgatctgctgactaaagagtccttgcgccctgaataatccgcagtgacaccaggtaatatgtcaagggccttgaatgagcctcagagatgtgctggcttcagttgtgacccaacacattcctagcagtggtggctatggagaccgactcctgcttgagaaaaaaggaaagaagagtaagggaactttgtcttgcagcttagataccagctcagacactgtgatggagaacctaatgggcccttagggtcccccattccaagacatggctcttaggtggcatttctggacctgccctaggcagaagggagcccagttccccgaagggtgagtctcagtacaggcagcagtcaccacaatctgactgaagagccttgagctttaagggaacattggtggcagcctggcagcattccccatggtcctgaggtggcagtgaccatgaggtaaggctcctctgcgtttggtaatggaagcgaagactgagaaggactgtgtcttgtggttcaagttccagctcagccacaatacaatagaataccaggtagacttctaaggttctttactctagtccctgactcccaggcatccatgtgcagaagaatgaaactagacccctatctctcaccaaatacaaaaatcaaatcaaaatggattaaagacttgaatctaagacctctgactataaaattactacaagaaaacattggggaaactcaccaagatattggtctgggcaaagacttgaacaatgcagcagagccacaggcaaccaaagcaaaaatggataaaggagatcacttaaaattaaaaagcttctgcacagaaaacgaaaatcaacaaagtgaaaaggcaacccacaggatgggagaaaatatttccaaactacccatctgacaagggattaataacaagaatatataaagcacttgatccaataacaaaaaaaaaactaatactctaattaaaatatgcacaaaagacctgaatagaaatttctcaaaagaaggcatacaaatggccaacaggtatatgaaaaaatgctcaacaacactaatcatcagagaaatgcaaatcaaaactacaatgaaataccatctcaccccacttaaaatggcttatatccaaaagacaggtaataacaaatgctggttaggaattgctgaaaagggaacacttatacactggtggtgggaatgtaaattagtacaatcactatagccaacagtttagaggttcctcagaaaactaaaaatagagctaccatgtaatccagcaatcccactgctgggtatatacccaaaagaaaggaaatcagtatatcaaagaggtgtctacactcctatgtttgttgcagcactgtttacaatagctaagatttggaagcaacataagtgtccatcaacagatgaatggataaagaaaatgtggtacatatacacaatggagtactattcagccataaaaaagaatgcgatcctgtcatttgcaataacatggatggaactagaggtcattatgttaagtgaaataagccaggcacagaaagacaaacatcactgttcccacttatttgtgggagctaaaaatcaaaacaattgaactcatggagctatactgaactcatggagatacagagtaaaataatggtcaccagatgctgagaagggtagtggggtttgggcggtggaaatggagatggttaatgtacacaaaaaaaatagttaggaagaacaaataagagtgttggtggcaaaacagggtgattatattcaataataatttagttgtacattataaaataacttaaaaagcataatttgatcatttgcaacattaaggataaatgctttaggtgatggatatcccatttaccctgatgtggttattacatattgtatgcctgtgaaaaataaagtaaaatagctcatggataggaagaatcaatatcgtgaaaatggccatactccccaaggtaatttatagattcaatgccatccccatcaagctaccaatgactttcttcacagaattggaaaaaactactttaaagttcatatggaaccaaaaaagagcccgcattaccaagacaatcctaagccaaaaaaacaaagctggaggcatcatgctacctgacttcaaactatactacaaggctacagtaaccaaaacagcatggtactggtaccaaaacagagatatagaacaatggaacagaacagaacagaggcctcagaaataataccacacacctaaaaccatctgatctttgacaaacctgacaaaaacaagaaatggggaaaggattccctatttaataaatggtgctgcaaaaactggctagccatatgtagaaagctgaaaacggatcccttccttacaccttatacaaaaattaattcaagatggattaaaaacttaaatgttagacctaaaaccataaaaaccctagaagaaaacctaggcgataccattcaagacataggcatgggcaaggacttcatgactaaaacaccaaacgcaatggcaacaaaagccaaaattgacaaatgggatctaattaaactaaagagcttctgcacagcaaaagaaactaccatcagagtgaacaagcaacctacagaatgggagaaaatttttacagtctacccatctgacaaaggggtaatatccagaatctacaaagaacttaaacaaatttacaggaaaaaatcaaacaaccccatcaaaaagtgggccaaggatatgaacagacacttgagaagacatttatacaaccaacagacacatgaaaaaccacaatgagataccatctcacaccagttagaatggcgatcattaaaaagtcaggaaacaacaggtgctggagaggatgtggagaaataggaacacttttacactgttggtgggtctgtaaactagttcaaccattgtggaagacagtgtggcaattcctcgaggatctagaactagaaatactatttggcccagccatcccattactgggtatatacccaaaggattacaaatcatgctgctatgaagacacatgcacacatatgtttattgcgacactattcacaatagcaaagacttggaaccaacccaaatgtccatcagtgatagactggattaagaaaatgtggcacatatacaccacagaatactatgcagccataaaaaaggatgagttcatgtcctttgtagggacatggatgaagctggaaaccatcattctgagcaaactatcacaaggacagaaaaccaaacaccacatattctcactcataggtgggaactgaccaatgagaacacttggacacaggatggggaacatcacacactgaggcctgtcgtggggtggggggaggggggagggatagcattaggagatatacctaatgtaaatgatgaattaatgggtgcagcacaccaacatggcacatgtatacctatgtaacaaacctgcacattgtgcacatgtaccctagaacttaaagtataataaaataaaaataaaaataaaaaaacaaaaataaagaaaaataaagtaaaatagctaaaagagtataactgaattgtttgtaacacaacaaaatcataaatgcttgaggtgatggataccccatttaccccgatgtgattattacaaattgtatgcctgtaaaaaataaaataactaaaagagtataattgggttgtttgtaacacaaaggaaagataaatgcttgaggtgataacacctcatttaccctgatgtgattattacgcatgtatcaaaatatctcatgcaacccatatatatgtatgtgtgtgtgtgtgtatatatatgtatacatgtgtgtgtgtgtatgtatatatatatatacctactatgtacccacaaaaattaaaaaataaaaaagaaagaataggatgtagctaaataaatacacaaataacacaagggaggcaattcctataatagcttctttaattgaaaaatctggcccttcaacatcagctgacatagggcaggaatgagcctgtcttagtgtctctgccatgcccagtcattggtacatggcttcactgcaaacacagtgatggatttcagagcccagcagctggggcctttggtcagttatgctgtcatggttgaaggtcttccaggccattctcatggcagccataatatatttttgttaagaaattctaccaaagcaaaatatggttgaggtaggtatcaaaaaaaatctgacccctgaagaaactagatagatcttggaaaatgactgttgactagtgcaaactcaatcacaacatagccccatggtttcatgtacatgatatacagctgttggtttggtaaatgccttctttcctatcccagtcaggaaccaagatcagaaatattgaggattcatatggaagagacaacaaatatttatacttttgccttagtactatgttaattcttacacctctgccataatggaatccaaagagatgtggaaatgttaactcttacaccctctgtcataatgaaatccaaagagatgtgggtatccctcagaatactacatcgatcccttacattgattgacaccattatgctgatccaacaggatgagcaagataagactaacataccaaggaggccttgctaagacacatgctccagaaggtagaatataaaccctttaaagattcagggacctgatacttcagtatagctgttaggaagtctattatcaagggcatgcaggaacatctcctcctaagtaaaagacaaatggccaaaccttgtagaccctactataaagaaataaacacaatgcctgatgggtctctttgggttctggaggcaacacatttcatacctaggaatattgctctggcccatatagtgggtaaagcagaaggctaccagttttgagtggggcccagagcaggaaagggctctgcagtagaccaaacctatagtgcaagcaaccttgctacttgggccatacatctggcagaccctatgttcttggagattccggtgttgaaaaaaatatgcaaggtggaatttatgggagagatgtgggagaatcaaagtgcactttgagttgcccctggagttttagggcaaggccatgccaaagaacatacatatcacttgaaaaatagctcctggcaagctattagtccctgatagagacagaacagttaaccacaaaataatgataatgatcatgcatttagaaatgcccactatgagctgtgtcctgttagacccaccaagtcttaacatcaagtaggcctagcagcaatcacaataaatgtggaaatggtacatccagaacctagtgcaagctgaaccagaagacaggcaaactgcatgagaacgtagccccgactgccatatcacccactatagctgctctagtgcccttccctcaactcacactgatgatcatattggagggtcccatatgaccacctggaagagaaagaaaacttccgaatttggtgtgtggatgggttagcttggggtatgggtgcaagccaaaaatgaaaagtggctgccttacagcctcactcaggagcagccttgaaagacagtgttcttcccagtgtagactcaagaaaaagaaagacagtaaagagggaaaaatgtacccagtgggcagaactataggaggtgcacctgatcatctattttgtatgagtggagacatggtccaaggttagaataaatacagacttatagccagtgatgaatggctgggtcagggcccagaaagagaaagattggaaaattggagtaaacagcttctaggattattggcatgttgattgacatatagaagtggacacaaattgtgacaatctttgtgtaaaatgttaatgtccatcagaggagatctaccatgaaagagagactaaacatcaaacagtctaaatggttggccagttgatgctaaccagccttcttcatcactcaccccaacactggcaaaacaggttatgaaagaagtagcatggtggtagggacaggggctatgcatgggcccaaagtatatgaacttccactcacttagggtgttctaggtagttttaaatgtctaaaatgccagtaacagtaaccagtgctgaagtcctcatatgacacaattccccaaggagaacaatcagccacttggtagcaagtttactacagtgggctgcatctatcctggaagggccagcagttcatcctcacagggctagatacctattctgggtatgggtttacttttcctgcctgtagaacctcacccagaacctgggaacttatgaaatgcatgatccacaactatggaattccacacagcatggcattcaactaggagacccatgttacagcaaaggagttatgggaatgagcctatgaccatgggatacatcgatcatattgcatactacaccatccagaagtagctgacctcacagaaaactaaaatggcctcctaaaggcacggtctcagaggcaacactcagaaggtatgaattaagtcagagatcaccatatgatactgtgttctctacaggaataataaaaggttcagaaagcaaggagtggaagcaggaatggccctactaagcatcactaccaatgacccactgcagaatcttgtgtttctggtcccttaaactctaagttttatagtgttagaggtcctagttcccaaagggagtgcactcttaccaagggacacaacaggataccactcaactacaaactattactgacaactggacacctgggcttcttgtgaccagcagccaagaagagggctcaccatcctatcaggcgtaattgacactaatcatcaggagaaggtatggataatatttcacaatgagaatagagaggagtaagtgtggagttcagatgacccacctgggtgcctcctggtactcccctaacccattgtaactatgaataaacatatgcagcaaatccagtctgagaagggtatggttaccagggactctgatcttttagtaatgagggtttgagtcagacaccagacaagccaccaacacctgccaagttggtagctgagagtgagaggaatttagaatggatagtggaagagggaggcaatgagtaccagttgaagcccaagaccagctgaggtagggttggagagctgtactttatcccactaacccttctcttctaagaaaggctcacaagagacctgaatgaacttctccatgaacatgtatggagaagcggagcagcatgatacaaggggtggactgcggcagacctacagatgtgtcactcagatccctcttcaagaaaggactcacttcacagctgtaaggagagtaattatttcatagccacctagctgttagcaccttcaggattggcttcagttcttgggccaaggtcatgctcttcttggagcagcccctagtcaatgactgaaaaaggctgtggtgcacagatctagccatttctgtccagtgcagatgcttccaatgggaatctgtttcagaattccccactggactgacagaaactttctcaggtgtgcattgagactgatggtgcctcctgcccaatcctgcttccttttcaatcacaggcgtcactctctaacaaatctcagtgactacttcccagaaaacccatccttcctgcaacagtccgttttaaaataacgtgctccatctttaggaattgtgccccttgcccctactccaaatactggggaaactatgtggcttaagtcaccttgtagtagcagagggtaaacaagactgccaagagtaaaagtgttccttttactcttcactttgcctttgacaaatatcctggtgaaacgccaggcttctctaaaatggctcaggcattgagggtcctaccatgggccttcctttacttccaactcctgccccatacctgaccctcatcagggaccatgccttaatactggtcactttattgtggaaataaaaagccctaaaatcatctgagagaaacagtttgcaagtcttaatgtggctttcctctcttctattttctctggtgggattacttacaggcataaatatgaaaaatacatatcacatgcgatgattcacaattattaaaattaaataagaggaaatctttggcattcacattcattttcttattcggaagagacatcccattctactgattgcaatataaataagtttggaataatgattgtgatattccattaaactaatggattcaatctcataagtcatttttatggataaaatttaacatactgtattaattccaaacagaatacatgtgcagtttgttacaggaaactagattactacatgtaatgtcaacagtcattacttcctggtgttatttacctgatcccaatttcctagctaataccactgtgtgtgtaatgaataatgcactgtggaaatgtacactgtgcaaaaacacactatatatagtacagttattagcgtggacatcacctaataaaatagtttgcatttcttccctgcctcccacccgcttcccactatttttaatgtaatatatacccggaagaaacacttcagaggtggggaaggacgtccaaagtgagcaactttttataactatttatttactattaagatgtaaatgagcagacaagtaataaccacccagatcaagcaagaaatggaaagctttcaacacccccagaaagctctcttgtgccccctcaccatctatacctaggaagtagccactattttaatttgtatcaccacagattcgtttcaaagtgagcaacttttaaaaactgtaaattcggtgcttaaaaatctcctaaagcaaagattgaagttatttgtcactattgcaaaaacaggaaaagtccagcactcagcagtgaggcttaacaacaataactttcagtttttcaggtggctgactggctagttaaaaattatccaaacctggtgttcgcaggcgccgccgcgccgccgtcgctctccaacgccagcgccgcctctcgctcgccgagctccagccgaaggagaaggggggtaagtaaggaggtctctgtaccacggctcctacaaagcggactgcccgcaaaccgaccagtggtaagcacccaggaagcaactggctacaaaagccgctcgcaagagtgcgccctctactggaggggtgaagaaacctcatcgttacaggcctggtactgtggcgctccgtgaaattagacgttcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattacgccaaaagacatccagctagcacgccgcatacgtggagaacgtgcttaagaatccactatgatgggaaacatttcattctcaaaaaaaaaaaaaaatatcttcttcctgtcattggtagtactgaacgttagatatttttttccatggggtcaaaaggtacctaagtatatgattgcgagtggaaaaataggggatagaaatcaggtattggctgtttttccattttcatttgtgtgtgaatttttaatataaatgcggagacataaagcattaatgcaagttaaaatgtttcggtgaacaagtttcagcggttcaactttataataattataaataaacctgttaaatttttctggacaatgccagcatttggatttttttaaaacaagtaaatttcttattgacggcacaaaaaaaaattatccaaatctccaaccttacttctccctttagagtgtttaaatcagtaatcagttccttcgcttttttttttttttttaatctctgcccttcctcacccctccattctgcctctctggtcaccacttcctacaccaagtggagttctggcttttgagagttaatcgtacacatctcttctgaactccatattcagtgatgttcaattggtagcttaaaattggtagccatggtggaagtatttacacaacagaaaaaactgcaaatgctatacctctgggccccgctgcccccagtgatgattgctaaatgtttatcaggacaccaccaggccactataatacacacacacagacacacacacacacaatacattcaaattatgccaaatgcctcaaagagctttggggattaaaaatgctatccagtcacacaaagcaaaaccaatcacagaagattagtaggagcaagtttcaactcagccagtcttttcagattcatactagcttgccactggtggtggtttggttttgcatcaaatgtcactttgtgaattggttctacaatatgtaaatgcatagtaatttcctaattgaggtaaactattgctaacctcacctgaaatatttgcaatagacttagagacacaataatatattgcagaaatagttgaaaattcactgtgtgaaacagaattttaataacttgtctctgtattacaatctctatctgttatttatggcttcaggcatataatactttgtctccgaaccagacagtaagtccattgggatcaaaaatagtgacttcttcttactttaaattcttcacagtgcctagcatagtattaggtttcaagcagatggcaggtagcaatgtattaaattcactgtttcctctcctatttccttctctattccatccccctaatcagttaccctatactttcttagttactccctaccatctctctaatccacccagtcacacaaaacaaaccctaccacaaaaattaagaagagtattataaatattctgtatttcagaaacagagtacgttcatttgacaaatatttgaacactaacacgaggggcattgttctaaatattgtaggtacatgcaaagatgatttagacacagacttttactcgaaggagattccaggtgaaaagaatagattatacactgtcttagttcattttctgttacttataacagaatatacgaactggctaatttataaagaaaatgaatctatttcttacagttatggaggctgagaagtccaacgtcaaggggatacatccagtagcttgtggggactctctacagggtatcacatggtaagggggctgagtgtactagcttgggtctctctttttagttttataaagccaatggtcccactcccatgataactcattaatccattaacccattaatcagttaatctatgaacagattaatccattcataagggtggagccctcacaactctatcacttcttaaaagccccacttcttaatactaccacattggggattgaatttcaccatgagttttggaggagacaaacattcaaaccatagcagatacatatttaagaaactctgatacaagtaggaaaataatccagataaaatgccatgggagtgtaaaggagggagaaactactttccactaggatagtttttggacatgccgagttggaagtagaggtagaggagtaaataaccaaagcaggaaagcacaggagcacacaccagaaacagcagtttgtctggagtgtaggatgtggaaggaggaacagcttaaaatgaagttggaaagcggaggtcagattatatagaattatcaatattttactaaagagtttgagctttacctttggtctttgtgttactcaaagtgcgccagattatgttgcagtaaaatccacaaaaccaatgacttaaaacaacaatatttatttcttaatcatgctacatgtacatcatgagtactctgggggcccctctcccttggatccaggccaacagagcagccaccacctggagccagagggacaaagaatggggcaaattgtacacgtgctcttaaagcttctgccccaagatatcacacatcacttctgcccacttttcattcactataacaagtcacatcgttactaaaatatcaaaggtttggtctaggtcccattgctcatagcatggaaaaccaatcactgagatgagtattgccagggaagaaggctttattcaggtgctgcacctgagaagatggaagatcagtgtcaaatccatttccctgaccaactaaaactaggggtttatatagcaggaaagaaatatgaccatgtgtgggaaaacaggaattagagaggggataaagaagaggagttggtcaacaggaagcaggtggttggttaggcaataatgatgggtgagggatctggcatcttattgtccagatgtggtgatctgataaatttcagtttcttgataccatctgaggggcctgatggttggtttcctgagaaaggaactcagataaaacaaatgtaattttctcaagttttaagactgggagggttaatttctacatgtattcaaaagaaaccataaacatcagttctaagggacaattatgccagtttcaacatgaccacacctaacttcaagggagtggggaactgcaatcttaccatgtgcctagtggagtggagagcaagccagacatatttaatagcactaatgactaccagagtctttaagaaggggttggatatggtcatatatagatttcagaaagatcactttagcagtgcatattggaaggacgtgagggatgctaacctggaggaagaaaacctagtcaaaaggctggtgtagtattccaggggcaagatgatggtggtctcctctagagcaaggtggaagaattaaagaaaaaggaacacatgcatgagatattcaatgagatactaaggagaatcaacaggactaagccaacgggccatgaaagtaggaatggggtaaatagaactgctgctgttagaaatgtctgttgggcagagattgtggtggtgcccagggctgttgaggtgtgactggtggtggagcaaggctggcaagtatggttgatggtttttcactattggtggtgagctgtgaatagtggctggtgggtgtgggtggtaaaattcagtataactgaagcatatatgaggtggggagtagtaggaatttagaatggatgggaaggtagccaagagccaaataggaaagtctttgactaccatggtatgtggtttggattttatcataaagacaaaagaaccacctaattattttaaacatatcatcctgatgatgcttcaagtacatggcagttataaaatgagaaaatcatgtggtaaagtaaggccaaggatagctggccaaccagtatatgcatgaatctgacagagttcgagagcagaggggtgggctgtgtaatgtagactgcattgccataattcatatctatctgacatttgataactgtctagacaaaggttaattggaatgcttcttgttttcacaaacaggattttaattttccatttttattttatactcatttttccaattcatttccacttttgagcatgcccacagggacaccaagtttagagcaggctctacttgccagaaacttccttcatgtattaacttcaaaatctggccttagtggaaaaactgagttcagagaaatgacgaacgatttggtgactgctatgaaagaagtctgagaagttagcacatgtttggcagaatggactgaaactctgcagagtgaaaatctcagacctgaagttgtcttcatgaggaatttaaatgctaccatcatctccaatatttatgttaatgcaggcttcattgcacttgaaagttcagaaatttgagcatcaaaatgcaaagataccatagacatgaaataaaaatagtcacaaggatatttatatctaataaagttcaacaaccaagttatcgacacatggcaatccacatattgcagaaattgaagcaaaatgaaacaggtaagaagctgctaactcactacattaacaattttagagccctttatagaaaaaaaatacttaaaatctactactgaaagctaaatattggaaaataaatcagaagatattctatgtggagttcttaatgtagtctaagaggatggggaggaaaaagacagaaaaacattccagttagtaaagaactattgaacataggcaaggcagatacagagaaaagggaacagacacacgagacatttaaactgacccacaaacacagcactaccaatttgtgagtgcttgatgcgggccaggcaccatattatgtaatttgcatacattatttcattaatcctttcagcttcctttgaagtaggaacttacatcagatattgtctatgggtacttgagtccacacctgactttctatctgtaatcttccctgtattgcccaggttgggagccagaaaacctacatttccaagactctcttgccagctagattttggctagcttttgccaatggaaggctctctcacgaggtaattaagtaggagaggagagagaaactattctgcatctggctttggcagtggaagcaccccgtgactgcaggtaattacgggctccagcagcatcagtggagttctaggagccccagcagcactgtcagcagcaagtgcatgctcacagactctaggccaggggtgtccaatcttttggcttccctgagccacattggaaaaagaaaaagtgtcttgggccacacataaaacacacattaataatagctaacgagctaaaaaaaaatcacaaaaatttcataatgttttaagaaagtttacgaatttgtcttgggctgtattcaaagccatcctgggacatatgtggcccatgggccgtgggttggaccagcttgctctagggatattaattttccacatttttgctcctccatccttagagagctgtggttttctatagttactgacatctaggttataccaccctctgccttttgcacctccagcctttccaacacttttgtaatcaatttcctatattaaatctccatctgtttgaagcacctagagagatttctggcttttccattggcaacacatcatatcatttaaccttttcaagaacgctttaggcactattatccttatttcagacataatccaaatatcacctggcctaaacaatcttttagatacaaatgaattcatattaacatctattatccagaatttctttttacatatcttccttccctcttccttgaacccctagaatgtctactacccctctgaaaagctccccccagtattttggggaatttttaaagggaagtattatatgtctttcaaattatttaaggcactaaattgcatgtgacagagacctgcctcaaattagctgaagcaaaaaaagtaatctgattggcccacatgactaggaagtattttgagttagaccagagaattgaaggaagaatgcagaaccagggccctggctgaaacttaatgccatcagaaatttctctgtcttcattcttctcttatgtctgccgttttctaattggcttcactctttcctattacagattgtccttatctacatggaagggaagagagccactggcagctccaacatcacacccttagagtatggccatagagggtgacccaagaggctagatgacatttcctccatctgcaagtgaagaatttagggcaaggattctgattagccattttagagcatgtactcatgtcagttttattttgtgttgctatttttgttttgttttgtttttttctttattttattttattattattagactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcggtgtttggttttttgttcttgctatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgagtagtgccgcaataaacatacatgttcatgtgtctttatagtggcatgatttatagtcctttgggtatatacccagtaatgggatggctgggtcaaacggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggtgttgatttgcatttctctgatggccagtgatggtgagcattttttcatgtgttttttggctgcataaatgtcaggcattaccattcaggacataggcatgggcaaggacttcatgtctaaaacaccaaaagcaatggcaacaaaagccaaaattgacaaatgggatctaattaaactgaagagcttctgcacagcaaaagaaactaccatcagagtgaaaaggcaacctacaaaatgggagaaaattttcgcaacctactcatctgacaaagggctaatatccagaatctacaatgaactcaaacacatttacaagaaaaaaacaaacaaccccatcaaaaagtgggcaaaggacatgaacagacacttctcaaaagaagacatttgttttgtttttttcttggaagggagagaaaggcacagcatgacacctgaataaggagaatgaaaaaaaactgttaggtgaacagaaacaaaaacaaccacagaccactatagttgtcatccccacccacccatatccccttccaatgctgctctgacttgcaactgtcaatgcccaactgcctgaaaagccagtgtactttccaacttttgttaaacctcaggaaggctaaaaggtgcatgagaacaactgggggcctcacaaccatgtgagttttttcattaggtcatcagtgtcctttctccctagatgtaatctacatcagggcagggatttttttttgtctattttcttttttattattattaacgttggttatttatttatggacctactcattttagcatggtaaaatgtactcaaaataaaatttactattttttcttcaacttttaagttccagggtacatgtgcaggatgcgcaggtttgttacataggtaaatgtgtgccatgctggtttgctgcacagatcaacccatcacctaggtattaagcccagcatccattattcttcatgttgctctctccctccaccccccaccaatgacaggctccagtgtgtattgttcccctcgaagtgtccatgtgttctcatcgttcagctcccagttataagagagaacatttggtgtttggttttctgtttctacgtgagtttgctgaggataacggcttccagcttcatccctgtccctgcaaaggacatgatcttgttcctttcagtgacattaagtacattcacattgctattcaaccatcgtcaccataaatctattttcagaactttttcatcttccccagctgaaactctacgcccattaaactataattatccatttccctctcccctagtccttgggaaccaccattctactttctgtctctatgaatatgactattataggtacctcatataagtagaatcatatagtatttgtacttttgtggttggcttacttcacttagcataatatcttcaaggtctacccacattgtaggatgtgacagaacttccatcttttttaaggctgaataatattccactataagttgatgccaagttatgtttatacatccattcatcaatgaacatttgggttgtttctgtatcttggctattgtgaataatggtgctattaacatggctttaaaaataccagttcaagtccctgctttcatttatttggggtatatacccagaagtggtattgctagaccacatggtaattctgtatttaattttttgaggaactgccataccgttttgcacagtggctacactattttacactcccaccagcaatgaagaagggttccagtttttccacgtcctcatcaatatttgttattttggttttttttttcataatagacaccctagttggtatgaagtagtatcttattgtggttttgatctgcatttcgctaatgattagtgatgctgattatcttttaatgtgctgattagccgttgatacatcttctttggagatatgtctgcttgactcttttcccattttttaaccaggttgttgtttattgttattgttgttgttgaattgtatgatttctttatatatttggaatatcaatccctaatcagatatatgatttgaaaatattttctcacattccataggttgccttttcactctgttgatagcatcttttgatgcagaaaccttttttattttgatgaggttcaatttatctattttctcttttgttgtctgtgtttttcatgtcatatccaacaaatcattaccaaatctaatatgaggctttttcctatgttttcttctaaaagtttatagttttagctcttatgtttaagtcttcaatccattttgagttaatttctgtatatggtataatgtaaggattcaattcattttcttggatgtggatatccagttttcccaacactatttgtcaaaaagactgtactttccccattgaatgatcttggtactcttgtcaaaactaacttggccatatatgtaaaaatttatttctgatctctatgtttctactctattgttctaaatgtctgtctttatgccagtatcatactggtttgattaccatagcataatgtactgtaagttttgaaattagaaagtatgagacctccaactttgctcgtcttttcagagattttcttggctatttaatgcctcttaaaattacacaagaattttacaatggatttttctatttctgcaaaaagaagaaaacacccatgggtgaacaagataccttggcacatgcctgttgtctcagctactggggagactgaggtggaaggatcacttgagcccaggagtttgagacccctggacaacatagcaagactctgtctctaaaaaaattaaaaatgacaccattgggattttgatagggattgcattgaatctgtagataactttgggtagaactgacatcttagcaatattacctcttccaacctaggaacacaggacatattttcatttattagtgtcttctttgatttctttcagcagcaatttgtagttttcagtgtacaagtctttcatcgccttggttaagtttatttctaagtattctattctttttgatgctattgtaaatgacactgttttcctaatttccttttaagttaaaactgattttgaaattaaagctaattttgtacactgatgttatagcttgcagctttgctaaattagtgtatctcttcttaacacctagattcctaatgtctatcgcctgtaacatagtgggtactcaataactgtctattgagtaaacaaagaagtctcttgaaagagcctccctcttgctgctgctaatggtgcttctcatgagaatgttcattccaatgatgttatttcactaatgagaaaagccttctcccagatattgta

SEQ ID NO: 133 - DNA, 229072 bp, Homo sapiens
tttgtctatctggatgacaaggtgactttcagatgcagtctgaaggaatgtgactgtcagcggggtccgaggctgtccccaccatccccgaagcaccgtcaacactggcatcctggcaccgagtggacacaccctggaaaaggctcactgccacccatgggccctgctctagcaaggacagaagatgaactgggcttccagttactctggggggtttagggaggatgactctgagtgctaagccactaaatgcagccccagttagtcaggtttggctgggacaccacaaatgatgtgggcaaaggcctggagcactggccatccagcccccacgccggtagctgtctctggaaaagtgttggactgaagcccaagcctgcttccgtgccctgctgagctgggcagtcaaccccggcttagcttttgctgccctgacggagccccagcccttggtcaggctgcacatggcagcttggtgggcacagggtagccgtggatcaagaccaagaaagggacagaggccaagggctttcccagcttcagtccacctgctcgggacaactggtgctccaagcaccaagtagagctcccagccctgagatgagcgtcctcaactcctttcagggaagcatgaacccatgcctgtggcccacccatccctgcgcctgggctcagtgaggccactggggcaccttcaccttggataagagttcagaactttgaagattaagctggaccagatctgctcatcctcacagtacatttcaggagcatctcaatggctcccaccctggcctggaaccctcctgtgctgccgagatatcagggaggcgctgggtactgcaaggggaagatggcattgctatggagccactcttggtgaaggtcgaatgggtgacattggaagtctagcttttcctgaggctggggtctggaccttggtctagatcaggggtcagcaaatttttcttgaaaatgtagacagaaaatatcttaagctggccgggcacggtggctcacacctgtaatcccagcactttgggaggctgaggcaggcggatcacaaggtcaggagatcgagaccatcctggctaacacagtgaaaccccgtctctactaaaaatacaaaaaattagccgggtgtggtggcgggcgcctgtagtcccagctactctggaggctgaggaaggagaatggcgtgaacccgggaggtggagcttgcagtgagccaagatcgtgccactgcactccagcctgggcgacagagccagactccatctcaaaaaaaaaaaaagaaaaaagaaaatatcttaagctttgaggaccacatagtctctgttgcaatcactcatttgggccactgtagcacaaaaacaaacatagataacacacacatgagtgagcatggctggggcccaataaaactttatttacacaagcaggtgatgaaccacggtccatagtgtcccaatccttgatttagatggtgaactatcatgagctttcgttgccctctccggtagaaatatgggagaaaccacagagagaaacagagatttcaggaaaacagtaaaattaaacaaataaagtgagacgtcgcccctcctggaggctgcaggctgtgttgaacctgtgtgtgtctgggtgtacagggatgtgagtagatgcgcgtggagatgtgtgtgtgggtggagactgagcgtggctggaggtggctgtggtaggatgccagaaggaaggagtttgcattcagttcctttattagtactctctggagttgttgaggggatgtcactgctgaacactgaccctggtgcaggctaaaccgaagttagcctctgctaccctctgctgggtgaggcactggggagaacagtgggactgaatggggcgggctttctccctcccacacttcccctggaaacacccagcaccagcacattagaacatggggagccaccttccccagcgctgcttcccaaggttcggaaggggaaactctgacctcaagctctgtttgaagagcgatagcaaaggggagaggttggctgtggtttggtggtgcttatctccttcctttgctttgaaaccacaggctggcatactacccgagagaatgaccagtgccaccaagggaagggcacaagctcactggttccaggggagacatctcaggggacaggaacatcccctgacgctgaatgagtgcagcacacagacggagaatacacacaagagaaatcatgaggacatgagagaaggcactggcaataggaagttacaaaaagcaacaaaaagaaagagtagatataaaaacaataatcgaagaaagccaacaacagatgggatgaatcatacgaggtatgcgactcatggatgaagaggtgagtgatgagatcagctggggaactctctcccaggaaagacaaaccagaagaaacacaaatgacatcgaagtggccaggcgcagtggctcacgcctgtaatcccagcactttgggagcccgaggcaggtggatcacttgaggtcaggagtttgagaccagcctggccaacatgatgaaaccctgtctctactaaaaatacaaaaattagccaggtgtggtggcaggcacctgtgatcccagctactcaggaggctgaggcaggagaatcacttgaaccaggaagcagagattgcagtgagctgagatggtgccagtgcactccagcctgggcagtagagtgacagcctgtctaaaaaaaaaaaaaggcagtaaagtgataggaggatagattagaagggccattttccagatagtgcaaggaagaaagaagaagaagaagaggaggaggaggaggaagaggaagaagacggagaagagggcatctcagaagaaacaatggagatacatttctcaaaactgaagaaagatgaccaacctcagaccgaagggccaagaggccaaaccagagagacagcttggcaagccaggaagagcaccaaagctagacaattagagtgaaattaaagaaaacccaaggtgacaaaaatttaaaaagcttccttgtgacctcagtccattggtgaaaatttaaaaaaaaaaaaaaaaaaaaaaggacagcctgggcaacatggtgaaaccccatctctacaaaaaatacaaaaattagctgggtgtggtggcacatgcctgtagtcccagctattcgagaggctaagtaaggcaggaggatcacttggggccaagagttccagaccagctgcggcaacatacatgttgtgggaagtcaggcaccccgaacggagggactggctgaagccatggcagaagaacataaattgtgaagatttcatggacatttatcacttccccaatcaatactcttgtgatttcctatgcctgtctttaatctcttaatcctgtcatcttcgtaaactgaggatgtatgtcgccttaggaccctgtgatgactgcgttaactgcacaaattgtttgtagaggacaattgttgtgtgtttgagcaatgtgaaatctgggcatcttaagaacaggataacagcaattttcagggaacaagggagataaccttaaagtctggctgcctgtgggctgggcaggacagagccatacttctcttattaccgcaaacaggtaagagaaatatcgctgaattctttccccagtaaggaatattaataattaacagccctgagaaaagaatgcattcccagggccgggccactgaaatggcctccctgagagtgcctgcctttattcagaagtagaaagggatgaaacacgccctagtctcctgcagcacccccagacttgataggattaggaaattccagcctggcaaattctagtcagaccggttctctgctcttgaaccctgacagtgcgtgcacagtgggacctggaagttcattagtgattctagtttcgccgtgaccttctgccctgtgatcttttgtcgcccttgaagtatgtgatctctgtgacccacaccctgttcgtgcactccctcctctttgaaaattgctaataaaaactcgctggttttacggctcagggggcatcacggaacctgcggacatgtgatgtctcccctggacacccggctttaaaatgtctctcttttgtactctttccctttatttctcaggccagccgacacttagggaaaataggaaaggacccacgtgaaatattgggggctgaatttcccccgataataagtctcttaaaaaagacttttaaatgaaatttctttgttttttaacttttatttctgttttgggggtacatgtgaaggtttgttacataagtaaactcgtgtcttcggtgtttgttgtacagaatatttcatcacccaggtattatgccgagtacccaatagttctcttttctgctcctctccttcctcccatcctgcaccctggagtcaaccacagtgtctgttgtttccttgtttgtgttataagttctcatcatttagctcccacttacaagtgagaacatccagtatttggatttctgttcctgcattagtttgctaaggataatagcctctagctccatccatgttcccacaaaagacatgatctagttctttttaatggctgcattaaatgaagttttaaagatacaacataaacaccaacctcttccccaccacaaaaatcccttgctgaatttgattacacttaaattaacgagttttgtttcatgaaagactccttggacaaacttgacagttgatggaataggagaagctgtctgtcatgtctaaagccaacaagagatcaatatctagaataaatggagatctgcaaatcaacagaaagtaggcagcaaagccaaagaaaatagcctaaggcacagccactaaaaggaacgtgatcatgtcctttgcagggacatgggtggagctggaagccgttagcctcagcaaactcacacaggaacagaaaaccagcgagaccgcatggtctcacttataagtgggagctgaacaatgagaacacatggtcacatggcggcgatcaacacacactggtgcctgttgagcggggtgctggggagggagagtaccaggaagaatagctaagggatactgggcttaatacctgggtgatgggatgatctgtacagcaaaccatcatggcgcacacacctatgtaacaaacctgcacatcctctacatgtaccccagaacttcaaataaaagttggacggccaggcgtggtggctcacgcctgtaatcccagcactttgggaagccgaggcgtgcagatcacctaaggtcaggagttcgagaccagcccggccaacatggtgaaaccccgtctctactaaaaatacaaaaatcagccagatgtggcacgcacctataattccacctactcgggaggctgaagcagaattgcttgaacccgagaggcggaggttgcagtgagccgccgagatcgcgccactgcactccagcctgggccacagcgtgagactacgtcataaaataaaataaaataacacaaaataaaataaaataaaataaaataaaataaaataaaataaaataaaataaaataaaaaaataaaataaaataaaataaaataaagcaatttcctttcctctaagcggcctccacccctctcccctgccctgtgaagcgggtgtgcaagctccgggatcgcagcggtcttagggaatttccccccgcgatgtcccggcgcgccagttcgctgcgcacacttcgctgcggtcctcttcctgctgtctgtttactccctaggccccgctggggacctgggaaagagggaaaggcttccccggccagctgcgcggcgactccggggactccagggcgcccctctgcggccgacgcccggggtgcagcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccagtgagtacgcgcggcccgcgtccccggggatggggctcagagctcccagcatggggccaacccgcagcatcaggcccgggctcccggcagggctcctcgcccacctcgagacccgggacgggggcctaggggacccaggacgtccccagtgccgttagcggctttcagggggcccggagcgcctcggggagggatgggaccccgggggcggggagggggggcagactgcgctcaccgcgccttggcatcctcccccgggctccagcaaacttttctttgttcgctgcagtgccgccctacaccgtggtctatttcccagttcgaggtaggagcatgtgtctggcagggaagggaggcaggggctggggctgcagcccacagcccctcgcccacccggagagatccgaacccccttatccctccgtcgtgtggcttttaccccgggcctccttcctgttccccgcctctcccgccatgcctgctccccgccccagtgttgtgtgaaatcttcggaggaacctgtttccctgttccctccctgcactcctgacccctccccgggttgctgcgaggcggagtcggcccggtccccacatctcgtacttctccctccccgcaggccgctgcgcggccctgcgcatgctgctggcagatcagggccagagctggaaggaggaggtggtgaccgtggagacgtggcaggagggctcactcaaagcctcctgcgtaagtgaccatgcccgggcaaggggagggggtgctgggccttagggggctgtgactaggatcgggggacgcccaagctcagtgcccctccctgagccatgcctcccccaacagctatacgggcagctccccaagttccaggacggagacctcaccctgtaccagtccaataccatcctgcgtcacctgggccgcacccttggtgagtcttgaacctccaagtccagggcaggcatgggcaagcctctgcccccggagcccttttgtttaaatcagctgccccgcagccctctggagtggaggaaactgagacccactgaggttacgtagtttgcccaaggtcaagcctgggtgcctgcaatccttgccctgtgccaggctgcctcccaggtgtcaggtgagctctgagcacctgctgtgtggcagtctctcatccttccacgcacatcctcttcccctcctcccaggctggggctcacagacagccccctggttggcccatccccagtgactgtgtgttgatcaggcgcccagtcacgcggcctgctcccctccacccaaccccagggctctatgggaaggaccagcaggaggcagccctggtggacatggtgaatgacggcgtggaggacctccgctgcaaatacatctccctcatctacaccaactatgtgagcatctgcaccagggttgggcactgggggctgaacaaagaaaggggcttcttgtgccctcaccccccttacccctcaggtggcttgggctgaccccttcttgggtcagggtgcaggggctgggtcagctctgggccaggggcccaggggcctgggacaagacacaacctgcacccttattgcctgggacatcaaccagccaagtaacgggtcatgggggcgagtgcaaggacagagacctccagcaactggtggtttctgatctcctggggtggcgagggcttcctggagtagccagaggtggaggaggatttgtcgccagtttctggatggaggtgctggcacttttagctgaggaaaatatgcagacacagagcacatttggggacctgggaccagttcagcagaggcagcgtgtgtgcgcgtgcgtgtgcatgtgtgtgcgtgtgtgtgtgtacgcttgcatttgtgtcgggtgggtaaggagatagagatgggcgggcagtaggcccaggtcccgaaggccttgaacccactggtttggagtctcctaagggcaatgggggccattgagaagtctgaacagggctgtgtctgaatgtgaggtctagaaggatcctccagagaagccagctctaaagcttttgcaatcatctggtgagagaacccagcaaggatggacaggcagaatggaatagagatgagttggcagctgaagtggacaggatttggtactagcctggttgtggggagcaagcagaggagaatctgggactctggtgtctggcctggggcagacgggggtgtctcaggggctgggagggatgagagtaggatgatacatggtggtgtctggcaggaggcgggcaaggatgactatgtgaaggcactgcccgggcaactgaagccttttgagaccctgctgtcccagaaccagggaggcaagaccttcattgtgggagaccaggtgagcatctggccccatgctgttccttcctcgccaccctctgcttccagatggacacaggtgtgagccatttgtttagcaaagcagagcagacctaggggatgggcttaggccctctgcccccaattcctccagcctgctcccgctggctgagtccctggcccccctgccctgcagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctactatgagcactgtgtttcctgggacggggcttaggggttctcagcctcgaggtcggtgggagggcagagcagaggactagaaaacagctcctccagcacagtcagtggcttcctggagccctcagcctggctgtgtttactgaacctcacaaactagaagaggaagaaaaaaaaagagagagagaaacaaagagaaataaccatggtcactgtcctggagcaccacacagtgtatatagaaggagaaaagtctcatagaaacatgctttctaggcacagcacgtgcctgtcagatggacagactccaggatggagggaaatgagggattctgggaaggagggatgtgaggagttccctgtcctgggggattagctgagtagctctgagcagcccaggttggtgggagggtcattctgcttggatgggggctttcctggcttcctgctgacttgtgagttttggtgcatcctaggcaagcaatgacactactgtattaggattctccagagaagctaagccagtaagatgctgtagggcaggcaaaattttatctctgtccttttagggttttttggctgggcctgagaactaaagacatgagcaagagaaaagcattcaaatttatctaggctgggcatagtggctcatgcctgtaatcccagcactttgggaggctgaggcaggtgaatcacttgaggtcaggagttcaagaccagcctgaccaacatggtgaaaccccgtctctactaaaaatacaaaaattagccaggtgtggtggcggttacctgtagtccctgctacttgggaggctgaggcatgagaatcgctctctctctcctgccaccttgtaaagatgtgcctgcttccccttcaccttccaccctgattgtaagtttcctgaggcttcccagtcatgcttcctgttaagcctgcaaaactgtgagtcaattaaacctcttttcttcataaattactcagtctctgataggtctttgtagcagtgtgagaatggactaatacactgtttttgttttgttttgttttgttttgtttttgagatggagtctcactctggtgcctaggctggagtatagtggtgtaatctctgctcactgtaacctctgcctctcagactcaagcaattctcctgcctcagcctcctgagtagctgggattacaggtgcccaccaccgcgcctggctaatttttgtatttttagtagagatgggctttcatcatgttggccaggctggtttcggacttttaacctcacgtgatccactcgccttgggctcccaaagtgctgggattacaggcgtgagccaccgcacccagcctaatacgctatattaatcagaaactgccaactaacctctaacttgggacttttcactctaaccagtcaaaattgttttctttgtctggcttctgcaaaatgattaagtttcacttcccctctaatagaagcactagctgctttggtcttgtgctatcttaatttatgtgtcactgaatgctcaaataaactctttagaatgtaaatgggcttaagtttatcttctagcagatctgatgtcagaggtaggatccttcagaaggacatcagaaggatctgaaggatttctccccatcctgggcccagtgatggtctccaggagcaatgagcaaacaggtgtaggcatttcactgagccccctgcacgctgcttcctgcagcatatttgaaggtcatcactggtaagtcccactcagatactgtattagtcccttctcacactgctataaagaactacctgagactgggtaatttataaagaaaagaggctaagccaggtgtggtggctcatacctgtaatcccaacactttggttttttttctggttgttgttgttgttgttttttgagtcagagtctcactctgtcgcccaggctggagtgcagtggcacaatctcagctcactgcaacctccactttctgggttcaagtgattctcctgcctctgcctcccaagtagctaggattacaggcacatgccaccatgcctggctaatttttgtatttttagtagagacagggtttcaccatgttggccaggctggtgtcaaaactcctgatctcaggtgatccactcgcctcggcctctcaaagtgctgggattacaggcgtaagccactgcacccagccaatcccagcacttcaggaggctgaggcgagcagatcacttgaggtcaggagttggagaccagcctggccaacatggtgaaaaccccatttctactaaaaatatttaaaaaatcagctgggcatggtggcacgtgcctgtaatcacagctactcgggaggctgaggtaggagaatcccttgaacccgggaggcagaggctgcagtgagctgagatgacgcctctgcactccagcctgggtgacagaagattgattgactcacagttctgcatggctggggaggcctcaggaaacctacaatcgtggcagaaggcgaatgggaagcaaggcacatcttacatggtggcaggggaggtaaggggggaagttccacatccttttataccaacagagcacgtgacaactcactgtcacgagaatagcaagggggaaattcgcccccatgatcctatcacctcccactaagtccctccctcaccacgtggagattacaattcaagatgagatttgggtggggacacagccaaaccatatcacatacaaactccagaacttaaatcgagttctctgagttgagccgatctggactgggtttggaagttgtggtagaagtttaacgcatcctgtagggaggcttcaggtatctgactgggtcagacagaaactgaaatggttttagtgaaagacctctaataggtaaggttccaggaaaacaaacaattctgggctcatttaaatccagggggtctgggactccatcgcaggacttgtgctcttctagagagatgattgaatcttaccaaaaataatttagaattttggtggccacagtggggaagttttaacctaaataaaactgctcatctccagaatgcattgaaaaaaaagaggggggatcccaaacaccccagaaataatgggttgtatttttggttggcaagcagagggttctaagttctccatctttctcactagcctcctctgaatctgctgacttctttgcttggttaccttcccaccttgacgatgcaatgaaaaaaaacccagctagataagttatacaagttaggctgtcaaatcaaccatgtctgcttctttacccttatgccatagttaaaatcttaagctcagagcaataataaaaggtatccctgtccggcatagaaaatgctttgtctgccctatttgttaatgggctccaccctgacctcagtaatctagttacacatatgttgacaggacctgaggaagctcaaaattggatgcaagaggcagaatggtattgctctgaggacaatatccaaggtccacaagcccctacttggtccatatataggccagaagaaacccaaacttttgaccgggtgcagtggctcacgcctgtaatcccagcactttgggaggccgaggagggtggatcacgaggtcaggaggtcaagaccatcctggctaacatggtgaaaccctgtctctactaaaaatacaaaaaaattagccgggtgtggtggcaggcacctgtagtcccagctgcttgggaggctgaggcaggagaatggcgtgaacctgggaggtggagcttacagtgagccgagattgcaccactgcactccagcctgggtgacaaagcgagactccgtctcaaaaaaaaaatcgatgcctgatagcattttaatttatcagttagtctggaaactacacgagaagaaagaacaaaatacccttaaacaactacccccggcagggagactcattttcctgtctctcctggcctgatacgttttgcatagctcgcattcttcacactgctctaagctacttttctttctcatttccctcttttgatagatatttttctcttctgaaagcattgatgatcgacattttttttatgcatatgatttttgttcactgtcacgtaagattcaggaatcaatgtgttagatgcaagtttgtcccatgtcactgggaaggcttattcccaggccatctgtcctacttcagagagaaagaggagaggtacctatggttaaagaatttagtgaaggtgccgggcacggtggctcacgcctgtaatcccagcactttgggaggccgaggcgggtggatcacctgaggtcgggagttcgagaccagcctggccaacatggtgaaacccgtctctactaaaaatacaaacattacccgggcgtggtggtgcacgcttataatcccagctactcaggaggctgaggcaggagaatcgcttgaacctgggaagcagaggttgcagtgagccaagatcgcaccattgcactccagcctgggcaacaagagcaagacttcatttcaaaaaaaaaaaaaaaaaaaaagaatttagtgaagtctcaaggtcaaattgattagaaccacagagggacaaagcaatgggaactcagtcgagccatccgcttacaaaggagccgtgacatgtgagagcatttctaagcatctagctatcatgattttattttttgttgttgacttaagacatctagaaatgcaaagcataatcaatttaagaataaaaactactggccgggcacagttgctcacacctgtaatcccagcactttgggaggctgaggtgggaggctgagttgggcagatcacttgaggttaggagttcgagaccagcctggccaacatggtgaaacctgtctctactaaaaacacaaaaattagccaggtgtggtggcagacacctgtaatcccagctactcaggaggccgaggcaggagattcgcttgaaccctggaggcggagcttgcagtgagctgagatggcgccactgcactccagcctaggcgacaagagtgaaactgtatcaaaaaaaaaatatgatgcaaataaagacagttattaacaaaacaagttgaaatccagatctgaaaagtgttcttatttgtgaaggtaacaaatcaaatagatcatgtaatggggttggctttttgacagcttgcagccatttagccttttgagtgatccttccaaaccgagtttccacttctcatccaggtttgaagaacaaggtgactggttgtggtcagcttcggtgggagatctctggtgatgaaagatgtccactcaggtgggctgcctttttaaagtgaaaaaaaaaatgagaatccatgagtcaatgcccctgatgttagctgcacaaagactggttaacagtacgtgacatgatcccttccaacatggttggagggagtattttatttgatgatgtttccaataaacaaaatctccaggttggaagctgtgatctttgatgtctgtctccagggagattgctttttaaaagaattcttcattaattaaatttttttttaattgagaagctttataaaggccctggcaatcatgaagtatagcatttttaagaagagctagctcatagacttctgcattcaggcacatggccttcctgttatttcaaagaaagaaagccgatgttgttgaaatggggtagagtgtgaattaagcaataccaatgggagactcttaggccagagaagtttcaagtttctataagcttggccaggcacggtggctcacacctgtaatcccagcactttgggaggccgaggcagacggatcacctgaggccgggagttcgataccagcctggccaacatggcgaaacccgtctctactaaaaagtacaaaaattagctgggcatggtggtgggtgcctgtaatcccagctactcaggaggctgaggcaggagaattgcttgaacctgggaggcggaggttgcagtgagctgagatcgcgccactgccctctagcctgagcgacaagagggagactgtctcaaaaaaaaaaaaagtttctataagctttgccaatttgatttttattatttgtgcatttcacaagtctggaagactgagggtggtatggacaatggaaatgttgaaaaatcagccatacgttacaaataaactgaattatttgaccagtgaaatgggttcattagtttccatgaagattggagggagctctccaagaaggaatagggcaagatttaaagtagtcatggtcaaagatgcaatcaacaaagaaatttggtcattttatttttttgtggcctactgaaacgggaagggttcccttgtcccccttgcagggcatgtgatgggggagtggctcgcttcttcagtgccccgctgctcagacctgcaggggagcatacagatgggcaggttgtggggctccaacccacggcagcatctaggggtggatgtttacagctcctgaagccctagtgggcatgtgttacagggtgctcttttagttttgccatctataggcagcttgtgttaaccagcagctcaattagaccctctgctttgttacaaggacagagggatttctgtatcccaggttcttgccttggtgtactggaagaataggatcacacctgggcttggagaatgagtgcaaggttttattgagtggaggtaactctcagcagttggaggaagccagaagggcatggagtgggaaggttttgccctggagtcaggctgctcagcggcctgggcttgcctttgactgcccggccaaactccgcctcgttctgcaggtggatggcctgccggcatgctggcgtctgtcgtgtgctcttccaccagcctgctcccttctgtggcagattggtcagagaggtgggaagaactatagggaaaggacgcaaaccttctgaaaggtgggaaggttctgcagagccctgggggagaagaactgaaggcagctcttctataaccctgaggcagagggcaaggagtaggtacaagggagtatgggggattttatcttaaataggcatgtttacttatgtcgaccaggaactgaccttagatcatctatgatcacctatgatcatgtttcagggaacatgaggttccctgaaaggggaataataaatattaatgacttacagattgtgtcggctccaggttttcgacattgtgcctgcactgaataaaagcaaagcagctccagcttcttccactagagccaggcagtcacctagctgctcttaacactgcatacctgtgtctgggtactcatttcctctgttggccagggtctgtgggacagagctggcacccctcaatgacctctcaacgtccagccacttgtgtcttcttctgccaatgtgttcctctccacgtccagctgcttgtgtgtctgcttgctagggtctcagggtttttataggcacaggatatgggtgtggtgggccagggtgctctttggaaatgcaatatttgggcaggaaaacaaaaatgcctgtcttcacccaggtccatgggcacaggcctgggggtggagccctagccagggactacacattcctctacccagcacttccctgccccccttccgtatcactataattcaacacaatacttacaataatgactgataatatataccaacacatatcagatttttaggaatctcatataattttggaacacatattaataacacatttcacaaatataactcaaagaaagttaaatgtcatttcttttttgacaatgcttgctgtgtaatttttacatgccaaataataccaagttctcttgaacttacatgggttttttttttctttttcaaatgttgaaacgttagtttgaggtcaaaatggcttaatttagaatttgaattttcatttttggaagtttgtcaaataccaaagctttaaaacacttgatattaaaatagaaaaggtttaaaagacttgttcaaaatagaatcatggggaacttcaaaataatagtcattcatttagccaaagtgataactgaaagatttcagaaaagctgggtgtggtgactcacatctgtaatcccagcactttgggaagccaaggtgggaggatcacctgaagtcaggagttcgagaccagtctggccaacatggtgaaaccctgtctcccctaaaaatacaaaattagttgggcatggtggcaggtgcctgtaatccccgctactcaagaggctaaggcaggagaatcgcttgaacacggggggtggggggaaggttgcattgagccaagttcgcaccattgcactgtagcctgggcaaaaagagcgaaactccatctaaaaaaaaaaaagatttccgaaagcaaaaacctttattgtttgatagagaggagactcagttttctaaacaatccaaagacctaatgaaggaagcataaggcaaactcgctcctctttttttatttttttcactttgcagtttgctcaaaaggcaaacaaaaatcttttacaatctcttattactactacatgaaaatctcgtttaaaagagaaaactaaattctacctttacattagtgtattattaatgctacagctaaaaatatagttataataaaatcttgcaaacagatccatctaatctcaatcacttttgaccactactcaagataaagtttctatataccttttatactcttacaatgttttcctttttcttttctcttttcttttcttttttttttttttttttgagatggagtctcgctctgtcacccaggctagagtgcagtggcacgatctctgctcactgcaacctctgcctcccgggttcaagcgattctcctgcctcagcctctgaagaagctgggactacaggcacccaccaccatgctcggctaatttttgtatttttagcagagacagggtttcaccatattggccaggctggtttcgaactcctgaccttgtgatctgcccacctcggcctcccaaagtgctgggattacaagtgtgagccaccgtgtccggccacaatgtttttcattgtctttctttctccagctttgtttattcatttggctttatctatctcatatatatgatatgatatgatacacacacagatgcatatatatacgtatgcgtatatatacacacacatacacgaacgtatataatcatatatatttcttaatgggatatatatatataattttacagatggggtattgctctattgtccaggctggagtgcagtggcaaaatcagagctcctgggctcaagcaatcctcctgcctcagcctcctgaatagctgagactacaggcatgaaccaccatgcccagctaatttaaaaaaatttatcaggccaggcatggtggctcatgcctgtaatcccagcacttcaggaggctgaggcaggtggatcacttgagctcaggagtttgagaccagcctgagcaacatgccgaaacctcgtttctacaaaaaatacaaaagttagccaggtgtggtggcacaggcctgtagtcctagctagttagggggctgagatgggaggattgcttgagcccgaattctttttggtttctccaatttaagtgtctcccacttttctgacttgtaatcattaagaacaaggattgctttgttcctaaagccctacaagcaggatatggacaactggattaaacttcagagaaaacccctcatgcctgatgtagggagcacttgaggagtttgctgaaatgccttctgccataaacagagatattaaaaccacaaatcaggaaaatatgcttcaagcttcaatctaggaatcttgattaactgacccctggactcagagactatatttatagtttgttctggttatctccctgagtgagaactgagcccattcaacccagattcatatgtttgcaaggtgtctttgaaaaggagagagagagagagagagagaacaaggtgaagacacacttgttcccggctgcccaggcctggaagtgacacacttcatttctgccccatttggatgcaagaagactgagaaacagtttagctctgtgtctgagaagaggaaatgagtttgtgatatctagccagtctctatcacatacaaccaacccatgctttaaaaatgaaaaataaaataaaataaaaatataaaacaaatccatgcctatcttggaactcagtatgtactagcagtggtatcataaataagtttgaaaagaagagttatttagatagcattagtgaaactgattccacctattaagaaaaattactggatccttacctcacaccatatacaataaaatctaaacagatcagtggttctcgagaggaggcaatgttgtcacccagaggatatttggtaatatctggagacatttttgttgtcccaacttgtggggtgctattgacacctagggatgctgctcaacatcctccaatgcacagggcagctagcaaataaagccccagtggccacagtgtcaaggttgagaagctcacagcaaagccccaaatggccatagtgtcaaggttgagaagccctgcactagggttcacctacacttgagagagaaaaataaaatactaacagaaaaaaataattaaagaaagtttcttatgaccttgggctaggaatagatttcttttttttttcttttttttctttttggagtttaaaactttttatttggaaataatttcaaagttataaaatgttgcaaaaaaattttttaaactaccaaaaacagccatatttaccgtttacccagatttacctattcaacattttataccattcacttcattattttctctctctctctcttttttttttttattgatcattcttgggtgtttctggcagagggggatttggcagggtcataggacaatagtggagggaaggtcagcagataaacaagtgaacaaaggtctctggctttcctaggcagaggaccctgcggccttccgcagtgtttgtgtccctgggtacttgagattagggagtggtgatgactcttaaagagcatgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaatttttcttactacagaacaaaatgaagtctcccatgtctacttctttctacacagacacagcaacaatctgatttctctatcttttccctgcctttcccccttttctattccacaaaaccgccatcgtcatcatggccccttctcaatgagctgttgggtacacctcccagacggggtggtggccgggcagaggggctggcccccacctccctcccggacggggtggctgccgggtggagacgctcctcacgtcccagatggggtggctgccgggcggaggcgctcctcacttctcagaccgggcagctgccgggcggaggggctcctcacttctcagatggggcggctgctgggtggaggggctcctcacttctcagatggggcagccgggcagagacgctcctcacctcccagatggggtcgcggccgggcagaggtgctccccacatcccggacgatgggcggccgggcagagatgctcctcacctcctagacaggatggcggccgggaagaggcgctcctcacttcccagactgggcagccgggcagaggggctcctcacatcccagacgatgggcggccaggcagagacgctcctcacctcccagacggggtggcggccgggcagaggctgcaatcttggcactttgggaggccaaggcaggcggctgggaggtggaggttgtagctggccgagatcacaccactgcactccagcctgggcaacattgagcactgagtgaacgagactccgtctgcaatcccggcacctcgggaggccaaggctggtggatcactcgcagttaggagctagagaccagcccagccaacacagcgaaaccccgtctccaccaaaaaaaccgagatagatttcttaaataaggcccctaaatgaatgaatttaactatatcaaaacaaaagatttctctttttaaatttttaatggatacattgtacttgtacatatttatggagtacaatttggtggttccatatacatatatgtgttttataatgatcaaattaggtaggctgggcataatggctcacatctagcatcccagaactttgggaggcccaggcggaagaattgtttgagcccaggagttcaaggtccccctgggcaacattatgagaccccatctctataaaaaattaaaaaattagtggggtgtggtggttcatgcctgtggtcccaactactttggagctgaggtgggaggattgcttgagcccaagaggtcaaggctgtagtgagctatattcccatcactgcactccagcctgggtaatagagggagatcctgtctcaaaaacaaacaaattaggatatttagtgtgaccatcacctcatgcatttatctgaagttttctcttgtacaatgatcattattgtttattagattatcagatagatgataaaggaaatatttgcaacatttgacaggaagagggaggacctgtggtttttaatggtggagctgggattcccactaatccttcagaataccccaaaagccacaaagaccatgaaaaccaaaacacacattccatctaaatacacactttatctcttatgaaagtaggagactcccagcactttgggaggctgagacaggcaggtaacctgaggtcaggagatagagaccagcctggccaacatggtgaaatcctgtctctactaaaaatacaaaaattagccggtcccagtggcatgtacctgtaatcccagctactcgggaggcagaggcacgagaatcacttgaacctgggaggtgaaggttgcagtgagccgagatcgtgccactgtactccagcctgggcggcgacaaagcgagactctgtttcaaaaaaaaaaaaaaagaagaagaagaaagaaagaaagtaggacacatctcaagtgactacagttaagagcatctgtgcaccaagtaacatatctgggcacctatacaacaaaagctcacagatagacaaggactctggcagttttaaataagatttcaaactctgccataggaaagcagagaggcaccacccttcaattgctcttgggacatttactataataattatgtattatgccttaaaggaaattttagaacattccagggattaagaggggtggggagagggagagaaatagtacagatgacagtctttcattatgaggcaataaaatgaaaaataacaaaaccgggaaacaaaatccccctaacccctgtacatttataaatctttcttaaaatgactcccgtcaaagaagaaatcaaaaccaaaattgcagaacatctagcgaatgatgataaagatgcactatatgtaagaactattggtctacttgactggattgctatggctttagaatcagtcttgctatctgccagggcgaaacccaccacccaccccatcttcttcttcaaaattgtcttggctattcttggccctttgttgttctatatacattttggtgtcagctttcccacttccatgaaaagccctggtgggattttgatgggaatttgcagtgaatttacagattaatttgaagatgtgacacttttatgatattaagtcatccacctggtgaaagccctgtgaaccagcctggctcccccatcctcccagcagctgaggggccaactggcggggactgtgggtgcacgataaaggaaggaagccataaatactggccatggcctcatgaccggctgcagccacagaggtccccttcaatgtcctttgtggctttgagttttgcatagtgggaggaaattgtctttgcaaggtgcaaagtggccccaggaggaagaaaatgtaatagaagacaactgctcaacctgtttctgatcataaaaactcaacagtctttttctttttctttttgctgatttataagatgaggcctgacatttctaaaacctgaaccattgaggaatggggaagacgagtttcacatttctcacagcttagaaggggcgttgaaggggtgtgtaagcttttcctggtgtctgtcatcccagatagccatcaaggactatgaggagtgaaaaagaagagactagagctttcgtgttaagggacaagagcttttgtgttaagggacaaagggggtataggcaagacttcaggtgacaacagggggatgggcaaaggaccaatgcagaaacaatcgttacctagacctgatcttctgggtttccggatgtgagtttgctgcagggaggcgccagcaggaccggacccaggggactgataccggtacctggggtctgtgtatgcccaagacctccctggtcctccgtgatggaaactgcagaccatgtctaatgcatcaggatggtatatgccaaagagggaccctgagaccctggcagagtgatggagagtggccacaccaggatggcggcgcggagggtattccatggcccctgagctgggccagcagggagagaggcctgggcctgatgcgtcattcattgtgctgcttgccttaaatactttcaccttgtcctttgcgtgccccaccagccgtgactgatagactttactctttccagtttaaattcatggaaaaaaaagatttccagttcaagacagcaggatacaacctgaaacccactatgtctttctcaaacacatcaagaccagagaagaaaaactagaaaaactttttttttttttttttaagacggagtcgctctgccacccaggctggagtgcaatggcacgatctcggcccactgcaatctctgcctcccgggttcaaggaattctcctgcctcagcctcccgagtagctgggattacaggcacctgccaccatgcccggttaatgttttgtatttttagcagagacggggtttcaccatgttagccaggatggtctcgaattcctggcctcaagtgatccacccgcctcggcctcccaaagtgtcgggattataggcgtgagccaccgcacctggcctgtatttcctatttagcattctttccctgtatttcttctttactttgttttcttgtcttcagttgaattgaggtttttgtgctagtcccttctcccctactattggaagttacacattttacttttatttttagtgattactcttaaatttttagatcatacctaaatttcatgtccaagcaaaagctaatatctctatcccccttcctgaatatgaagtgaaaacaaaaacagagtatatgtccaggcgcagtggctcatgcctgtaatcccaacactttgggaggccgaggtgggcggatcacctgaggtcaggagttcgagaccagcctggccaacatggagaaaccctgtctctactaaaaaaaaaaaataaatagccgggcacggtggcgcatgagtgagccgagagttcacgagttcgagaaaaagtaacaatttggccagattcggtggcttacgcctgttatcccagcactttgggaggctgaggtgggtggatcacctgaggtcaggagttcgagaccagcctggtcaacatggtgaaaccctgtctctactaaaaatacaaaaattagccaagtgtggtggtgtgcacctgtaatcccagctacttgggaggctgaggcaggagaatcgcttgaacccaggaggcagaggttgcagcgagctgattgcaccactgcactctggcctgggtggaaagagcgagactccatctcaataaataaatattaaaaaaaaaatcacctagaaacagtaacaggtattgtcaggatggtcataaaatgttattactttcttcttgcttttttggtatttcttcaatttcaaacacaggaaaaaaattgatgtttttcatttttcaaatataatatttgattacaatattgagtaagtccctcccttgagaagctctatgctgggggttggggaagatctgatcgtgccttactcacactgggcctgacaataggtgctcaagatagttgtatggggttgttgtaggaccaacaggtttgtatgcccatatgtatgcagtaacagaccaattacactgagatagcagggtttgcagcagagaaagagtttaatgattgcagggcaccaagtttggagatgggaggagaccttcaaatccatctccccaaggagttttggactgaattttttaaggagattgtggagggcaaggggctggaaatttgggattgttgattgcctaagcaaggggcatgaaataattgggattggaaaccgcattctttggtgagccagctcctcatggggaccagttgagtcagtagttttatcagcatgcaggatctgaaggaatacttcaaaaggaaaatttagcatttcatgttcaagttgttatttatacagcagttaagggcagctataatctagggtctttgtcactccgggacaacaggcaccaaccagccatgaggaagcaggtcagagagcagctgacctcatgatgaatactgagtatgctgcaggcttggtttattttcatcttttccccctacttcttccctaatttgtaggggtgggttgcccctacacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattgatcatctgtgggtgtttctcgaagagggggatgtgtcagggtcacaagacaattgtgggaagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaacgagcatgctgccttcaagcatctgtttaacaaagcacatcttgcaccgcccttaatccattcaactctgagttgacacagcacatgtttcagagagcacggggttgggggtaaggtcacagaatctcaaggcagaagaatttttcttagtacataacaaaatggagtctcctatgtctacttctttctacacagacacagtaacaatctgatctctcttgcttttccccacactaattggttttataaagtttatagggacggttgtagggtggttgcagaaagcttcctgggggaggtgacgtccaaagggctcctaggaggactagggccaagttgggaggaagacagatcctctggtgcagatccagcttgtatgggcaaagccaaaggagctggaactggggaggttgacaggtggcagcacaaaggaccttgaatgccaggccaaagggtcttgagctttgttctgagggcagtggggaaccacaaaaactctcaggcaggaaaggggcaaaacgggtctgagatttataataatcccactgttccatgtttgcagagaaggggctggaggagccaagatgtgagggtgggaggccccaaggatacattgttaatttcaggtgagagatgacagggccacagccatctatcactgtgcagggaatgtttggaaggtaaagttgaccagatagacacagtggatgtggggccagtgggacagggaggagcccttgatacctcttggcttgtggcctggaggctggctggggaggctgatatacagagtgacacaggatgggatgggtgctgaggaggtgagagccaggacctgagatgctgcagagaaggctcctgggagatgacatcagagtggatctccttcttcgcttgagaagcctggcaagtaggtgctccagtgggtggggaccagtgggggatttgttgttaggagacctcaggccgagttctggcagttgtgtcatcctgggcaggccactcagcaatgctgataccctgcttctgaaaacagggctcatcattcctgaggctggagttttggaggattaaggaggtaacacatggcaagtgcttggcccagagcctggcactgaatgaacagaggatccttccctcactctccgttttccatcccccctcatgcccagcatctcctgtccccagcatccccaacctgcatctccctcagcctgtattcctttgacccagttagagacagatgaggaaggaatccacccgctgggctggctctgacctgccccccttcttctgccccaaagggagggatccgaggactcaggtctgagcccggattagctgtgtaatccccagctttgcctaggcaacctctttccctgaccaagagagggggcctgcggctggcagccaggactcctgggctctgggcctgatactactctatctgtctgggaaacctcagacagggaagagatttcttggtgcctctcttgggaatgtcactgacgtccacagtgactgtcacatgcgtgtcagttgttctgtgggtttgctgtgtgcggggcactgtggaaaggaagaaaggcctagattccagtccagctccaccactcagcagcttcatgcccacagacaaaggacaaaatccccctgagcctcagttttttcgtggacaaaatggagtgaacaccttgtggggctgctgtggggtatgtgagaaaatagctgcaaaggagttttgtaaacagcacgttttagagagatcaggaaggatgattacagcacaaaagaacagagatggttcctcaccatgaggactggaaaagagctggggagagcaggccaaaaaggtcactcttatcacgaggaccacagcagagggttccaggaaactgaaaaagacgagttcatcaggcttccaagacctcctgggaaggcaaaggacagagggacctcctcaggtcaggggaaaaccgagggagggggacagccacacaaacgccctaaagtctaatgacggcagaaaggggtcttgggggacgggggtggggttcacagcagtggcctgggcgtgatgaccctggcgaaggacggggtcgcagagcccttaaatcctggaccagtggctgattccaaaagcagcagggaccatgccaggattttgggcagaagcagaaagtgctggactctcctgacaagagctgagagaactcagcggcgccagcaagagtttgtgccgtgcactgaccatctgcatcctctctgcctcaccccagcctaggattccgtgacaggccctctgggaagaactccgcgaacaaccccctgccttggagtctgcaatccttcctcgagcacacggacgcccggggtggggaagcccacagtctggcagggctcgcactgggcagaataattgcaacgtagtcatgaggatcgggctatgacctgcctgacttttcactcctcccatgatacaccgatgcataccgcaggtgcacactaaacgccgaatctatagaaagtggaacacaccaggacccagcagaaggcgacatgcgaggtttgtttacttgtggcatcaaaggctgggagccggcgagctaaggagggagcgaaagagcgagcggtggggacagccaccgctaaatgccagcccggtggagggaggaaggcggaccccaggccggtgggaccacatctcccagaagccccggcgccaaggcactggcctctcagtcctcccccgaggaggcggggccgctggcgaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacggtgaggcccagcctggctggggccacgggtgtttggggccgggtgtcgcggccgcgcccgtgcacgagcagtccctggggtctgtagtggcctctggagagcccttctccccaggccaggcgggaaggcccccgctccggcctggttgaagtaggggaacgggtcccaacgcggggccgactcccttgaccctctgacttgctggcttcccttgttttacagtcctcggcctggcggaagttttgcaggttgtgaagacccctagtctttcattctctccttgtcacagccttgtagggcgtgaaggggtcattgccccatttagggatgcgcacctcctgatttcccgtccactgctctgcgccctgaagtggctgaaaagtgctcttaaaaggatgggaatcccgtcgccctcagctggtgcgctctccactgggtcgtggggctcctcatttcatcctaagtgagcccctccatcacctgtgtgttaaggaggcatttctttcccatcagtaaacacatttcgcctcttcggccgaggtaggaatataaaaggcccctggcctacccaagttttggtccagcaggggagccaggccgggaaagggccaagctgccacactcggcttgtggggctgtgtggtgccgtgatgcagctgtgggtttggccaccgacagacctgggctcaaattggacctgctgcttttgactgtgagaccttccataagctccttttgctccaagcctcagttttctcctctgtgaaacagagaaaatcgttcctatcagagttcttatgaggatgaaatgggattttggatgtaaaatgcttccatccagtacctgctaaacaaaatgcttactaatggccgggcgcggtggctcacgcctgtaatcccagcactttgggaggctgaggcgggcggatcgcttgaggtcaggagttcgagaccagcctggccaatatggtgaaaccctgtctctactaaaagtgcaaaaattacccgggcgtggtggtgagtgcctgtaatcccagctatccagaggctgaggcacaagaattatttgaacctgggaggtggagtttgcagtgagctgagattacgccactgcactccagcctaggcaaaagagcaagagtctgtctcaaaaaaaaaaaaatgcttactaagtggcagtggtatctatgatgctatagatgcttccctagccctagcccagcccctcctaaatagggagacccaagattctgtagcttctggcccaatccctcatggccccagagcactctgggcctcctgaccctttgtctccctagacagcacccaagaaaacctcatttggctcgctgaaggatgaagaccggattttcaccaacctgtacggccgccatgactggaggtgagacagtgcccttagtgtgttgggtcccggagcaaggtgtccccttcattgccttccctattctgtccaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggtgtgtgtgtgggggcggggcagatgtggctgtgggagagaccttgggggtggctggggtttccctgggcctttgggctctttccttagaaacttagcatgaatgaggtgggcacatgttcccaggccttaaatggatgggacttactctgtggacttccacaggggagacttatgtagcagaatcaacacatgattttgactcaggcagacttagttcaaatcctagctctgcctcctaatcatagaggtttgggcaatttcccagcctttgtgaaccttagcttcctttttgtaaataggtacagtgatatcatgcaaggattaaagagataatgttcatacagcttttggcctgtatgctggttggcacataaagcaaatgataaatgtcacctgctttacctccttttgatggtagagcttgaggaatgctctttgtcaccaagagtagaatctggctctcaggggcagacacaaggagagatgtttggatgagctgaatgaagacctttcttgtggtcatagccacccaaagacagaataggcagtgagctccctgtcattggtggtgagcaagcagagcccctgggacatgttgggagggcagtaaaggattggctgtcagaggagacatctttgaggcctccctgggtggagtggggtggcatggagttgaagacccagtcctgatggccctgtagcctgtctgacctgtgggcccctgcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtgggtagggagagatgtagacagatgagaaggtgttcagtgtgcactcacacacccctcacccagcacagttgttctgaggtgttagtacctggtctgtcagtggttgaactgggggagtggtggccagtcctgcatgcatcccaaatgggacttggctcccaaagcctccttccagggctcctaatgctgctggtgtaaattttttttttttgcttcaaaaatatagtattttttataaaacaagtagcaagaagaaaaaacctaagtggaactatgtgtttagcaagagagcggaataattatgaatataaacaattcctatttggagaaaatacattatgttcattgcttggaactatgaataatacttatatctgtaggaaatatagaaaaataaaataggttaaggcaataaggatataggcaattacatttttattttaattttataaggacttttatttttcctttacagactagggtagttaggagacctgatagtagctacttcgtttttattttcctggcagcaaagcagcttacttatgtgttccttcttgcttatctgttccagatcatagtcaagttttccaattcgttttactaagctagcaaaattttttataccaggagcattaggagcttcaccgtgggaggccttcaagggcttcatgactcctgaagttataggctgactcctgggctgggggtgggctgggaaactcacacctttgtcctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggtaaggcctggcgtaaccctgggtcagactgtgtcctgtgacacccgggatctggctaggctccctttggattgttcttagggatttctgagtggcttcccggctggggccagatagagagtaggctggcaacaacacacaggctcccccagggccgcctgctgtccctcctcctgcctcggtcccctccgcaccagtgctgctctgtggctccaccttcacagtgcctgttctgaggctaagggcatggggtgaacaaggcaatgggcatctctggagtttggggtccagcagggataagaatgataaggggatattagagcaggggctctgccatgggtgcaggaccctgggacacacctccctgccaggaaacttgccccaccccctagcagccaccagttctcttcccatttccctgaaggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctggtaaggcctggggccagccaggtggtgggggggtgcgcagtgggggcaggtgtccacaaagagagcctgggcgggagggctcaggagacggggctgggtctaggggctgactaagggcctgggctcaggactaggcaggtgtgccggccccagccctgaccatgcatccctttggggaccgacttggggccccagggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcggtaagggttcacacaccagccctggtccctgccctcctggttgctgtctccctccctgggcctcccagaaaaccctcttgccagcactcaggtctcagttcctgcagcctgagataaagcaaggtggaagaggagggaggaaggctgctctgaggagaataccccggagtctgggcagcacagggggcccagggaggctggaggaggccagaacgctgggtgggctgggaagagcttctggaactgggggaggggctgctgctagggggctgaggcccaggcttctgtctggccgtgggtgcctgctaattgcccctcgtcacccagacggacatcgtgaaagccatcgcccgcctcattgagttctataagcacgagagctgtggccagtgtaccccatgccgtgagggtgagcatcgggcaggttgggggcttgcttgctgtggcttcatttaacctcctccccaccacgtggcctgcagccctcaagcgccgccccacatcctggctggggagatcatcaggccctctcttgtggctgtggctgcaggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcaggtattcaccacccttctgcgtagcacggagggtgggtggcatcaagggcccagggtgttgggggatttttggactctgtttcacatggtccccccaccgaccccagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctccagctgccgctgctgtgactgtgctctttaccctttacccagcacacgatcctcaagggtgggaggggagaacagggtccagtctggcccatggccagagaaaggacagggtctcatctggcttgaaggagatgtttatttcggctccatgatttggggtggggtgaatgtgaaagcggggagagaggaaacacctctctgacttggggctgggcatgagggtaaggcagccccagccgccatcatttttgtggggacgtttcaggcagctgtagtggaggggcggcaggcagggcccatgggctagtcgctgagctggacaggcttgctgtccagcgggtgccacagcttcaggcggtggtcactgtggcccaggcactcaagccagtgccgcaggcgctccccactggcatggctgcccagctgcaccccgcctgccatgggggatgggtcaggaaccgccaggagcctactgggcccccaccccagctcctcatgttcccactcaccaatgaagtcatcagccgtgcctaggtcatagtcccacacagacaccagcagcgtcttctgggccagctcctcccgtgggcctgagtaaaagaattcctgcagggagaagggcagagaggcgggaaggaggcagcctcggctctcccacagcttaagaagcaggccacggtagggtagtggctcagcatgtcaaggccagggttggctgggacctgcctggccctggctcacctcattgaactcggggttcagggtcttcctgtgaacactggttttgaatttagatttcttccctgcatttggatgcaggaaactgatcggggaagattggcgggttaggtgtggccctggagaggtgaggagtcaccgccttatcctcacctcccgcctgcctaccccagttcactcacaggcgcacgaaggggtccgagtaaccattggcatccatgggggccaggtgggcgcagcgcagcacacctaccagcaagccaccctgctgagagctgtagcacagtgacagtaggacgtgcccacattcctcccaggccacctctgtctccacctcctcctgcaggtgtaggctgaggtcagccccaatccagtccaaagcccaccccctttagcctccgtgctctgggcaggaaagctcaacctggccccaaagaaatcgggggcaacgacttcatttccaatacagccacttgcccagtgccatggaagtggccctatgggtcagctgtaccctccagggcctgaccaaaggcgaggcttgctgaccacatgaccagtcagatacgtctgtcatggaggggaagcgaactggctgacatgccagtagctccctaagtggcctcccatccagtgtgtgtagccacccctgtaggcaagcggctctgagaggatgttcacttcccaaggagaagcagatctcttcaaaaccccaccctcttcaccccctatttccctggggaccagatgctgagtgtcgtttgtcacactctgggccctggtgcttctgaacaggctcagggaggaagcccggggaggatgcactgctctcacccgcagggtaggtttccatttgcggaaagccccaccaccttgctcacaggcggttctcaggaatgcggaagtgctctgtgggcacccaccatgctccgggcgctgttgtgcttgggatctggggcggagggtacacggggctggcgctgggtgaagtggcctgtccatgccaccttggtgggcttcagccacttgggcttagctaatcgacagctgcagcaacttgtggctccaccagggggcggggcacccggcactttggggaggagctggtagagggccccgctctcagcctcccagctgcctcccccaccgaccacaggggttctaactaggtctttggtctctagtggcgtcaaacccctgccagtcaccctcactgcctccggacaagggcctgtctaggacagcctgccccaggagtggcccccacactcccctcaggccagaccccagccagggagccccacccatctgtcctctcttccacctcgcccagcctcccatctcgggccgtggacaaatgccgccagtttcagcctctgcctcaaggcaggtctctgcccagctgcgcccccagggactctgcttgtcccagtgccccacagctcctctgggctgccctggcaagggagtcaccctcactttgtcacctggctgtcccctgtgacaatgagggctcacagggcctatgagagctggcctcaggttcctccaagtcccctacgcccctgccaccaggcctgccccctcatctctgctcagcccagttgtcctacccacctcatagagggacatgccacaggctgtgtccaggctcttgggcctcttggcctgaaagggcagagagcccggtcatcctggccagatgctgcccagatccccctccctgttcctcccctccagctccccccatcacaggttcctggcctctgcagtcccacctgtgctccagccccactcaccagcctccgcttctccagacagatgtcaaagctcctggctcggtttggcaccagcttcctcaggggcacccgcagctcccccagggaaggtgcctgccactgtcgctgtaccatgggtcctcgcacacacacagcctggtggccgcccaggtcagacctggccaggccagccccatccctctgctccacccccaggtggcccaggccagatcctcacctaagggtcttgcactcagcatcctggcgggtgaagccgtgataggtgagtgtctcctcccagacaggtaccctcgtgccccgaacggtgtgtgtccgaagctggctggcctagggcccaagccgggtgggtcagggcctcctagggctaagaccgtcctgtaacccccaaccctacctccctggtaggaccccccactatttgcacatcccagcaactgagacctaggccttgcaggatggggaggagccaagcagagccaagtgggtgccccaggctgggtgttccaccagagggcagcagtgggggcctggggcttgccctcaccttgctggcccctggcagcagattggctttgacataggcatccgcggagcctgaggccaatggcttgaggccctgggaacagacagtgggtatgagacaggcccgtgccccagccctctgtcccaggaacacccacccccatcctcaccttggcacgatgagccgtgcaatgcagggcactgttgtccgcttcaaaaagaagtgtgaactccagggtgcccagggcagctagaggcaggtggaaggcagcgtcacctcctacctcagctcagtctgcccccacccatggcacgtgcttcctgccttgcccctccatggccagatggtagggacaccccactccccctcctggctgggctgagctcagggtgtccccctcttcccgcccctactcactgctgtcgtctgagtctccttctggctctgggtcgggctgcagctggggtgcagagcggacggcggacgccgctgcggggcgcaggttcggagggtgcagggcaggctccgcaaaagggtaaaagtgcgggaagtagtgggaaatgaggcggatgggccggatggggcccgggctcacatcgatggccatgtgctcctgcatgctaacccggggaggctgcccacctgctgccgcagtgcccgccatggggacccagacggggggcggtgggcggagactcagagaaatgcctgaggactggggctggcgggaacgcacccggcctcggaaatggggtgaagaagcatcgctgataccatgcagggacctgaggacagagcgcagggttgagggaggggctgggggagtcctcagcctggagggttgtggcaggctttggaggggactgggtgtgttgggagtcagtccagctcccggcccttaccgctctgggagctacttcacccagtgtgagttgctgctgctggcagtgggtacgcactcatgagggcagagcccgtgactgctgtgtccccagtgagtgagggtgacccagagctcagaaccctctcagagctccttcctagcgctggggctcagcttccctcctccctctgcccccttcacactttgtcaaagggagttatttttgccaccatcatgtggccctgctcccaggtgaggaggctggtgggccggaggtgacagagggctgtggaggtgataagtggtttgtgggaaggagggagcgcataggaggaggggagggggtgcatgggaaggtgggaggggagggaggtctggggaggagaggaggggagccacaggagggggctcctgtgatggagccctgtgggggtggccagtttacactctgaaacatgaaccagatcatcccgcctccacccctgcttggaataaaatctgaatcctttggtgaggcacggccccttttcacctcaccaaggagtgtccccttggcatctcacagtaacggcctgctcccctcccaaactgggccaccctccctgccctttgacctgaccactcctactcacctttggtttctgggtcaccccctgcaggggatcttggctggttttaaccatccagcattccctctcctctcttctccccagttattcttttaatttttaatcaacataaccgtaggtgtgtatggggtacaatatggtgttctgatgtgatatgtgtagaaatgcaatttctacaatatgcattgtagaaagagtcagtcaggctaatgaaaaaaagaacacttaaaatgtgctcttcaggcaactgtgaaatacacaaggcgctattgttagggatgtttgtcatgctgtgcaacagggccttcagcttactcttcctgactggaactttgtaccctaagagcaatgtctcccctctccccatccctagtcccccactctccagcccctggtgaccaccattctctctgcttctaggagttcaactttttcagattccccataaaaatcagaccgtatagtatttgtctttctgtgcctagcttatttcacttagcatatcgtcctccaggttcatccatgttgtcacaaatgatagaatgtccatctttgttaaggctgaacagtatagacagaccatcctatccatccgtctgatgctgggcagtcaggttgctgccgtgtcttagctgttgtgaatggcactgcagtgaacacggaggcagacacctcttcagcatgctgacttcaattcctgtggatactacccacaagtgaggttgctggatcacacggtagctctatttttagtgttctaagggactgccatatgattttccaaaatggctgtgctcatttaccttcccacaaacagcacataaggcttccctttcctccacatcctcacgagcatttgttgtctcccatggtttggtagtagcttttctaacaggtgtgagatggtatctcattgagattttaacttctatttccttcacgattagcgatgttgagcattttttcacgtgtcttttgagaaatgtatgttcaggtcctttgcccatgtttaaatggggatatttgtttcttgagttccttgtttcttttggatattagcccccttatcaggtgtatggtttgcaaagattttctcctatcctgtagtctctctcttcactttgttgtttcttttgctgtgcagaagctttttagtcgggtgctatcccatttgtctgtttttgcttttgatgcctttgcttttggggtcctatccaagaaatcattgcccagaccaatgtctagaactttccccatatgtttccttcaagtagtgttaccattgcaggttttttttttttttttttttcctttaagataggatctcactctgtcgcccaggctggagtgcagtggcacaatctcagttcactgcagcctctgccccctgggctctagcgatcttcccccctcagcttcttgagtagttgggactacagcgtgcaccaccatgcctggctaatttttttgtatttctgtacagatggggtttcactacattggccaggccggtcttgaactcctgaagtcacggtggcccgccttggccaaccaaagtgctgggattacaggcatgagccatgacgtctggctcacttcaggtttttacaggccattttgagttgatttttgtctaaagtgggaacctcaattgttctttgggaaccactgcttctcagtccagggagttccctcctacccaggcaagcatcccagattctatccatcaatgtactgtaaatccaactgagaggtgacagcgtgcgggcagtcctcatagccctcgctcgctcgctctcggcgcctcctctgcctgggctcccactttggcagcacttgaggagtgcttcagcccaccgctgcactgtgggagcccctttctaggctggccaaggccggagccggctccctcagcttgcagggaggtgtggagggagaggcgccgggaaccggggctgcgcgtggcgcttgcgggccagctggagttccgggtgggcgtgggcttggcgggccccgcactcgccgcagccagccggccctgccggccccgggcaatgaggggcttagcacccgggccagcggctgtggagggtgtactgggtcccccagcagtgccagcccaccggtgctgcgcttgatttctcgccgggccttagctgccttcctgcggggcagggctcaggacctgcagcccgccatgcctgagcctcccaccccctccgtgggctcctgtgtggcccgagcctccccgatgagcgccgccccctgctccatggcgcccagtcccatcgaccacccaaggggtgaggagtgcgggtgcatggcgcgggactggcaggcagctccatctgcagcaccggtgcaggatccactgggtgaagccagctgagctcctgagtctggtgaggatatggggaacctttgtatctagctcagggattgtaaatacaccaatcagcaccctgtgtctagctcagggtttgtgaatgcaccagtggacaatctgtatctagctactctggtggggccttggagaacctttatgtctagctcagggattgtaaatacaccaatcggcactctgtatctaactcaaggtttgtaaatacaccaatcagcaccctgtgtctagctcagggtttgtgaatgcaccaacggacactctgtatctagctaccctggtggggacttggagaaccgttgtgtcgacactctgtatctaactaatctggtggggacttggagaacctttgtgtctagctcagggattgtaaacgcaccaatcagcgccctgtcaaaacaaaccacttgtctctaccaatcagcaggacgtgggtggggccagataagagaataaaagcaggctgcccaagccagcagtggcaacccgcttgggtccccttccacactgtggaagctttgttctttcactctttgcaataaatcttgctactgttcactctttgggtccacactgcttttatgagctataacactcaccgcaaaggtctgcagcttcactcctgaagccagcgagaccacaagcccactgggaggaacgaacaactccaggcgcgcaatgaacaactccaggcgcgccgccttaagagctgtaacactcaccgcgaaggtctgcagtttcactcctaagccagcgagaccacgaacccaccagaaggaagaaactccaaacacatctgaacattagaaggaacaaactccagatgcgccaccttaagagctgtaacactcaccgcgagggtccacggcttcattcttgaagtcagtgagagaccaagaacccaccaattccggacacattttggcgaccatgaagggactttcgcctattgccaagcggtgagacaatcgctgagcagtgagaccatcacctattgccgagcggtgagaccattgcctatcgccaagcagtgagtaccattggacccctttcgcttgctattctgtcctatctttccttagaattcgggggctaaataccaggcacctgtcggccagttaaaagtgactagcgtggccgctggactaaagacatgggtgtcagactttctgggaaagagctctctaacaacccccgactcttcggagttgggaccgttggtttgcctagaaccagcttccgcttttcctgtacttctgggctgagccgagggtcgacagagaggaaggccatgcagctctggggtcctgacaacatgatggttgaccccgcggccatgagcagaactctcaaaagcatgtcgcccaagcgagacccgcccatctatcctatctatcctgaccctagccccctgggtcctaatgcctgccagacaaacttcctcttgcctcccttctctgaggttagacccacttctaaaaattgctacctgtctctggtgcttttctagtttctccgataagaatgatttctagtataaactccaggactctgttaccttctttaggcacctgggctcaccaatcagaaagacataatttttgcccaaagccccatcgtagtggggactacctggaattttaggatccctcctcacactgacaggcctaacaaaagctattcctgaagctaggatatggggagcctcagaaattgtatccttcctattcatataagttaggacaaaagatgtcactcttccaaccctggagaccccttccctccttcagggtatggccctccacttcatttttggggcataacatctttataggacaggggtaaagtcccaatactaacaggagaatgcttaggactctaacaggtttttgagaatgcgtcggtaagggccactaaatccgatttttctcggtcggtcctccttgtggtctaggaggacaggcaagggtgcaggttttcgagaatgcgtcggcaaggaccactaaatccgaccttcctcggtcctccatgtggtctgggaggaaaactagtgtttctgctgccgcgtcggtaagcgcaactattccgatcagcagggtccagggaccgttgcgggttcttgggcaggggttgtttctgctgctgcgtcagtgagcgcaactattccgatcaacagggtccagggactgttgcgggttcttgggcagggggagaaacaaaacaaaccaaaaccgtgggtggttttgtctttcagatgggaaacactcaggcatcaacaggctcacccttgaaatgcatcctaagccattgggaccaatttgacccacaaaccctgaaaaagaggcggctcatttttttctgcactgcggcttggccccaatattctctttctgatggggaaaaatggccacctgcgggaagtacaaattacaataccatcctgcagcttgatcttttctgtaagagggaaggcaaatggagtgaaataccttatgcccaagctttcttttcattgagggagaatacacaactatgcaaagcttgccatttacatcccaaaggaggacctctcggcttacccccatatcccagcctccctatagctccccttcctattaatgataatcctcctctaatctcccctgcccagaaggaaataagcaaagaggtctccaaaggaccacaaacccccccgggctgtcagttgtgtccccttcaagttgtagggggaggggaatttggcccaacccgggtacatgtccccttctccctctctgatttaaagcagatcaaggcagacctggggaagttttcagatgatcctgataggtacatagatgtcctacagggtctagggcaaacctttgacctcacttggagagatgtcatgctactgttagatcaaaccctggcctttaatgaaaagaatgcggctttagctgcagcccgagagtttggagatacctggtatcttagtcaagtaaatgatagaatgacagccgtagaaagggacaaattccctaccggtcagcaagccatccccagtatggatcccaactgggaccttgactcagatcatggggactggagttgtaaacatctgttgacctgtgttctagaaggactaaggagaattagaaaaaagcccatgaattattcagtgatgtccaccataactcagggaaaggaagaaaatccttctgccttcctcgagcggctatgagaggccttaagaaaatatactcccctgtcacccaaatcacttgagggtcaattgattctaaaagataagtttattacccaatcagctgcagatatcaggagaaagctccaaaagcaagccctgggccctgaacaaaatctagagacattattaaacctggcaacctcggtgttctataatagggaccaagaggaacaggtccaaaaggaaaagcgagatcagagaaaggccgcagccttagtcatggccctcagacaaacaaaccttggtggttcagagaggacagaacatgaagcaggccaatcacctggtaaggcttgttatcagtgtggtttactgggacactttaaaaaagattgtccaatgagaaacaagctgccccctcgtccgtgtccactatgctgaggcaatcactggaaggtgcactgccccagaggatgaaggttccctgggtcagaagcccccagccagacgatccaacaacaggactgagggtgcctggggcaagcgccagctcatgtcatcaccctcactgagccccgggtatgtttaactattgagggccaggaaattgacttcctcctggacactggcgcggccttctcagtgttaatctcctgtcctggacgactctcctcaaggtccattaccatccaaggaatcctgggacagcctgtaaccaggtatttctcccacctcctcagttgtaattgggagactttgctcttttcacatgcctttcttgttatgcctgaaagtcccacacccttattagggagggatatattagccaaggctggagctattatctacatgaatatggggaacaagttacccatttgttgtcccctacttgaggagggaatcaaccctgaagtctgggcattggaaggacaatttggaagggcaaaaaatgcccacccagtccaaatcaggttaaaagatcccaccacttttccttatcaaaggcaatatcccttaaggcctgaagctcataaaggattacagaatattgttaaacatttgaaagctcaaggcttagtaaggaaatgcagcagtccctgcaacaccccaattctggaagtacaaagaccgagactagtgcaagatcttagactcattaatgaggcagtaatttcactatatccagttgtacccaaaccctataccctgctctctcaaataccagaggaagcagaatggttcacagttctggacctcaaggatgccttcttctgtgttcccctgcactctgattcacagttcctctttgcttttgaggatcccacaaaccacacatcccaacttacatggatggtcttgccccaagggtttagggatagccctcatctgtttggtcaggccctagccaaagatctaggccacttctcaagtccaggcactctggtccttcaatatgtggatgatttacttttggctaccagttaggaagccttgtgccagcaggctactctagatctcttgaactttctagctaatcaagggtacaaggtgtctatgtcgaaggcccagctttgcctacagcaggttaaatatctaggcctaatcttagccaaagggaccagggccctcagcaaggagtgaatacagcctatactggcttatcctcgccctaagacattaaaacagttgagggagttccttggaattaccagcttttgccgactatggatccctggatacagcgagacagccaggcccctctaatcaaggaaacccagagggcaaatactcatctagttgagtgggaaccagaggcagaaacagccttcaaaaccttaaagcaggctctagtacaagctccagctttaagccttcccacaggacagaatttctctttatatgtcagagagagagccgggatagctcttggagtcctcactcaaactcatgggacaaccccacaaccagtggcatacctaagtaaggaaattgatgtagtagcaaaaggctggcctcactgtttaagggtagttgcagcagtggccgtcttagcatcagaggctatcaaaataatacaaggaaaggatctcactgtctagactacttatgatgtaaatggcatactaggtgccaaaggaagtttatggctatcagacaactgcctacttagataccaggcactactccttgagggaccagtgcttcaaatatgcacatgcatggccctcaaccctgccacttttctcccagaggatggggaaccaatcaagcatgactgccaacaaattatagtccagacttatgccgcccgagatgatctcttagaagtccccttaactaatcctgaccttaacctatatactgatggaagttcatttgtggagaatgggatacgaaggttagtgatgtaaccatacttgaaagcaagcctcttcccccagggaccagtgcccagttagcggaactagtggcacttacccgggccttagaactgggaaagggaaaaagaataaatgtgtatacagatagcaagtatgcttatctaatcctacatgcccatgctgcaatatggaaagagagggagttcctaacctctgtaggaacccccattaaataccacaaggaaattatagagttattgcacgcaatgcaaaaacacaaagaggtgggaatcttacactgacaaagccatcagaataggaaggagaggggagaacagcagcataagcagctggcagaggcagcagaaaggaaagagacaggaagtcaaagaaagagacagagaggaagagacaagaagttagagagaaagagggacagacacagaaagtcaaagagagggtaaaaaagagaggaagagacaaagaagaagtcaaagagagagatggaagtagtaaagaaaaaacagtgtacctattcctttaaaagccagggtaaatttctctctacccagccaaggcatattctcttatgtggatcttcaacccatatctgcctctcaaagttggaagaaataatgaaatctatccttactttacaatcccaaatagactctttggcagcagtgactctccaaaaccgctgaggcctagatctcctcactgctgaaaaaggaggactctgcaccttcttaggggaagagtgttgtttttacactaaccagtcagggatagcatgagatgccacccagcgtttacaggaaaaggcttctgaaatcagacgcctttcaaattcttataccaacctctggagttgggcaacatggcttctcccctttctaggtcccgtggcagccatcttgctgttactcgcctttgggccctgtatttttaaccttcttgtcaaatttgtttcctctagaatcgaggccatcaagctacagatggtcttacaaatggaaccccaaatgagttcaactaacaacttctaccgaggacccctggactgaccagctggcacttcccctggcctagagagttcccctctgaaggacactacaactgcaaagccccttcttcgcccctatccagcaggaagtagctagagcagtcatcggccaaattcccaacagcagttggggtgtcctgttgattgaggggagacagcatgctggcagtcctcacagccctcactcgctcgctcactctcggcacctcctctgcctgggctcccactttggcagcacttgaggagcccttcagctctgtatctagctactctgatgggtccttggagaacctttatgtctagctcagggattgtaaatacaccaatcagcaccctgtgtctagctcagggtttgtgaatgcaccaatggacactctgtatctagctactctggtggggccttggagaacctttgtgtcaacactctgtatctaactaacctggtggggatgtggagaacctttgtgtctagctcagggattgtaaacgcaccaatcagtgccctgtcaaaccactcggctctaccaatcagcaggatgtgggtggggccagataagagaataaaagcaggctgcccgagccagcagtggcaacccgctcaggtccccttccacactgtggaagctttgttctttcgctctttgcaatacatcttgctactgctcactctttgggtccacactgcttttatgagctgtaacactcaccacaaaggtctgtagcttcactcctgagccagcgagaccacgaactcaccagaaggaagaaactccaaacacatccgaacatcagaagaaacaaactccagacgcaccaccttaagagctgtaacactcactgtgagggtccatggcttcattcttgaagtcagtgagaccaagaacccaccaattccggacacacaaccggccatgtgacaggctcagggaaggacatgtgactcaaggcaggccagtgaagtgcaattctaggttagactggccgggaaggagcggccgtgttttctgttgatggatgctgctgccctctcctcaacctctcacgctctgcactacagacaacctccttggggctgaggccagcacagcgcaaagcacagcaagaggggagcccgagcccctggatccagccatcctccacggcaagctcagaccacccgctccctcagctctttcacagaaccctggtctacctagttgatgtcttatataattccactattatctgtgattaattaatgtggaaccacatgattatctgtgtgacctggtctgaggtctcccctagactgagcaccccctctggacggcaggtgagcatctgaccggtccacagctgtggcccccacacagcagctggcacacacaggggctctgcatgttagactcctgcagtaacacccaggggcatgggtgcgccttactcctctctgggatcccggagcccagcacagcgtcagccaggcacagcagagagaacaggaggtgcaggctgagacagggcagtgcagtgcctaagagtctgggctgtggagtctgagagctctggttccaatcccagcgtggggcccttaggcaaggtgtctctcctccctgaaagcagtctcaccagccagagacagtgttggccctgccttatgggctgttgtgagggtgagatgaattgactccaagtacttggcacccaggaagtgtccattgctgtggggcatggcgtgactggaaggaggagccccagccagcgacctggagtggtctgcccaaggtcaaggccccagtacagcagaagcaagagctctagagctgtcaaagacctttattcagtcctggagtggagctggcctgacagggtgaagccaggggctgcttagggcgggccagaccctcagcccctgagcaggtcaggccggccaggcggggctggtaggtaccaggtgccagcagctgcagggcaaactcagtgatgacagctgtgaggccccagacccggtgtggtccatgcaggaagacgggtagtgtgtagcggaagtggccaccccggcagaagtgggtatagccctgattctgcgtctgcagcaggtgggccagcggcagtgcaaacacctcatctacctgcaggcaggaggcagagagggtagacagaggactggaacagcccaaccccctcatatcccccagctcacctcctccgagttgggcctgaggctctggggatccagtgggcctacaccagcaagcactggcaccacggtggccttttgctggggaagagggcaggtggtcagggaagcatggccttcgctgggtttgaaggctggggaggggagtgtgagaggaagacccctttgccatgcataggcctttggtagtcatgttcgggtccacctgcctgtgtcctccagccatgctgactgactcaggtcccctcaaatgcactagacctgttccctctgcttaggacaatctcccacttggcattcaagcctgggttcaatccctgcctaccccatgaagcttccctgaccctaatccaccaaactgagtggagctggcccaccccatcgccctgggccacctctactcaggacaccagagcctccccaatcccttcccgagggggtgtgtggggtggtgcatgtgaccaggcaggttaggggcacccttccacactttgtgcccgtgggggtccatgaccactctcctggtccctggtagcccagctccagggcaggcacagagtgagtgaatggggtggggtggcctcagccaagtggcttaccggatcatacacaggccgcagcaggccccacacgtgctcctcgggcactgccaggcccagctcctcccgggtttcccgcagggccgtgtgcaccacatcttggtcagccgggtcgcacttgccgcctgggaaactaaacagacacaaggagtctggtccttggactcttggggccacggagaggtcggggtatcggcagtgcggggggggccactggcccaccgaagtgtcgcctgcctctgcccctagtttactgggaggccccaggcaagccatgcgacctctggaggccagtttacctccctgagcaatggggataaggaagagaggcccgggacagcgcaggataagagggtctgcagcaggggcaagaagatcctggggctcagatacccaaattcggcctatggtggccccagcaacactgacattgtcctcaggatgttcttaattcccgccgggcggggcccgaacctctccgtagtcgccggcagggggcggcgtccgccctctaagcgggaaacagctcaaaggggtgtcccggcccaggcgtgcgcgcaaggacgcgtacgaggggcccacgcggcgaggacgtggcgccccggcaggtgcaccggggccgacggacacggatcgctgacctctcgctgcagcccttgggcggagggactctccccagacccattttacggaggcggaaaccgaggctcgaaggggctaagtgccctgccagaggtccctgccagccccgggctcctgtagcctccggcaaagggcgaggagttcccggccgctgtacctgacgtcgcccttgtgcctcccggtcaggcggctggaccgcagcgtgtacagcagcgccgggaccccacgcactgagcagagcggcacgagcaccgcggccgacgcgggccgcgcgcggagccgggccgtggcccctgccagcagccggcggcagcgcagctcgccctcggccgacaggcagtcgggcagcatgtcaagtcctgcgcggccgggacactgagggcgcgggatcgggcgagggaagaggcggggcgaggcggggcggggcgctcagcccgggtccctccgaaagctgagagggagaaggggcagcccgcgcgacgcgtcccgcctggggggctgcagagcggcagcggcgtcggggggcctcagtggggtgggtctgttcgtgggcggggccttcccggagacggggcctcggtgggactgggtctgttcgggggcggggcctgtttgaaggcgggtcctcggtgggacggggtccgttagggggcggggcctgtttgaaggcggggcctcggtgggacgcgttgagtcccccggatgggagggacggagggcggcggggcggggcggggcggggcctgcgcgggagccggactcggacgttactgccaaagggcggcggggcctagtaggcaatcgaggttggggcgggctgggggcggggcctggaccggagcttttgctacgaaggactggggggcgtggccaggaggactgtgcttccggcagggccgggccgtggccgggggtgtggccgcggggagggagatgggcgcggagctgcaggacctgccggttgtgttctccgagatcctgaaaccacgcgaaccgtgaagcgcccggcgaccgtcctcggtcccgttgggtcctggcgttggggtgtctgatgaggccccgccggcccccactggtccgtccctcccctaggggctccaggatgtacggagccgggatcccacggggacgcccctccaggaacccgaggtcgatcggtgcgcgagaggagcgtccggcccagccctccctccggtcctccctcccgataccgctgggtggcgcgcgccgcccccagtcttgtcttcccctctggctccgtcggactccagccccaggcctttgacctccttgtcccagcgtccagagctcttctcccttcctgccttgagtcttgaccggattcccaaatccctccccctttcctacctcggcccctgtggtcactgaccaccgtggttctgcgcccttccaccagaccctgggcttggggaccagatgaccccagccttgcgcacagcatttaaacgtggggtggcgggtgtccgccatgctctgctgtgtgacgttgagcaggtcccgcgcctctctgagcgccagtttcgatcctcatctgggcaagtgcagccctgccactgggctggagtcaccacttttaatattactgtgtgctcccagggatgcggacggcactgggcagagcttcgggatgcctacagggctgatgtggggactatgatgggtctgggagttcctgaggcccccacccaccctgaccacgacgacagaagtgctctgaccactcatgccaaatagtttaatgttagggggaagggagaggtaaggcagggttttcgggagttacccccaaagcaagagggcacagtattcaggctgctggggttgggagatagaagtcctggttccaagcttgccatggtcccagccttgctgtgaccctgggcaggtagcctctttctctagactttcacctaccctgctctccttgagacagagatggggctggagggggcggggcagaggctgattcccacacccggtgtaaggtccagggtagcagggcttccccccagggcttctggcatcactgggagtcctggccaggccccaggcacaccacagtgggggacaggagccccagcccagctgggagaggcaggcctccttgatccctatcagcccggatgttggggagggggtatggtgctggtcgggtccttgggatccctaggtggctcggggctccagagtacaggctctgatacgtgacaggcctgtaggtggccggggccagcaggacctcaggtgggggcagcagctgatgatggagccaagcaggggtcttggaggtggaagctgaagctttgttggggtctgagggaggaaatgagtggactctgggcctcccatcgcatcctcatccctcatcccaggcctgccctggtcccttcctgctcctccttcccaagttacctacctctcagccttcgcctttgcttttccctctgcctggaatttcttcttcaccttctccctctgtccaaacccttcccagtcctccaaggcccagcttgagagccacctcctgcaggaagcctgcctggcaccccctgcctgtgctctttgccctgagccccatattgtcttaggcatgtctgcttccccctccgtgtgtccacacaggggccctgtgggttcgctgagctgctgaagccccttcctggaggtcctgtccctttgccttccgcccactgtgtacaccttagtcccactatgtctgcaggcctggggccttacctttctccctgtctgtggcacccttcagcacacagggactgaggctgctgtgactccgggctgggacactgagcaggggccgtggggccacaggcctgaaagagcaagcgagaatggggggaggggatcaaggggaagaacccaggccagggatcatggccagcttcagatggtggggccccaggatgggtcagagggtgtgaccctgaaacaagggtcaggaactgaggccttaggatatgcctggggtgggggtgaggggctagggtcagggtcagacagtaccaggagtccaggtcactctctctaaagcctttggcaaaagggttgctggcgattttcagctgggtgatctgcaggagacaaagtgcagttgtgggctggccatgagccaggctcagccaccttgtcctcccgggaaccggcagtcaggaggccctggcacctgggcctcttggcccaggaactctgagctgataggagtgcgggcagggccttgactgatggcagatactcagggcaagttgggagggcagtagtctgtgccagtgagggctgcaagcctcagggctcagtctccacccctgtgaaatgggcctgcagcgggtgctcccgagctggttcacccaccctgtggttctgataggctgtcactgctgtgaactgggtctctgtgaagatgaaggacttgaagttctcctgggcatagcgctcactgtccttgcgtgggtccacgaagaccacgtggaaacggggctggtagcggtgcatagagttgagaatgatctgtggaagggacagagcaggggtacaggggtgaggcggagtacagcggactccctgaggctggagtccttccctccaagccgggagactgccctgggcctgccaccctgttcctttcatggcagcacagggtctgagctggagaggctgcagttccgtgtcaaaggcccctttggatcatggatccttgcctccatgtcctctcacaccccacatcccagctgccacccactgcctgtgtgctggcccgtcactgtcgcgttcaccagtttcctcggttgcctcctggcctgtcccctgtccccgccttacccctctgttccttctccacacagctgcccgggaagccacatcatatgccccctgctcctaaccgtccagcgacttccaccccacacggtaaaagccagagccccccgaagtcagcccgacccctcaggcattcgcctccttggcttcccctcctggctccactccggccccatggatgcgtcttgcaattctgccggcccaggattctctggcctcagggcctttgcacctactgtcccctctgacgggcatgggccgctgcatcctccacctccttcaggtcttcagctccctgcgccccctgagagcagcagcaccctttctccgccccccttccgtacctctgcttcctctttggcatttgtccctatctgagacgctggggacagtgtcttctggaccctgcctttgccccaggaagtgacctctgtgagggcagggatcgttggctgtttgaccaagtgttaatgatgctgtgtccacacataaagcgggcccggcctaggctgggcgttccataccttgtcctccctctccttgcgggggacaacgtatgctggaacattcccccgcccccacccccttttccacctgcctggacagcccttcctgctgtgccacccccagccaggtgagctcgccaccccggctccccgccctgccttgaccatcagcagcaggcagaggtgctgggcaccaaggccattggacaccaaagtccctaccagccctgaccccaggcccttccgtccccaccgtggccccggcctcacgtggccattgtcatccagcaggttgttggtcagcttgagcttgtcaaaggacacaatctggcgcatccactgggcacccttggctggcgagtcggggtggaagtgcacgcggccaggtgtggctgggtctgccttgcccgccaccagccaggccgagctgtggaaggcatacctggggagcacagcgaggtggtgagggcttccccaaccagagtcacgcctgaacaatacaggcggggtgaaggggctgctgccgactccaacactgctcaccccacctggtgggcaccttgctaaggaacccaaggctcaagagaatcctgttgagacctgagttccctgtggctgcacctggctggtggatgacaggataacccctgctgccctgggctagacctctctgcctgcccaaggctagcccactacccatggaagtctgctgggtaccctgagctgggctgcctcctgccctcaggctgttgttgcgtgtctgtcgtcctgcccttaggctggacctccctggcattgtttggacaggcccctgcctcaccttggggtgcaggaagggtctaattcctggtctcagcacctgagacctgagcctttgccccaggccggtccccgcacctgtatctcttgtcgtccagggggatgaagtccatgagcagggcgtagtcggccagggagtccatgcccaggatcttcacctggaagggggggaacatcctcctgcgggagggaggtgctcagcagccggatgcggctccaaccctggcccctgcctcaccccgcccccgctgctcacacctgcctgccttggtgacgatcatctcagtgcccagctggttgaattcctcccacagaggcttcatctccagctgaactgtcactctggacacacgtgggttcttggggccctgcccagtgggctcggccacagcttgggccccagtagagctggtgcaagggcctgatgggaatggtgaccccagccggggctcccagccagagctggttgtaggtagggggtaggtctctgagggtgcaagtatgccgaggccagcagataggaaggctgtggagagaggacggaagtgtgggccccacgcatcacccagccagctcttatccttcaggctgcacctatatgcctcttcctccaggaagccctccctgactgccagggctgtgttctcacaggatcccccactcagcatcactctgtgaggtaaatgctcacttaaagtttattttgccagcaagctccttgacggtagtgtcagggcctgtcttgctccccagagaatgtttgggccatcttgtgtctatgtggcctcaagcaaattgtttcacctcctggagcctcagtttccacatctgtcagaaggggctcttaatacctgcctcacaaggccgatgtgaggattagtgaccatgcacaggggctggtgcacagggggcccttcacaaacagcacctgttctagatgatatgtgtgtggggcgggggagggggcaggggtcttccccagctctgtgggaccctgcctcccggtgctgctgaaggagagctgagccaagaagagccccccattcagcaccaattacccatccctgaccttgacaacccgcccagagcctgcctccagaaacccatcctaccgtctttttctctggtctctgcactcttttctaagcatcttgtcttttgatctgcaatcccggcacaagtcttggccaaatgctttgtcacccttcacccctccaattaaaaaaaatcttagctaaataagataccattttatacccattaagatggctattagaaaagaaaagaaaccagaaaataaaaagtgttggtaaggagatggaaaaattagaactcctttttttttttttttttttttttgaggcagggtctcactctgtttcccaggctggagtgcagcgggagctctgtcatagctcactgcagcctcgacctcctggcctcaagtgatcctcccatatcagccttacaagtagctgggactataggtgcacaccaccacacacggctactttttttttttttttgtagagatgggatctccctatgttgcccaggctggtcttgaattcctgagctcaagtgatcctcccacctcggcctcctaaagtgttgggattacaggtgtgagccactatgcctggcctcaagaaattggaactcttgtgcactgctggtgggaatgtaaaaggtgcagctgctggggaaacagcatggtagctcctcaaaaaattaaaactagaattactatatatgtatatattatttatttatttatttatttatttttttccagagtcttgctctgtcacccaggccggatggatctcggctcactgcaacctctgcctccctggttcaaaagattctcctgcctcagcctcccgagtagctgggattacaggcgtgcatcatcatgcctggctaatttttgtatttttattagagacgggatttcaccatgttgtctaggcttgtctcgaactcctgacctcaggtgatttgcccacctcagcctcccaaagtgctggggttacaggcgtgagccatcatgcccagcctagaattaccatatgatccagcaattccacttctgggtctataccagaaagaattgaaagaaggaactcaaacagatatttgcacacccatgttcttatgagcattattcacaatagctgagaagtggaagcaacccagtgtccattggaaaatgaatggatgaacaaaatggggtccatccgtgcaaggtaatagtatccagccttaacagggaagaacattctgacacatgctgcaacatggatgagtcctgaagatgctgttacacgaaatgagccagacaccaaaggacaaataccatatgattctactcataggccgtacgtggtgaggccaaatcatagaaacagaaagtagaatggtggttgccaggggctggggaggaggagatggagagttgttgtttcataaggacagaatatcagttctgcaagatgcaaaatgttctagagatggatgctaatgatggttgcacaacagtgttgttagaaatgcttgttttccggtgccgtaaagaaatagcacttgaacataaatttaatttcctcagcaaggccatttttttttactttttgcagaaagggtacactcgccagcagctttgccatgagagtacaccgaacaaaggagacagggtcatttataacctgacgtgtccaccctactgctgtgtctggttcccattggccggaacgggacctcacattctgtatttgtcctgattggctagtaacttagaacttttaaaactggcaaaggcagaggagaacaaaggaaggaggaagtaacttatagaatgctgagaaaggtaaaaacaccttcaaataaggaagaggaacaggctatgacctaatgtttgcttggaccaatataagcatgctagggcaaatatttaggctaaattgtgggagctaagaacataaaatatattgatttttttttattattgttagcagatatttaagaatgttagtacaggtctttgaataaattttgcttctaagagaagttattatttattctaattagatggcaggaaagtctatgaagaggaacctctactttactttttacaatgtgaatgtaattaatgacacaaaactgtgtatttaaaaatggttaaggtgggccgggcgcggtggctcatgcctgtaatcccagcactttgggaggccgaggcgggtaggtcacttgaggtcaggagtttgagaccagcctggccatcacggcaaaccctatctctactaaaaatacaaaaattagccagaagtgctggcgggcacctgtaatcccagctattcgggaggctgagacacaagtgtcgcttgaacccaagggggtggaggttgcagtgagacatgttcacaccactgcactccagcctgggtgacagagtgagactctgtctcaaaaaataaataaataaataaataaataaatataaataaataaaaaggttaagatggtaaattgtgttatgtatattttacaattaaaatgttttaaatggaaaaaaatcctgagaaacagaactattattttatagcagccccataaggggctgagaagctggaagggccatggaagccacagtggctgggagtcaggggacaaggttttattcccagctgtgtccccacccgagtggctttgggatatttacacgactgtaagactatgggatgcctggagcagaggggggtgctgggtgttggagagatggatgaactggcagacaggcgggtgacggaggcccccaggtggcatagcatctgctgaggtaccaggtggacggcacctggccagggtgagctcttagtaggtgcctggggagaatgtggagcccagggccatggccacgtcctcagcagccctgagagctgcgtgcaaaggccctgggatttctgcagcctcgcgggggagggggcgtctttgtgacagggatgggtcacatcaggtttgaggaccctgggcaggatggatagatgggctgatgtccccctgcccctgtggccagtccatcagaagggtagctggttgtcgcccggctgccctgctggggcgggtacgtcatccaggtgatgccagcccccctgggtccatggcaatgggtcccaaggtgggggggctcatgatttcactgggcctggaggctttgccggtggtcactggctcccaagtcctctaggggctcacccgctgcccgtcgcagccaatgtgctgcccctcaacactttcagggactctggtggggggagcctgtcctttgctcagtccctctagaagccagcattcctcagggcccagagatgacagcttgccagaagcatcgagtgtcaagtctggaagggaagctaagggcttcttgtccagccccaactttgatgctcaaggagctggggctcagggagaggcccgaggtcacacgtgcccagtgaggcgctcatctcccggaacagcctggtccctggcatctcccataattgcacttgggcagccgtgagccctgtcccgttgggatctcagaccttagcctggggtgcccctgccccaccctcttgtgaaggacctgggttcagcggggctgtcttggttcccaccctgcccacccaccctggaacctgagcctgacccatgaggccacctctgcttcagaacgtagcctacctgccatggagacagagaggctgtccggctcctggagaaacactgcttggctggggctgggaacctgcctgctggaaggggtggtcaccactcgtccactcggcacctcagctcagccctcaggtgctcacacaagctgtagtctctcggcaggacggtccttgcctcctcgatcgcccttcgtccacgtcctgaggtcgtggtcttcctactcgagctggacccctggtctccgaaggtgagatgcaggctctggggcgtgcagcggcccttctccaagccactctcgggctgtgctgtccaaggctgtgcgggaggagggcaggtgggaaggttctgacgttgcagagccccccttcctccctccttgtcctccctcttcaagttcctcccttccccagctaagagccccccagccattcctgatcgatgggcccaggcgtggcaggggtgagggggtgggagagtggttcttgaggacggctgggcatctgcaggggtccaggcctggctgactggaggggctggggccccgggggttgggaggcacagtgggagcagcagattgcgggctgaatggcggaggaggtgccctcccaccaagacccagacccctgacctgaggctggccccagccggccggcagatgcgcaattgtcaggagcagtgtgagcaggaaacgcaagggggcagcagcaacgagtgcagtcagcatagagccccagactggatggcgggaagcccaggtcctgtggcacgtgaacccacacgcacagacacatggatgaactcagggagctgcgcaacgctggcaggtcccacagtctccgtgcctcagcctccccagttaacctaagcacataatctcttccgcctgtgatggtctagcccagcctggagagcggtaagcccatcccgcctggaactgggggcactgccctggctgatggtgtccacggaatccccatctggacatgagtggaaacggtgaggctggcccaggtgagaagtgggcgtccgctctgcctgtgggtctgtctgttctctctggcctgaccgggcaccctctccaggttgtctacagcctgtgctgggcattcaggggacacatggatcactctgcagggaggcagaacctggaggtccccctgagaggctgccagttccttggttgagagtgctcgctggccttttgactcttgctgaatggcacagagtgggtcgtctggctggagccccccatacctcctccagaatcctgtcttggggatgctgggttggcagtggccttgattcctaagagggggcatggaggggctggggggcggcagggctgcttctccctgagcgctatgttctgggcgcagctgcagctcagggatgcctgtggctcaatcccttgtgtctcacatctcagcctgcagagctggatgggaccccacacaaagacggtgggctggctctgggggatgtaaaaggaggagggccggcccctggcccaaccccatgcccggctgtgtgagaaaaggctgccagcactttggagttgctgccaggcaagatgggagtgctctgtgtgagttggagggtcccagcagccccttgaggctatacaacaaggtgtagtcatctgccctggccatggcatggtgggtgggaagtggggagatgatggagggagttgggggatccattccagtactggtggctccccttcaccgagacacccaggggagggccaggctgggattgtagtggcccctgatacgtgtgtgtgtgcgattttgatctgtgtgatgggaaacaacccccctcccacacacacacacgagcacactgacatgctaacccacatgcacgcagacacacggatgaactcagagcctgctgactcgccacatggcgcacacacgtacagcttctgtgcacatggacttaccacacagcacgcgcacagacacaggcaggcctccctgcacacccctccccggctggcccgcccgccctgcctgcccgaggcgcctgctggccccctgccccctcatccatcttgcctgccagcctgtccctggtgcccccgtatccttcacaccttctcatatcactgctcaataccaggaggtggcgtggcagccgtggccgcagggaaatggatgggcagggtgggggtgtagagggctgggggagtggcactgcgaggggactctggactccagcagccccagatgtccaacaagagtccattaggctcaggcaggtgcgggcagtgaggctgcagccaggtcgcatatagccctgcctatttgtcctgccatgacaccctgaagggtgccagcatcaggacagaggggccctcagcagtgggcctcatgccggctcgcctgacatcagtgcgcggtgtcctggggatggcggaaatggtggcttcccaattagagctgggaagtccctgtgccccaacccaagccacctcctccctgcatctctgcagttggacaggctgtcctgcatggggacagccttgtcctgctgtggcccttcccccagccctgactccctgcttgagccactatgggcaccgggctcattacacacttaaaaatgcacatctggccacatagagatccccttagaacgcccaaggaactgaggctcttggaaacacgtgtgtgtgggaaacgcacagacacgcacgccaaagagcatccagggcaggcgccatgcacggacaaacacacatgtgtgcacagacatgggcctgtctctgcgctccccacactcactgtctggccccaggactataggagggttggggggtccccctctgggttgtagcctcctctggaagcccctccgctggatccagagcaatccttcttcaggttctcctcccacactctggaatcctcccccaggcatggatggacagctgtgggcacagaggcagccaccactggccccaagacacttgcaggtccaaggctgcactggccagacctcccccagatcctgtggtcaacctcccttcctccatccacttccccagccagagaggagccgtgcaggacagaggacacaaaccatggacctctggacatcttccattttatagaaagggaaattgaggccaggggttggggaggcctggcaaggaacatggtgcatggtaggtggcagaagggacctctgtgctcagagctgtgcctcaggacccatcgttcagatgggaagactgaggttggggaggtgtgtcttgggttaggaagctgggctcggggcaggggtcagcgcgggcatggcaggcacggtgaatgtgaacttctcagtctggacaaaggcaacgcccttctcatagtaggcagcctcgttaatgaacacggggtacaccgtggactctccctcatagagcaggtcctccccactgaacatctggaagatgggagcaccaggctgcagtggctggaagtctcggtcctgggaggagagccaaaggccaagattgctggggccacctctgccctggccccagaggggggtgaccccagcttgacacccaaaagatgcccctcattcatggcttttcccacccatgcttcacttccttaatccatatgacagcaggtctggtgagataccagtctgctctgtgtctagaaatgaagacacaggtcaccttggggtggcatgtgcccatgtggaagtggaccctcatggatacgggcacaggtattgaagctggagttcaaattcttgctagctgtgtaactgtgagcaagtcacttaacctctgtttctcagctttcttgtctgtaaaataaggattacaatatctcctcctatcattctgaagtttagactaaacaggttaatagtgcttacagcagtgtctggcacacggtaagtacaatatgattctttattaaataaattttggctgggcgcagtggctcacgcctgtaatcccagcactttgggaggccaaggcgggtggatcatgaggtcaggagttcaagaccagcctggccaacatggtgaaatttcatctctactaaaaatacaaaaattagccaggtgtggtggtgagcgcctgtaatcccagctattcgggaggctgaggcaggagaatcgcttgaactcaggaggcggaggttgcagtaagccaatattatgccactgcactccagcctgggcaacagagcgagactctgtctcaaataaataaataaataaattttaagcctgggcacagtggctcataatctcagtggcctgtaatctcagcactttgggaggctgaggtgggcagatcacttgaggtcaggagttcgagaccagcctggccaacgtggtgaaaccctgtctgtactaaaaagacaaaaattggctgggtgtggtggtgagtgcctataatcccagctactggggaggctgagtcaggagaatcgcttgaacccaggaggcagatgtcacagtgagttgagatcgcaccactgcactctagcctgggcaatgaagcaagattctgtctcaaaaaataataataaaaaataaaataaattttaaaattgtaggaggagccacccaaattgactgttatgactgaacgtctgcaaggtagctgggcacggctggattaagactgtctagccctaaacatggacgggatggtgctgcctccatttgtaagaaggtaactcctcaaaatgaaacttcagggcacaaaaggccacaagattgcaccagaccctattcaacaatgaccccctgtggcagcaagcagagcagcagccagtacgttcttctcaggcacccaagggaaaggtgtggaagcaggattgcctaatcctggaacattcaggaagggaaggcctgcagagagacatactgccaacatgcatggggatgctcgaggaaccaattgaaaatcagaagagagttttgtatttgcacctccaagcaggtgaattgagtcatgcctgctccatgtcccctccctctgccttttacagccagggtagggttgtctccatcatgccctccacaggagctatggggatcactgtggcctcttgtgctaggcctgagtgtggggttccagggaaggcagcagggccaggggaagtgggatggcggagcccagcctcccatcctgctcctcaacccgagatgctggtgagctcgtgggaggcttggctgcaccccctggggctcagttttccttgacaatcctcctccccaaggctgtggccccagaaatcaccccccaccacacacacacacacacacacacacacctgcagctgaggatgcacagtgcctgccaggtgcccggcctcggtgcgggggaagtccacgacgcccacgggtctataggcttccatctcaaaggcaggaaaggccgtacctgtgtgggaggctgggtgtgtgagcccatccctccctccaggctaggggacagactgggccgtgggggtacgtcagggctagatcccagcctgcctgtgagcctggctccccaacccctgagccagacctgctcttccccggacctgtttcccgaaagtcccctggggtctcaccctggttgaagagttcgatgaagtccagaactgtggccaccagggtcctcatccttgagaaaatgtcagcccgcagcacaccctgtggctgggggcccagctccagacctggggaccaggaagcaaggggttaggcaggtgcaggacccatatactccttgaagaggccctgccccttggtgactggacccgcccctccagccctcctggccccgcccacttctcagaaggctgcggcccacccagtccatttttggccacagagtccaggttgtagctctcctccccagaccgctggtacaggaagacctggcaggacagctcggggtactgcagctgggggcgagagaggcaggttaggggcccaggcctacttgggaagggaaactgaggtgggaaggtgttgcatggaggaaacacagggcaccaccctccttggccaggtctccctctaccctctggcagggtaggggagggggtaccgggggcctggagtgctggcgagtggcagaccccagggactggagcccaggggaaactaggcccggggaagaggggctaagcaaaggaggttccagcattgtcccgcctgccctccctccctcccactcccctctggggagctgtgtgcttggggccggggccacctgcagatggcggcacaggtgcatggcaaagacttcgtgggaggacttcgcgattaagcaggtgcccatgttggccgtggtgttgtgcaggtcaaggacaaagtcaaaggcctggcccgaggccttgggccccagcagctggttcagctctcgggctcttgtcacctcatatgggtcgtccggggtgggcctggaactgtggagacgggaatgggggacaccgatcttcacagtctcagtcagtcttcagtggtttaaggggaaaggggcaggggccctgcaggagccactctgagcagctcgagcgagggctttcccttcagacgttgtggctgtgtccacccctgcccgtggccctcttggctctgcacttcccggtaaaatccaagctctcagcctggcccgccctcccacctgcctgcccacttgcctgcctctcatgccctcattccagccacactgcctgagcaccatgctggtctcacccccaggcctgtgctgtgcttggccctccagtggaaactccctctcacctctcttcccctggctagcttttagtcagcctttggggcttggctgagacaccattgcctccaggaagccttccctgactgctctcagccaggttagctgctttgtgtagcctccggccctgcctttagccccctgggttatggttgcccggttcttcctctgtctccccattaagcttgaagccaacaccttggtcctattccccattctctcacctgagctggccagagcctggcctggagataggatgcagtgactattcattggaaggaggcatgaacagtgatcagggcacacgacaagtaaacatggcctgtggggctaatctgagggaagaattaggtctgggatccccagaagaggtcctgaaccaacttgcagtcaggaaggccttcctggaggaggtgacatcaatcttggtttctctaaatgttcggtttgtcccgtggaggaatgggccacataggcagaggggaagcaggagtgaaggcagggagggccctgctggtggcgggagggaagttttgtggtggggactcggtgcccaactgcctgggccaacctggcggcaaaagcactcacttgaggaagctgctggtgaaggtgcggttgaggtcatggtccacgtagcggcggcagccggatgtggctgccgggttggccagcacaggcacagcggagaagctggctctctgcagctctgcgggggcatgcagccagtgccgggccaggtagacgcccgacatctcgttgccatgcgtgcccccagtcacagccacgcgacgcaggggctcccggggcacaggcagtgagcacatgctggtgtggggtgcagaacctgggggtgggcatacttaggagaccctggccccgatgcaagggatctgggctcagggcaaggatggcggtgggaggctccacagggcagccacctgtcaagaggtgtggacagctgggagtgtctcagctgtgtcccacctgcacccccagtggccctttctctgaggagacaattttcctgctcctttggagaaaagaagtttctttttcctaaattgagaagaggggcccaactgttcaggaagatgggttcaccaaggcacactccctataggaagaggactgcgctcctttttatagacagggaaactgaggcacagcgtggggagtggaaagtgtcaccagagttagctgtggagtgtctgggttctaggcaacagcctcgccttcctgcccctcctgcttgctcctcccagctggtgcaggggtctcaggtcagggggtacttaccgctgatgcggatctgggcttcccgggccaccaggactggcgtctaactcgcagacaggctggtattcatgggcctggagatccacagatgggaagttttgtggcaagctggcagacagcagggggtgggtgggacgggctgaggttcatgcagccaaaggtcggagtgctggggtctgctccactgctcctgccccgcccgccccacgctgctacttgtgctgccacggcccaacgagtccaggtcctgcgggcaagttcctgcccctgcccttcgtccttctgctgggccccagaggggccaccttccttaacactactaagaggtacacccgcagtggggtggtgacttggttttggtcaccaccagagcaggctattgaaagttactatagaggtgtcaccttgatggccaccaagatgacaagctgcccctccttcaccacctcggcaacatgcctctgtccttgcagcccggagagggctgtggtcactcctgagtcgcccttacccaaaggtgccatgtggagccccagttttacagctctttgttgctttaagcaaaattttaaaatgtttgatccgggatttcagtcattttcaaggacagtgtaactcagatgactcggtttgccctgttttgggaacaaccctcaggctcattttatagatgtgaaaactgaggctcagaaaattgtctgcaggcacacaagccctagaggcaggctgcaggtggcccacagaaccctaggggcagactgttcagcggcacacagagccctagaggcgggctgcaggtggcgcacagagccctagaggcgggctgtaggtggcactcagtgcgtccaatgtggctccatcccctcctgctgcctctcaagagcaaagtggggaaggatgaaggtgaggtcccctgcactcagccctggggcctctacctcccaccaggctcagctgtctgctgggaggagctgaggccagttccgaagtcactggggagtgaggcaagctgctccgccagggcctgctggatgccaggtgctgggaccctgagctggagcctcccccaggcatcgatcctgggccttctttaccaccacactgggtctccccgggccagtccagccctgctccagatgccaggcccaccagcctggggggctctgggtggccaggaccctctaagttacaccctctcggaagctgccccagatcacactcagctctgtgtggcctgggctctcctgccctccacacccaaggcttcgtgagctcagagcatggcgattgtggggacaggggatttgtcatcctggctcccatcagggcagctgggatcttgacagggtgtcaagaggggtggatggagtgtgaggctgagcccccagtgggccggggctccctatgagccccctccaggggccactcctcctggcacctggagcctcagcaaagggagggcagagactgccattagggggccatgccatgccatcaactcctgtatccggcccagccctgggggcagctgtcaccggctccattttgcaggtgtggactgaagctctaggggttgggtgacttgactgagtccttggcaggtggtgggagagggagtcagcagaggagcctgtcggcctgggtctgttccttccttgcttggggtaggggtctcagggacccccatgctgctttatgagtcccaggccatggtctttgttggaaggcccccccaacccccacagaggctgggatcctgctgactcggtgtggtacctctcaggaaggaagggcctccgtggcagacctagctattttgggggctgctgggggccagggtgcttcctgccacaaggtgctgggcccccaagtttagggagaacagcagtaggggtgctggaaagtttcacttcccttggctggggtccagcttctgcatttcagtgagtgtttatggaacagaacggggtccaggaaccctcagaaacagcagcccccagtcctggcagtgtgtgcgcgtgtgtgcatgtgtgtgcatgcatgtgtgcatctgtacatgtgtgcgtgtgcatgagagcatgtgtgtgcgtgtgtgcactcacatgtgtacgtgacagcatgcgtgtgtgcgtgcgtgtgtacatgtgtgtgcatgtgcatgagtattgtgtgcatgtgtgcatgtatgtgtacatgtgtgcgtgtgtgcatgagagcatgtgtgcgtgtgtgcgcatgtgtgacagcatgcatgtgtgcgtgtgtacgtgtgtgcatgtgcatgagagtattgtgtgcatgtgtgcatgcatgtgtgtgtacatgtgtgcgtgtgtgcatgagagtgtgtgtgcatgtgtgtgcatgtgtgcatgtgcttgagagcgtgtgtgcgtgcatgtgcgtgagcatgtgtgcgtgtgtgtgtgttgtgtgcacacgtgtgacctggctctggccccacctccctgacaggctgtgtgacctggagagattcagtgccctctctgggccttggctccaccctgtgaaagtcctggccaagggcagctgtggggagtgaggaacaaagggcgggcacaagcttgaaaatgggcacatggagaccccagcatgagtgagggcagaggatggtgatgtcatgggcatcatcacgggggccaatttcctcactgcagttggggaaactgagacccagagaggggtcagagctgtggttcccccctgtgtcagcatccaattagatcatgcctcccagcatcacctcattgcaagatgcaatcagatcacgcctcattaccctatgcttataaaacctgccccagccctcagctcggggagacactgctttgggagctgtctaggtgttctccttacttgttgcaagaaataaaatcccctattaaatcctctttagttaacacccgccaagcaactgagcccacccgttgtgtgggtaacaaaactctggcgacccagatggggccgactgggattctgatcctaacttcttgaggctcactaaggtaaagcagtgggccgcggcaccttccccgggcgaactcacccacgtggccccagagggttgagggtgactcccggggatcttctgcttgctgcgtggcccgtggggctgtcactccgccctacccccgaaacagcggaagcagctgcctggagcttttgttctgtgctgctccttcagggaagaaagtggactttgccccgtgggttgactgaaagggtaaattctttggacctagcagtgggatctctagacttcagcgcagggcacctctgctttcggtttctgtctggctctacgtgccgtgggggattgagaggcatctctggccaggccaagggcaacccggatcccggatctgggtagacaacagtgggactagttttgggaattcgtttttttttttttgagacagagtctggctctgtcacccaagctggggtgcagtggcgcgatctcggctcactgcaagctccacctcccgggttcacgccattctcctgcctcagcttcctgagtagctgggaccacaggcgcccgccaccacgcccggctaattttttgcatttttagtagagacggggtttcaccgtgttagccaggatggtctcgatctcttgacctcgtgatccgcccgcctcggcctcccaaagtgctgagattacaggcgtgagccaccgcgcccagcatgagaatttgttcttttttagagaaacagaatttttcacaggaggctgagctgctccatctcccagagcccctacttgccataccccgggttaccagaaacaggagctctgccatttgatgaaaaaaatacttttttcagataaatgtttttgtcatatcatcacacaaagcgggtaaagttgtatatatatacatacaactttttacaaatatgtgatcatatgtacaaaggctagaaggaaatatacagaaaaatatgtattaaaatactggttttttttcattgttttataagatactctacaaaacattacaatgaggtaggactattttagtgctagagaatctcattaaatgaatttgttcaagagcttctttgtcagctgggtgcagtggctcacacctgtaaccccaacactttgggaggccaaggggggcagattgcttgagcctaggtgttcaagaccagcctgggcaacatagggagaccctgtctctaccaaaaaaaaaaaaaaaattagggtgggcgcggtggctcacacctataatcccagcactttgggaggctgaggcgagtggatcacctgatgtcaggagtgtaagaccagcctgggcaacatggcaaaaccccgtctgtactaaaaatacaaaatttatccaggcatggtggtgggtgcctgtaatcccagctacttgggaggctgaggcatgaggcagaggttgcagtgagccgagatcatgccattgcactacagcctgggcgacaagagcgaaactctgtctcaaaaaaaaaaaaaaaaaaaaattagccaggtggtggcacacacagctgtggccccagctactcaggaggctgaggcgggagaatcacttgagcacggggagttggaggtaatcgtaccgtgagtacagtgagccgttatcgtatggctgcattccaggctagacaacacagtgagaccttgtctcaaaagaaaataaataaataaataaataaataaataaataaataaataaataaagagcttctttgtcaatatccttttgtgggtatacatcatagtcccacagtacttcttcaacccagggagataaatgtgtattagtctgaagacccaggagagaatcttcaagacttggcactgtcactgatgatgatctgcttccttacattatgacaaatgtattcccagctccggcttgttctgcctcattaagagaatatttgaagacattattcatgatagcagcatcagcattttgcagaagaaaccctggggacagatgtctgcatgaagcacctttattctgtgaataaactggtattttttaatgaccatttcctgcaactggcaaaagtctccgttcagttctactccacagggttgcactgctaagctataagatcaccccataaagactgtgctgagcctggagctgacgtcagccacagcctttcctgattgatcagggagtgcatgaagataaatgaacttcaattccatgagggagaaggaacgagcaatcggtctaaaggttctgtttggtgtgaaccacccagtagtttctgctcattttccctttgtcacataatgaatcaatgaagtctttatcacaaaggaatgcgtcagcgtgaatggtgggttctggctgctgctgtagtttttgaagggttagatgttctgaggaaagcatggtttctagaggcaagcaattctgaaggtcttctgcagtgggttttttttttttttaattttgagacaaggtccggctctgtcacccaggctggagtgcagtggctcgactgtggctcactgcaacctccaacttccaggttcaagcagtcctcccatctcagcctcccaagtagctgaaactacaggcacgcacccagctaattttttttttgagatggggtcttgctatgttgtccagtctggtctcaaactcctgagctcaagtgatccacccccttcagcctcctaaagtgctgagattacaggcataagccaccacacccaacctttctgctgtgtttttaaacacaatgtctttatttccttcagtgaattcatcaaaatctcgggcagtttgcatctgctggagcagtgccgggcggtcggcagagccacagtatagagcagttacaagatttcctgccttgccgagtgaaatctatgccttccaattttttttaattaattaatttttaaaaaattagattggtacaaaagtaattgcagtttttgccattactttcaatggcaaaaacagcggttacttttgaaccaacctaatattatagagacagggtttcaccatcttacctaggttggtctcgaactcctaagctcaagtgatccacccacctcggcctcccaaagcgtggtgattataggcatgagccaccatgcccgcccctccccaccaatatatttttaaaactagttgagtgtgggccaagagttgtgggatctgtgtcaccaccaatcccgcctctaagctgctgggtgggtaatatgggaaaacagtaattgtagcaggactccagtggcagaagccatgcggataaactacaaaaagcagaagggacactggggatgctgacatctccattggttgagattacccttaaggtattgagcaactgtggccaggtccaggaagggcaaaaaaaaaacaaaaaacaaaaaacaaaaaggcaacacaagacaagaagccatcgagtctcttggctacaaccagccagtacacaagaaacagttcactgcggccaggcgtggtggctcatgtccgtaatcccagcactttgggaggctgaggcgggaggatcacctgaggtcaggagttcaagaccagcgtggccaacatggctaaccctgtctctactaaaaatataaaaaattagccaggcatggtggtgggcacttgtaatcccaactactcgggaggctgaagcaggagaatcgcttcaacccaggaagcgaaggttgtaagctgatatcgcgccattgcactctagcctgtgcgacaagagcaaaactctttcttgaaaaaaacaaaaaacaaaaaaacaaaacagttcactggagatgatcagccataagtaagatccctagggaccccactgcccggccaaagggcctcccgcccttgagaacacaacagtgtgcatattgtaaacaagagggccattgggtactagagtgtcctaactgtccccagtgggtagggaaagaaacttccccgtcaatcagcccaccagatgctacagtttgctaatagtgaccagaagtgatgggacttggggactcctctatgatctgggaacccctagatcgggtaacaattgctgtgggagagactcacgggttttccgacactagagccaaatttttgcctgtctcctttctaccgtgttcttcctaaaatttaggaaagggcttctgctgtatgggagagataaattttagctaaaattgttagttggacggagacagagttggaactgtcttttaagtagtgaattttacctgacccatggctaaacctttaaaagttaaagctataggatcgttatttgtatctggtagtatgtacacgtccggttatatttggctatggtaccgaattggcttataaagaaatgagtactcataaactaagcaaataagaccaagtgcttttcaagttcacatgacagtaatcttttggtgaatggaactagtctaaaattgttggtttgatgggaatggtgtgccttctgaaatgtaacttaaaggttcttacttttttttttttttttttgagacggagtctcgctctgtcgcccaggctggagtgcagtggcgtgatctcggctcactgcaagctctgcctcccgggttcacgccattctccttcctcagcctcccgagtagctgggactacaggcgcctgccaccacgcccggctaattttttgtattttttttttttttttagtagagatggggtttcactgtgttagccaggatggtcttgatctcctgacctcgtgatctgcccacctcggcctcctaaagtgctgggattacaggcgtgagccacagcatccggccttaaaggttcttacttttatgatagttgcctgacatccagctatataaaggtaattaacagataaataatttgaaatgatgactagctttgtctaatatatcagttctcataagtaatcctggtaaactgctaaaaataaataaagtatgtaaaggtaaatgggataagtatctatcggctttttaatgtaatttgaaatcctctattaggtaatggatactcattaactatgtgagttatttccaaataagacaaaaactggaacaaattgctgaccataaatatgtttgccctgggtctcttaaatttaatataaagactaaatatgtttgggcctataaatacgtataaaaattatgctataggaaaacatgtttttctaacaattacaaaatggctcttccccataaaataccaatatgtgataggaagttcaagattttgtgcttcctatgttttcaacaaaatttaagggaactggatgggcactgtggctcatgcctgtaattccagcactttgggaagctgaagcaggaggatcgtttgagatcaggaggttcagaccagcctgggcaacatagtgaaactctgtctctactgaaaaacaaaaaagaaaaaattagccaggggtggtggcacatgcctactgtagtcccagctactcaggaggctgaggtgggaggatcacttgagccagggaggtcaaggctccagtaagccaaaatcaatgccactgcactccagcctgggtgatggagcacgaccttgtttcaaaaaaagaaaaaagataattaaaaacaaaaatttaagagtactaagggtttttaaaaatcctaatatacaattctatataggaagtgtgccaaaagtaaggagcacttaataagaaaacagtaagaaaggtatacaatatattctttattgagaaaaaaagtaatttgtctaatttagctgttatttaaagggagttttaaaatatggatttaggaaagaaatagaaaaaagattaaaaggaaccagtaagtagatgagacagagatgtaaagaaaattacagatgtgaagcaatgagagtaattttgtataggaaagaaacttgtgtgttcaatctctgtcttggactaaaatgactagacatttaagaaagaggaagtacagggcaagtccaagcatgccacagctgtctgagtaagtcatgataaggcttgtgaatgggaacttatgatggaaatgttgggtgtgattaaattggctgtaattaaatgaaatgatttgtaatagttttttttttttttgagatggagtctggctgtcttgctcatttgccaaggctggagtgcagtggttcgatcttgccacactgcaacttgcatctcctgggttcaagtgagtctcctgcctcagcctcctgagtagctgggattacaggcgtgcactaccatgcctggctaattttcgtatattcagtagagatggggtttcaccatgttggccaggctggtcttgaactcctgacttcaggtgatcctggcctcccaacgtgctgggattacaggcatgagccaccatgcctggcctgtaacagtttttctagagaatgaatttgaatgttaaaacacatgatacataacttacaattttggtcccctgtgttaaaacaacagtggtttcggctgagcgcagtggctcatgcctgtaatccaggcactttgggaggccgaggcaggtggatcatgaggtcaggagatttgagaccaacctggctaacatggtgaaaccccgtctctactaaaaatacaaaatattacccaggcttgggggcgtgcacctgcagtcccagctactcaggaggctgaggcaggagaatggcgtgaacccaggagacggagcttgcagtgagccgagatcacaccactgcacttcagcttgggtgacagaacgagactccgtcttaaaaacaaacaaacaaaaaacagcagtttcttaagacattaattcactcttagtaaagttccaagaggttttgatatttatttctaaaacctgcttcgttaatagccattctctgaattacaaattagtttctgtttctgtcatattccttcttaagatcagtctaatttctttggtttcaggtttatctcaaaggtctagaaaagcagctttacgccagtataaactgattctgtgttcttggtttttcttaatgtgtctgagttgtttcatgtaaccaggacttcccatggtattactaatgtattcccctgctcaccagcctaggaaacacagattgcttagggagactgagctttaaagtgttaaggtttttccatgcatgtaacttttcgtgttgcttttgaattcttttgattgtcactgtggttaaacgagtaactattattcggcagtgatctctgattctgttgaaggaagccatttgaactttttgacatcctctttggcagaattccccaggatccaaatcctaaattaagccatctggcctaaaatcaactttgagattctaccaaaagggcctcctggaacaagcctcaaaggttttgtctctgatcttttggagatattaaatgatcaggcttacttggtaaataatatgggaagcattgtcaaatagaaacggtgtttaacttcctttaagtaatgtttgtgtaagtgtgtcactaacacaggggaaaaggtttgagattcctaaaactctgatatgccaagatatgtgtcatgactgtgatggttgtgtcacatggttgtatgccagagaaatgctgaaatttctggccgggcacggtggctcacatctgtaatcccagcactttgggaggccgaggcgggtggatcacgaggttaggagattgagaccatcctggctaacatggtgaaaccctgtctttactaaaaatataaaaaattagccgggcatggtggtgggcacctgtagtcccagctactcggtaggctgagacaggagaatggtgtgaacctgggaggcggagcttgcagtgagctgagaatgcgccactgcactccagcctgggtgacagagtgagactccgtctcaaaaagaaaaaggaaaaaaaaagaaatgctgaaatttcctgtcaattgtaaattgtcatcagatctctgactggctgctctgggcttttgtcacccacagttaattcttatttttcagtcagggtctcactctattgcccaggctggagtacagtggcgtgatcacagctcacttcagccttaacctcccaggctcaagtgatcctcccacctcagcttcctgagtagctgggactacaggggtgctccactgtgcccagctaattgtctttatttttttataaggacaaggtctcatgtttcccaggctggtctcaaactcctgagctcaagtgattctcccgtcttggcttcccaaaatgctgggattataggcgtgagccaccatgccctgccacccacagttgttttaaattcttctctggaagcattcacaattggctatggtccaaaattgctaattaagattgagcaaaactggccaggtgcagtggctcacgcttgttgtagggtccagccctacaggatatgtgggttttttctcttcatgtgtggagatgagagatggtagaaataaatacacaagacaaagagatagaagaaaacacagctgggcccaggggaccactaccaccaaggtgtggagaccggtagtggccccaaatgcctgaccgcactgttatttattggatacaaggtaaaaggggcagggtaaggagtgtgagtcatctccaatgattgataaagtcacgcgagtgaagtgtccaccagacagggggcctttccctttaggtagccaaggcggagagacagaggacagcttacatcattatttcttctatgctcttctcagaaagatcaaagactttaatactttcactaatactgctactgctatctagaaggcagagccaggtgtacggagcataacatgaatgtgaaacaggagcgtgaccgctgaagcacagcatcacagggagacaggccaccagatggctgtaggtgggcctgactgatgtcaggccttccacaagaggtggtggagcagagtcttctctaactcccccaggaaaagggagactccctttcccagtctgctaagtaacgggtgccttccccaggcactgatgctacgcctagaccaaggtccgctaggtaatggatgccttcccaggtgctggtgttaccactagaccagggagccctctagtggccctgtccaggcgtaacagagggctcacactcatctggtcacttctcaccgtgccccttcagctcctatctctgtatggcctggtttttcctgggttataattatagaacaaagattattataatattggaataaagagtgatgctacaaactaatgattaatgatactcatatacaatcatatctataatctatttctagtataactattcttattctatatattttctttattatactgggacagcttgtgccctcagtctcttgccttggcacctgggtggcttgtcgcccacacctgtaatctcagcacttggggaggccaaggtggatggatcacttgaggccaggagtttgagaacagcctggccaacaaggtgaaaccctgcctctactaaaaatacaaaaaaattagcctggtgtggtggcgggcaactgtaatcccagctactcaggaggctgaggcaggagaatcgcttgaacatgggaggtggaggttgcagtgacccaagattgcaccactgccctccagcctgggtgatggagcgagactctgtcttaaaaataaataaataaaaagattgagcaaaacaaaaataattacatgaaattaagtaattgatatgaataatgtttttatgacttaaatgtgagactatcacctcattttgttttgcagattcaaggaaattttctgtcataacctgcctatagtttgtgaggactaaactctgattttttttgttcttattttgctcaaattcctccctaaggggcctggggagtcacaccctacaaaccataaagtctcatcagagaggctttaattttaaccctatagcgtggtctgctttctgacctgactctggcataacctcacataacaaataagagaagaaatcaaaatattttaaccccaaatatatttgcttgccatatcttgaaactgccctgcaaagttgtctcctgtggaaaaaatctacattctgtagagaatcccattttcccttttttctaacttctttccagatccaggagataatcaactaagaaccaggcacccttttatgttagataagaaacacttcaggccagtgcagtggctcacacctgtaatcccagctctttgggtggccgaggcatgtggatcacttgaggtcaggagttcaagaccagactggccaacgtgatgaaaccctgtctctacaaaaatacaaaaatttgccaggcgtggtggtgcacgcctgtaatcccagctgctcaggaggctgaggcaggagaatcacttgaacgcaggagggagaggttgcagtgagctgagatcactccactgcactccagcctgggcaacacagcaagaccccatctcaaaaaaaaaaaaaaaaaagaaaaagaaagattttacagcctactatctgagagcttcctctgcacaataaaacttggtctccacaatcctttatcttaacatgaacatttcctttgtgttgatcccaggtcttcagataaactcaaccaattgtcaaccaggaaaattttaaatgtacctatagcctggaagcccctgctttgagttgtcccatctttctggaccaaaccaacatatatcttgcacgtattgattgatgcgtcacgtctccctaaaatgtataaatccaagctgtgacctgacagtcttgggtacatgttctcaggatctcctaagggctgtgtcacgggccgtggtcattcatctttggctcagaataagtctcttaaatattgtacagagtttgactcttttgatcgacatttgcaataactcgatcaagggtcctttgtgaacaaaggtggaacttattcattttttctccctacttgattcctacaaaattcagaaactattcatgaacattcttatttatatatagtaaaacaaacaaacaaaaacaaacaaacaaaaaccctgctctcagggctgggcacagtggctcacgcctgtaatcccagcactttcagaggccaaggtgggaggatcacctgaagtcagaatttcaagaccagcctggccaacatggtgaaacctcatctctactaaaatagaacaaattagctgggcatggtggcgggcacctgtaatcccagctactagggagactgaggcaggagaatcacttgaacccgggaggcagaggttgcagtgagccgagattgtgcctctgtacttcagcctgggctacagagggagatgccacctcaaaaaataaaaaaacaaaaaacaaaaacgaaaaacaaaccctggtccctgtaagcaggacacaattagaaacatcgattgtattactaaggtttggactgaaataccatttttaagaaatgtgggctgggaatggtggctcacgcctgtaatcccagcattctgggaggccgaggtagactgcttgaccccaggagttcaagagcagcctgggcaacatagttctaaatctgagatttccttcatgatcaaagatgggtgggaaccccattctgcaagataagtgtcaacctcagaaagataggctctccagaacagatgaatttatttgggaggagcagaggattcctatctgggctatgagtgcttggaaggatcccaggcatacacagagggccacagccaaggggaagcttttaaaggacagaagtccatgtaagcagcttttaaacaaggtttgtaagtcacaagctgatcgcaggagttggcgatggttttctggtggagacggccgtggtaggtaagcatctgcagctcatctggaatactacagtcttgaggacgtgctttccatacgccctgtgtctggtctacatgcaggcgtgtcttgtgataaatcctgttacgggcatgtgtgtgtgagggcttctatgtggccccccgactccattttattagagtttggcataagtgactccattttggttccagcaactttcacataaggaaactgaggctcagagaagtcaagggacttgcccccaggtcccactaacactgtgcagtggagtgatgcaaaccccagttttcccagtggatggagctgctgtgggtgagtgcagggtgcggtgtgaaccagaggggtggtgcagagaccagtgtgggatgtgagaggatccctgggggaggcagtgctggtgcagttgggatggggcagagatggaagtgcgcgtgtgcctagaggggagagcaaaggcctggagggctccacgctctcaaccgttcagggctgatgcccctaagaaggcagggcactgtattttccagggtgacactgcccctgtgactgggtctggccaaccctgaccgagagggcaaagggctggaattggggagggtggggtgagtgaggacacctggcatgttctgcggcctcttggcctctctcgagcagcgtcccccagatagaagcaagaccttgctttgcagccctggcaggcaggatgcagtcatgtgacagctccagcaacctgaggctgggggaacctgcggtctggaggaacaatgtgagttgggagcataagcccctcatggctagactcaggtttctctgtgtgacccgttggaggcgggtgggacgctcacaggagggtgcagctctgggagcccatgccccagcgtaacagctgctggttccagtcggtatagggtgggtagtggatctcctttaatttctccaggccggagggggcgagcaggcaggtgcggtggtgggagaaggtgtcgaaggtgaacttgccgtggtaccggcccatcccactgtggcctgtgtgggcacagagaacaagggcctgagaccaggcagcccatggagccccagcagcagcccactgccccggccagggcacacagctggcagggagctcagagagagccaggccactcacagagccattttacagatagggaaactgaggccttgagaggcccagggtgtggatcaaggttgaacagtgagtgaagggacttcctgggtctggggtaccaaagccaagcttccctaggggtggaaatgggcagggacccaccgactcccccgaatggcacggacagcagagatatgtaggtgaagccctcattgcctccaaagctgccgctgctggtccgctccagcatctggttcacaacctgccagggagtgagaaggtgggtgttgggctctagtcatgagaagagggcttgagccccgcacattccacagcggaggtgagcctcatcctcacctgcccctccaccctctaacgggcaataatctccgctctaagcatcttctggggacagcaccctctcagtgacggtcggggtgccatgggggtgattaccaccatggcgcaaagaccaggaagccctgcaggatcatggggagccggcagccttgagtcgcgacggtgaggttaggatgctgcagtgtggtatgcgggccccaccgcgacccgctgggctctatcaggcccctgctctgctctgtccctgacctccattccgggcctctgcttgcctgtgcagaacctttgcacagtccaagtgcaggctgctctggccaggacagaggatggacccgctaagtgtctggtgggtttggaccctgtcctctctgccaggcatccttgcgccggatgcagtggtaccaggtggcctagatatagtcacccttgaggcatctgctgctctaaagccttgctgggaagggctgtgaaaggaaaggtgccagtctgtgcccctttcagcccctccattgcccccaacccggccgcacccccacctggctgctgttggagaaggcgtacagggccaggggcttctcctgccggttgatgaacttgatggcctcgtccacgctctgcacgttcacgatgggcaggatgggcccgaagatctcctcctgcatcacaggctccgtctcctgcacgtccaccagcaccgtgggggctgcgggcaccagagacggctcagccctggggccacagtcaggactgcccccaggggtagggtagaggtggggacaggggcatgggccagggctccaggccaggatcccaaggtctgacttcccagcgcttcaggctttggagtgtttagggaagaaagtttccccacagccccccagaagggaccctagggcttccccagcctgctcagggcctgtggggcgcagagaatcccccgaccttggtctcacagtcaggggtgatgggatcttagaaccttggagttcatgaggcagcagcgtcccagaatgttggagctgcagtgtcccatgagctgctgagtcatacggcccaggagactgggggctcaggatggggccgtcagagtttagaacctggggatcatgggctcggagaatcagaggttacggcctttcaggacagccggtggtgggatgggaattcaccttagcacgctgggccctggagccctggaatctgagctcagtgaatccagggctgagggaccagagtatggcctcatggggccacaggctcagaagcacagagacggaatcgtggcaccagagccatggctcaaggccgggctctgatagtggggccgggtttcaggtgcgagtccagactcgtggcccagccgtgggccctccattgagaaagggtcttggcccaggtgggctgcggtagggcagcaggactcaccgatgtagcgatcgctctcgttgctctggcccccaatggccacgcggctgcagcccagcaatgcccgcagccgctggaactgtttctggttgatgatgtggcccaggtttggggagctctgggggtcgtcgccatagaaacgggtgatggtgctctgcagggcgggcagcagcctctcctgcatctcggggctgcacaggacgtagtcaggggccacgcaggtctggccggcattgaagtagcagaaccaggccacgcggttggccacggtctgggggtcgcagttgtcgtccacgtagcaggggttcttgccccccagctccagggtgacaggcgtcaggtgcttggtggcagcagtcatgacaatcttgcccacacgagggctccctgggcgtggaaggaaaccagagtggccagtcagtgacctggaccaggcaggatggcccagcccagagcctgctcctccctggagaggtgttggagtcggcgggcttcctagggacatggtgaggagaccccatcctcaactggccttgaccacacactccaggcacctgactcttgcccgctttcttcatagaaagtcctggcccgcctcacccttctcctggccggtctggctcacccactgggacctgcctccagcctggccactcctggatccagttgctgcaatgtgcccagggcgtggcctatgcaggcagacggactctgtgccagctccagctccccacgtgcccccactgctggccccagcctcctccctccacaaccctcccaccctctctcctgatgatcccctccacctactctgggaccctggcctggccccctcacctgtgaagaagatgtagtccaacttgtgctctagcagctgccctgtctcctggggtccgcccagcaccacggcaaagcagctctgcaaggtggaatgagaggctcggggcgggctcggggccagccgggcctcctcagcccacaggggtgatatatggggacgtcgggcactgctggggcagggccaccctcacctggtccaggtactggggcagcacctcagccaggaccttctctgtgccctggctgatttctgacggcttcagcaccacgcaactccctgcaggggcagatggggacgtcgttgggggagcccagggtccccatgcccaaccaggggctgggctcagagggcatgtgaggcccagggtacctcagagcaagattccaggggcctctttgggaggggctactgggcggggagagcatggggttcggaacgccctcctcacctgcggcgagggcgcccaccaggagcaccagggtcaggttcagtgggtagttccagggtgcgatgatgaggaccaggccaaagggttccttccagatgaagaccgagtccagcttcatgaactgaggcacagggtagacagtgaggccctgccaagggccaccccaaagcccacccactgcacacttggggcctcagctccctgtgcgatggaatcccaggagagacgagaaaatcagtgactcgcccggggcctcaggggcagaagggggcctgggccagagctacccggtgccctgccctgccctcctgccgcctgccagcagggctcaccaggttcgtggaccgtggttcatccttcatccaggcctgcaggttcttgagagcgtagtcaacctcgttctggcaaaggatgagctcagatatgtctgcctcgaaagctggctgtggtggaggtggaattcagagtggtcaggcccagacctgggccaggaggggtctagaatttgaggagggcacacgcaggcaccaccaccactggacatataaatacagctcctatgggaggcactgccgtcccctgggaactgcgcatggctgcaattctgatctgtgacttcctggctgtgtggccttgggcaagcgatgttaacccctgagtgcctcagtttcctcatctgcaacatggggacagccatggagcctgcatcacagggtggctgtgagtgttcaggagtgaaggtcaggtgcctgccacactccacatgccagggagggggtctgttaaacaaacaggaataaaactagggacatagccagtcactagggggcacgggccctcctgaaagaggacagggacgctgctccagcccctgccggggcccactctccacggcccaccttatgcaggtcctgggccagcacgtcgcgcagaagctgcttgttttcttgaaggaagtggcccaggccctggagctgcgcagcccggaactcggccggccgcgtgcgccctcagttgaaggcctcacgcagccgccgcagcgtgtcctcgaaggggtccatcctgccggatggggtggcttgaactgggtggccagggctgcccctccttcacgggcaccctccagccaccccagggtctgcacacccttgccccacctgcacccatgggggctcacagacaccccacctcatacacacacagacccactcgaatgaccccacggggctggggctgcctgcaccacccccaactcacctgcctcccaggtgtgcccatgagggagggccctgggcttgacctcccctactccagggaggggatccccctcctggacgcccaccctggaagcccaacacacacacctcgggtgaccctgctgcccaccatcccagctcttccctgcacctcccctccttgcgcagacacacacccacccacgctggcaccttgccacccctacacccagaccactcagatggaacagagctctcccctgggcctccctcccttctgggactaaacgagggactcggagggttctttgcttcagagatcacagagctttgaggtcgcagatggggaaactgaagccataggcatgccctagccctgaggagggtttggcacctgctctggggagggggtggcactctgctggtcgtagaaggaagcagaagcagaggagagagctccggggctggtatgggtgggcacaggtgcaggtgggggtaggttggcagagctgagactgccccagggcatgaacccctctgggctttagcctgagggcccaagggaaccccagtggggtctggagaggaggaaggatcaggaccctgggggtgggggaaggggctcagggggacactcaagaggattgccaggcacctagcaacgggattctgagcatcccagcccaggggctcaagaatggtgcgcaaatcctgtgtctttgtgtatccgtgtgtctgtgtgtgtctttgtgtatccgtgtgtctgtgtgtttctttgtgtctgtgtgtctttgtatagctttgtgtctttgtgtgtctatgtgtgtgtgtgtgtatggctgtctgtctttgtgtgtgtatgggtgtctgtgtgtgtctgtgtatgtatgggtactgtgtgtctttgtgtgtatgggtgtctgtgtgtgtctgtgtatgtatgggtgctgtgtgtctttgtgtgtatgggtgtctgtgtgtgtctgtgtatgtatgggtgctgtgtgtctttgtgtgtatgggtgtctgtgtgtgtctgtgtatgtatgggtgctgtgtgtctttgtgtgtatgggtgtctgtgtgtgtatgggtgctgtgtgtctgtatgtgtatgggagtctgtgtgtatgggtgtgtgtatgtgtgtatgggtgtctgtgtctctttgtgtgtatgggtgtctgtgtgtgtatgtgtatatgggtgtctgtgtctctttgtgtgtatggatgtctgtgtctctgcgtgtatgggtgtctgtgtgtcttcgtgtgtccgtgtgtctttgtgtgtctgtgtgtctttgtgtgggtgtctgtgtttctttgtgtgtctgtgtgtctttgtgttctgtgcatcttcatgtgtatggctatgtgtgtgtctgtgtctttgtgtgcctttctgtgtatgggtgtctgtgtgtgtgtgtctgtgtgtgtatggatgtctgtgtgtgtgtatgggtgtttgtgtatggatgtctgtgtgtctgtgtctgtatgggtgtctgtgtatgtatcagtgtctgtgtgtctatgggtgtctgtgtgtctgtgtgtgtatgggtgctgtgtccatgtgtgtctgtgtatgggtgctgtatgtgtgtgggtgtgtgtgtccatgtgtgtctgtgtgtgtatggatgtctgtgtgtgtatgggtgtttgtgtatggatgtctgtgtgtctgcgtgtgtatgggtgtctgtgtatgtatcagtgcctgtgtgtctatgggtgtctgtgtgtctgtgtgtctgtgtgtgtatgggtgctgtgtccatgtgtatctgtgtatgggtgttatatgtgtatgggtgtgtgtgtccatgtgtgtctatgtgtgtatgggtgtgtctgtatgtgtatgggtgtctgtgtgtgtatgggtgtctgtgtgcgtatgggtgtctgtgtgtgtatgggtgtctgtgtccacgtgtgtctgtgtgtgtatgggtgtctgtgtgtgtatgggtgtgtgtgtccacgtgtgtctgtgtgtgtatgggtgtctgtgtgtgtatgggtgtgtgtgtccacgtgtgtctgtgtgtgtatgggtgtctgcgtatgggtgtgtgtgtccacgtgtgtctgtgtgtgtatgggtgtctgcgtatgggtgtgtgtgtccacgtgtgtctgtgtgtgtatgggtgtctgtatgtgtatgggtgtgtgtgtccacgtgtgtctgtgtgtgtatgggtgtctgtgtgtgtatgggtgtctctatgtgtatgggtgtgtgtgtccacatgtgtctgtgtgtgtatgggtgtctgtgtgtgtatgggtgtctgtgtgtgtgtatgggtgtctgtgtgtgtatgggtgtctgtgtccacgtgtgtctgtgtgtgtatgggtgtctgtgtgtgtatgggtgtgtgtgtccacgtgtgtctgtgtgtgtatgggtgtctgtgtgtgtatgggtgtgtgtgtccacgtgtgtctgtgtgtgtatgggtgtctgtatgcgtatgggtgtgtgtgtccatgtgtgtctgtgtgtgtatgggtgtctgtgtccatgtgtgtcgtgtgtgtgtctgcgtgtggacttgagtaatctcagccctcagctgcaggtcacagggccgtgcccagggctgctgcctcagacccgcattgctgagggcagtgggggtgggtggtgagcagggccttggcatccccagtgagtgtcctggaggccagtggccccatctgcacttgcaccgcaccaggcattcttgtcatatgtgatgcagggacagtgctcgcccatggacagagccagctgaaccaatggcagaagtccgtgtcttgtgaatgacaagatgaggagagcagcccctgcccggctcaggtcccagctgaagaatgtgaggagacaggaagccatgctgggcaccttcctggccacacctgcagatgccgcctccctcccctgggcagcgtgatcacattcctggcacaggacccccacactcagtgtgcggcccccctgcatgagggcctggaggaggacgcagcatacagggctctgcaaatattcatctactgtctttgctcaagcccttgggctagaacctgggtggggcctgggcccttctctggtagcgggcggtattggcctggagcgcttccaggtcccaggttccagggccctgacccaaagctttgcctggcatgcgagcgtcagcagcctccacccggcgctcaagcagctcctggccacatcagctcagctctaacctcttccatggctccctggtgcctttggagggatgaccgcctccggcctgaatcaagacccggattggaggagtctgggatgagctatggcacacaggtgtcctgatgttcatcccaggaacctggcctcagcgtggtcacagctttcccaggtgaggcaggtggggcagaggaacccctgccctttctgggcagtcgtcgcctgtcctcacatgtgcacatctggtgctcggtgaaataatcacggagccagcagcatctgcctgacggatgaggaaacagatgggggctggagctggacccaagccctgcctctcatgcaaggtgctttcttgtctcgcccacctgctgcagggcaggggtccgggcgcttgctggggcagggctgactggtgtgaaaggaaaatatcttggacccccaaaatcagtaagctaaaaggaaaattcaagctggaaactgatcagggccaacctgcctcccccccctttttttttttttttggaacggagtttcgctcttgttgcccaggctggagtgcaatgctgcgatctcagctcaccgcaacctctgcctcccaggttcaagtaattcttctgcctcaacctcccgagtagctgggattacaggcatgcaccaccacgcccaaataattttgtatttttagtagagatggggtttctccatgttgaggctggtcttgaactcctgaccgcaggtgatccgcccaccttggcctcccaaagtgctgggattacaggcatgagccaccgtgcgggcccctgcctctcattttattcacagccacccctctgcccaccgagatagatgcacattctgattgcctcctttggaaaggctcatcagaaactcaaaagaatgcagtctctcacctacctgtgacctggaagctgccccaaccctcacccccaccccctgcttcaagctgtccctgcctttctggatggaaccgatgtacttcatatatatatatatatatatatatatatatatatatatatatatatgtatgtatgtattttgtgtgtgtgtgtgtgtgtgtgtgtgtgtgtgtatatatatatgtattttttttttttttttgagacagactttctctcttgttgcccaggccagagtgcagtggtgggatctcagctcactgcaatctccatctcccggattcaagcgattctcctgcctcagcctcccgaatagctgaatagctgggattataggtgcctgccaccatgcccggctaattttatatttgtagtagagacggggtttcaccatgttggtcaggctggtctcaaactcccgacctcaggtgatccctgccttggcctcccaaagtgctaggattacaggcgtgagccaccgtgcctggccttcttacatatattgattgctgtctcctgtctccctaaagtgtgtaaaccaagctgtgtcccgaccaccttgggcacatgctgtcaggacatccccaggctgtgtcacaggtgcacgtcctcaaccttggcaaaattaacttttttttttttttaagatggagtctcattctgtcacccaggctggagtgcaactggcatgatctcggctcactgcaacctctgcctcccaggttcaaatgattctcctgcctcagcctcccgagtagctggtattataggcatgcgcccccatgcccagctaatttttataatttttagtagggacaggatttcaccatgttggccaggctggtttcaaactcctgtcctcaagtgatgcacctgcctcagcctcctaaagtgctgggattacaggcatgagtcaccacgcctggccacaaaatgaactttctttctttcttttcttttcttttcttttctttttttttttttttgagacggagtctcactctgttgcccaggctggagtgcagtggtgcgatctcagctcactgcaaactccgcctcccgggttcacgtcattctcctgcctcagcctcccgagtagctgggactacaggtgcccgccaccacacccagcttattttttgtgtttttagtagagacggggtttcaccgtgctagccaggatggtctcgatctcctgacatcgtgatccgcccgcctcggcctcccaaagtgctgggattacaggcaaaataaactttataaattaactgagacccgtctcagattttctgggtttacactggggacctctggctgctcaccaggcagttcctgactggacctgggtcccataggtgaccaccccagacttggccagcccccatggagctcacagtctacacacggaacaatgacaccggaaacaatatcattacaaacatgatcggtgggccagggcttcttccagaggtggccagagacccacccctggctctgactgctgcggggaagccgtaggggagggcctcttggagggcaggtgatctggacagagggaccaacgtgtgcaaaagccctgtgggggcagatgctgagaaataagacacacaggaaggtggaggcctgatgggacctgtcatatggagaggggactcattcccttggcagtggccatgcctggtgcagggcccagaaagaagtcagagctggcatctggggccaggtagctggcatgcacatctcatctgagcctcacagctattattattacccagttggaaggacagggaaaccgaggctcccagagacgacttgatttgccctcctcacagcctcagtgcgaggagggaggccccccagcccctctcctcacaccagccttgtgacaccatgtgccaatgtgtgcctcgtgcctttcactgtcttctcaacatcttcctgcagcttccagactttctaaatgcgaatgtagtatttctagaaccagaaacaagcaatgcatgttgcttttaacatctgaaaccaaagatccgactttcgcttcaactgccaagaatctctctgcttccaatccccgattctccggcacctcctgatcacagccctggtgcccccgacccaatccttgtctgtccacagagctgccttctcctctaacctgggagctcctcaaagggaggacggggtctgtccccatccctggggctcctggggaacaggcttcatttctgtggctgcttcccaggagcctgccaaagggcaaagtgaggctcagaagacaccagcacccacctccctctcctgagcaagccccgtacccatggcccctgcagccataggccccttggtgggcttgccccctgacccacgggccatgggcacacatccccttccctccatgcccctggttcccaccagtgtcctttaccctgagctccctctgcccgcccctcacccctgtggccccacataacccagcgtgggctctgcccctgggtccttcgctgcacctccactccctttcttggacatgctgcctccagatgcgcaggctctgctcctacccccaggcctcagccctgctctgctgactgcgatcctcccaggagactggcagctcccaaaccaactcccgtgcccacgcctggcaatggggtaatcaatggggtgatgctcagtgttacccaacaggcgtggggcagggctgcacctcccaattcccatgcctacccttgtctcactgccaggacctatagctgctcggtgtctgccctgttcttccagggccctgcccccagggaccacactgcacagccggcttgggaacaggttagacaagtcaaggctgtctgaggctttgctctgtgtttcctggaatgggctagcagggagttacctgatcaggaaaaaagaaccccaggggaaggtcacaggatgaaaatatcagcaggatcctggtggcaaatgctgccttcgccaggaagtcctcccaggccccagccacagtggtcccatgccccccatggcccctcctagggtctctatgctaaatcttcatctccctcctctcctgtcctcactcttcaggcttcacaggtcaagatgagcaactgtggctctatttccactctcagtgtgcccagctggcatactcagggcagaggaaggggctcagatctttgcagagagacccttgatgggcgacggcacctgtagctctaggatggcgcattgttcattggtttatttatttactgtgcaaccgtgggtaggttacttaacgtctctgagcctttcggaagtaacaataacacctaattgccatggttcttgagagggtcacagagggagacgtgagaatggaaaaggcagatcacagctcctggcacaaaatcagtgcccctcaatgttgcccgctaatgtttccacaagtatttgctgagcaccttctaggttccagggagcagaatgagctcaggtcctgccactgtccttcatggatggcctgactctgtccccaccccaccttcccccaagcctgagaccaaggacacgccctgctgagggctgtagagagtctcttggcagagtgtgcagccctgtgggcaggagggacatctgagataacccttggttgtgactggagacagcccagcggaggccacagcctgagaccaagccctggccctggaatcttcggtagctaaagatgtaaatgccaatgtgacaccaggaagggacctcgggatggggaagggaatacagggcagaatgctaaggcccatctaagagcagcagatgggttatggccactggggaggcccactgcctccaaaccactgaattgtacactgtaaatgggtgagttgtatgggatgtgaatgctatctcaataagctgttttgttttgttttgttaaactgaactgacaagaagcctgaatagacgtaaataaattaaaatatgctcaacctcagtagcaattgttaaaatgtaaaataggtcgggtgcggtggctcatgcctgtaatcccagcactttgggaggccgaagctggtggatcacttgaggttaggagttccagaacagcctggccaacatggtgaaaccctgtctctactaaaaatacaaaaaattagccaggcgtggtggcatgtgcctgtaatcccagctactcgggaggctgaggcaggagaattgctggaacctaggaagcagaggttgcagtgagctgagagcacaccattgcactccagcctgggcaacaagagaaaaatgaaattatatcaggcatgttcttagaccacggtggaataaaactggaaatcaactccaaaaagaaccttcaaaaccatgcaaataactggaaattaaataacctgctcttgaatgagcattgggtcaaaaacaaaatcaagatggaaattaaaaaattcttcaaactgaatgacaacagtgacacaacctatcaaaacctctgggatacagctaaggctgtgctaagaggaaagttcatagccctaaatgcctacatcaaaaagtctgaaagagcacagacaatctaagatcacacctcaaggaacagaggaacgagaacaatccaaacccaaaccaagcagaagaaaggaaataaccaagattagagcagaactaaatgaaattgaaacagaaaaaatatacaaaaggtaaatgaaacaaaaacttgttctttgaaaagataaataaaattgatagatcatttgcaagattaaccaagaaaagaagagagaaaatcctaataaactcactgagaaatgaaacaggagatattacaactgacaccactgaaatataaaagagcattcaaggctatggtgaacacctttacacacataaactagaaaacctagaagcaatggttacattcctggaaaaatacaacccccctagtttaaatcaggaagaattagataccctgaacaggccaataacaagcagcgggatggaagtggtaattttaaaattaccaacaaaaaaaaagtccaggaccagaaggattcacagcagaattttaccagacagtcaaagaagaattggtaccaatccttttgacactattccacaagatagagaaagaaggagccctccctaattcattctatgaagccagcatcatcctaataccaaaaccgggaaaggacacaaccaaaaaaggaaatgacagactgatatccttgatgaacatagatgctaaaatccttaacaatatactagctaaccgaattcaacaccatatcaaaaagataatcctccatgatcaagtgggtttcataccagagatgcaggggtggtttaacgtaggagggtcaataaatgtgatgcatcacataaccagaattaaaaatgaaaatcacatgatcatctcaatagatgcagaaaaagcatttgacaaaatccagcatccttttatgattaaaaccctcagcaaaatcagtatacaagggacatatcttaatgtaataaaagccatctatgacaaaaccacagccaacataatactgaacgggaaaaagttgaaaggcttcccgcagagaaccggaacaagacaaggatgcccactctcaccactcctcttcaacatattactggcagtcctagccagagcaatcagatgagaaaaagaaataggggcatctgaatcgataaagaggaagtcaaactgtccctgtttgctgatgatataattgtttaccttgaaaaccctgaggactcctccagaaagatcctaaaactgataaaagaattcagcaaagtttctggatacaaaattaatgtacacaaatcagtagctcttctatccaccaacagcgaccaagcagagaatcaaatcaagaattcaatccctttgacgatagcaaaaaaacaaacaaaaaaacaaaacaaaacaactttagaatatacctaaaaaagaagtcgaaagacctctaaaggaaaactacaaaacactgctaaaagaaatcatagatgacacaaacaaatggaaacacatcccatgctcatggatgggtagaatcagtattgtgaagatggccatactgccaaaagcaatctacaaattcaacacaatctccatcaaaacaccaccatctttcttcacagagttagaaaaaacaattctaaacttcatatggaaccaaaaaagagcccgcacagcaaaagcaagactaagccaaaagaacaaatctggaggcatcatactacctacctgatttcaaactatactctaaggccatagtcaccaaaacagtgacatatcggtgtaaaactaggcacacagaccaatggaacagaatagagaacccagaaataaacccaaatacttacaggcagctgatcttcaacaaataaacaaaaacataaagtggggaaaggacacccttttcaacaaatggtcctgggataattggctagccacatgtaggagaatgcaactggatcctcatctctcaccttacacaaaaatcaactcaggatggattaaggacttaaacccaagagctgaaactatacaaattctaggagatgacattggaaaaacccttctagacattggcttaggcaaggatttcatgaccaaagaaactatgatatatatatacacacacacagtactgtgtatatatatactatggtacatatatatatatatacactatgatatatatatacacacacactatggtgtatatatacacactatggtgtctatatatatatatatacacgctatggcatatatatacatactatgatatatatacacgctatggtatatatatacatactatggtatatatatacactaatggtatatatatatatatgtttgaatactactcagctataaaaagaaatgaattaacagcatttgcaatgatctggatgagattggaggctattattctaagtgaagtaactcaggaatggaaagccaaacatcgtatgttttcactgatatgtgggagctaagctatgaggacgcaaagcataagaatgatacaatggactttggggacttggagggaagagtgggaagggggtgagggataaaagacaacaagtatggtgcagtgtatactgctcaggtgatggctgcaccaggatctcacaaatcaccactaaagaatttactcatgtaaccaaataccacctgtatcccaataacttatggaaaaaaaatcaggggccaggtgcagtggctcacatctgtaattccagcacttcgggaggctgaggtggacggatcacttgaggtcaggagttcaagaccagcctgaccaacatgatgaaaccccgtctctactaaaaatacaaaaaaaattagccatgcattgtggcgtgcacctgtaatcccagttacttgggaggctgaggcaggagaattacttaaatctgggaggtggaggttgcagtgagctgagatctcaccgtagcactccagcctgggtgaaagagcgagactccatctcaaaagaaaaaaaaaagaaaaaaaacaaagccaggcacagtggctcatgcctgtaatcccagcagtttgggaggtggaagtgggaagatcactaggtcaggagatcaagaccatcctagctaacacagtgaaaccctgtctctactaaaaatacaaaaaattagctgggcatggtagcaggcacctgtagtcccagctacttgggaagctgaggcaggagaatggcgtgaaaaaaaaaaaagtaagaacctttaagttacatttcagaaggcacaccattcccatcaaaccaaattaataagagcctatatgaccaatcaaatcttgctgcattttgtgcgaaaaaatcaggccaagtataataagcctaaaacttattttgcacataaattggtcttactataatttctctctggtacaaaaggagggctagaaagagaaattctttcaaaggaaaattataacacttattactagattccagccctgacttttgtttttgagtgcagattgaatcatgaattatctcttggctacaataagcctctaaagaaccagattagaggccaggcatggtgtctcatgcctgtaatcccagcactctgggaggccgaggtgggtgggtcacgaggtcaggagtttgagaccagcctgaccaacatgatgaaaccccatctctactaaagatacaaaaattagccgggcgtggtgatgcgcacctgtaatcccagctactcaggaggctgaggcaggagaatcacttgaaccagggaggtggagcttgcagtaagccgagattgcactaccacactccagcctgggtgacagagtgagactccatctcaagaaaaaagagtaccagattataatttttcttcatattttcagttggtgccctgatggaatagattcctttgtctgttctgacacacaaatactcttaattgtcaaattattatcattatgattgagacagagtatctatcacccaggctggagtgcagtggcaagatcttggctcactgccacctctgcctcctgggctcaagaaatcctccagcctcggcctcctgagtagctgggactacaggcacacaccaccaggctctgctaatttttgtatattttttagagacagggttttgccatgttgccaaggctggtctcaaactcctgggctcaagtgatccacctgcctcggcttcccaaagttctaggattacagatgtgagccaccgcacctggccaattgtcaaattgttaatgttatttatctctccttgttttacctccaaggaaagcagaatcatggcattctgaagactagagatgctaacctctctcatttggcaccccactgggcccaatttgctttttactgcaaatgccctgctgttgaaactatacaagcaccctccctctgggcccagggactgttgtggaagaggtgggcacgtgacattgtaagggcagggtttgagggatattgttagctcagatcctccaaatcaaggatgggtacacaaatgcctaaacagctgggcaaaggacaaagggacttttgacttctgagccaatgtgtggcactgtattagtctgttctcacactgctaataaagacatacctgagactgggtaatttataaaggaaagaggtttaattgactcacagtttagcatggctagggaggtctcaggaaacttacagttatggtggaaggggaagcaaccacatccttcttcacatggtggcaggaaggggaaaaatgagagctgagcagagggaagccccttatcaaaccatcagaacttgtgagaacttactcactatcacgagattagcatggggcaaactgcccccataattctattacctcccaccaggtcactcccaccacacatggggattatgggaaccacagttcaagatgagatttgggtggggacacagccaaaccatacaggcacttttttatccattcccaaccacaaagaattttctgcttcctgtagaattaaaagacaatttttacggagaggatacaaagatcctcctagacaaagcctcctgggcataatactcctagttaggagatttatgcagatagatatatatttttaaaagttttaccagccatcttagaacaaattactagaaggccacaaaaagcactgcagcaccacaaaagtatctaaattccttagcttaaaaggttatagtaatgcttatgttttgctataagttaattgctataagtctataactaaaaccaagattacagtagctcaacacatagaaattaaagatagataaagttattgcgggatctggccagcagcccgcaatgcaatggggctctctctttgttcccaggcagattggcaggtcgaaaaataataaacacacacaagatagtgaaagctgggtccgggggggtcactgccttctggtcctgcagtgccaacaatgcactggatataccagcatttattattaagtttagtgagggcgggggtaggttagtgcgggatttagggtcatttgattatgaggtgagatggtcacatggggatgaagtaattctttaacataacatctgtatgcagaagtacagtatacagggataagaatttataatatagcgtgtgcatcagtaatttctaacagagcctaaaaacagaaacacaggctttccataacctatgattagcaagatattaatcagcggtaacagttgcagcaaaagctggttacaaacaatctgtagaaacaggacgtgaagctagacaaccggttagaccagaaattctcagaagggagtgtgccttaaccctaaagaggcctagaagagccatggcaagatgagggcatttttagccctatcttatccatatggacaggggcccctcatgtgtccatttataggctctctacaagggtcgcattccattcccagagctatgaacatctgcttttctgggataggaatcttggtgatgtgaaacctccctgactgcatatccattcataggctctctgccgggggaagcacatcacgcgctgttggctcattctggcagtccaacctggcattgtctttacacaatcctgcatgcaactttgtgtttacaataatcaggagcatttcatcttttattctgtagcaatagtttcaaggggtctccttacataaagtcaattttataacctcacctttggcttttattttattttattttatttttttattttttaaaaccagaacatttattgcatgactaattgttgacattcttaagatgaactggatgctgcaacagctgccctcttgggtttaggtgttgttccttcacggaatccatgcctgaatctgtgttatacaatttttaggtgcctcattcgaccagttctggtggtttttcatcttttagccttggcactccagttatactttctcttgcgcttggcagagtagccacatttgccacaggtcgacttctgaaggtggtaggcctcagagccacagcagcggcacaacgtgtgtgtcttattgcgatgctttccaaacgatgatgctcccttcgtcatctcgcttctgcggccgagaccagaaagtggctttttgtttgtacacaaaaattttccaggcacggtggtgcacacctatggtcccaggtacttgggaggctgaagtgggaggatttcttgagcccgggaggcagaagttgcagtgagccgagatcatgccactgcactccagcctgggtggcagagtgagacctcgtctcaaaaaaccaaaccaaaacaaaaaaagttaatgaatgcctgttcacatccatctttcctagaacatttaaattggctataaatctttgactctatgtctcttggccatatgtagtcccaccaagggacaggatggacctggggcaggcagccttgctgccctggcaatgccagggaataaaataaaagttttggtggccattgatcttgcctctggcaaatcttggccagaaggggaagacaataaaccagaaataaaattctaaaacacccaaccatctaaattgacccctcctctcagccaagggcattctaaccttaacctgaaaaactatttcaggccaagatgggaagcaggggccagacatgcctcgttataccctcctcccttttggacttactgatagaacacactcttaagtctggtaagaaacattcacgatctattatctttcaagcctgctacctggaggattcatctgcatgataaaatcttggtctccacaacctcgctggagtgcagtggcatgaccttggctcactgcaagctccatctcccaggtccaagtgattctcttgcctcagtctcccaagtacctgggactacagccatgcaccaccacgcacagctcatttgctttttttctggaggcaaggtctcgctatgttacccaggctggttccaaactcttgagctcaagcgatcctcctgcctcagcctcccaaagtgctgggattacaggcatgagccactgtgcatggctttggtgcaattttttaaaaggccagatgtcaattcaggcactctgtttcttcctgtgttaaattttgtaagatatacacttccctgggaaatttaccaatgtgttctaagttttcaaatgtatttatagttatttacagaattcgctttccctttaaacattttgactgtagccattatgatgtcctagtatcaattagttattttggttttgtggttttttttttactatttttcatttttaaaaactgggtttacaaataaagattgaatatagtcaagatgtgccatgcaatgatttgatacatatacatggtgtatagttattttttttcctactcagcctcgtcagatgttggccaatattggtctcagcactgtgagaggcagaggcgggtgatcacctgaggtcaggagtttgagaccagcctggctaacatggtgaaaccgcatttctactaaaaaaaaaatacaaaaattagccgagcatggtggcggtgcctgtaatcccagctactcgggaggctgaggcaggagaatcacttgagcccaggaggtggaggttgcagtgagctgagactgagccactgcaatccagcctaggcaacagagcaagactttgtctctggaaaaaaaaaaaaaaaagaaccatctattttgttgatcttgtctcttatgctttgttctctatttcatatatttttgctctaattattcctttattttcttagatttactctgtagctttttaaaatcatcttattgtttacaattaattgtagttctttgatgttttctttcttttctttttttttttctgagacagaatctcactcttgtcactcaggctggagtgcagtggcacagtctcagttcactgcaacctcagcctcccagattcaagcgattctcctgccacagcctcccaagtagctgggattacaggtacctgccaccatggcaggataatttttgtattttccgtagaggcagggtttcatcatgttggccaggctggtctcgaattcctgacctcaggtgatctgcctgccttggcctcctgaagtgctggaattacaggcatgagcctgtaatttttctttttctttttctctctctcttttttttttttttttttttttgagacagtcttgctttgtcacccaggcgggagtgcagtggcatgatctcagctcactgcaacctccacctcccagattcaggcaattctctggtctcagcctcccaagtagctgggattacaggcacacagcaccatgcctggctaatttttttttttttgagacggagtttcactctatcacccaggctggaatgcagtggcacaatcttggctcactgcaacctccgcctcccaggttcaagtgattctcctgcctcagcctcccaagtagctgggattacagatgtgttccaccatgcccagctaatttttgtatttttagtagaggcgtgatttcaccatactgtagcgggattgataaggaatcagagagaccaacggggttgagaaggatatttattatttaggtgtactggcccagtcagattaatatccaaaggactgagccctgaacaaagagttaagttaccttttaaggtagatctgtgcagggggaagcatattacagaagtgagaaaaaaagacagttatttaattaattgagacatgcattatatcatttcttacttttcaaggaaaaacatgttttacaacttgagtttatctgtctagtgaccttgcagctgcacagctagagaaacggtcttcacaatgcctgggaaaggggaagagatgaggctccctagccacagaaaaacaggcagttaatttttaaaggactccagctctttctctttctcagggggaactgtgttttcttatatgtaactgagtttttgcttacacgttctttaatttcttttaattcctgtttcattttcccatctttggtgctttttataacaaaggtgttaatagaaagcaccactatttgccacctcttcgtggagctgagctgcttcttctactggcagtggctgatatttggttaatgccatcaactgcacggtagtgagtcaggttactattgcctctatagttgactgaatactcttaataagcagcggtaaaaggcaagagaggatgaggcagatgccaagaataagtaagaacccaccaatgagggttttgaattttccaaaagttgagaaccatcctccaaacaaggaatccggggaccacccggaccatgtctgaacttgaacatgggccagcttgcgcatttcagctgtgatttccatgacagctcggccattattatcgatttctaggcaaaggttggttaaactaaattttccacatactcctccttctgagactaagaggtaacctaaagccaatctattttgatatatagcatttctcatttgtgttgcttgtattgctagtaaatctagtgcccttgacgtttcattggttataatttctttgtaatttctaggactgcctgcaaccttatgatgtggttgagcatatagatgggggtatgttaccccatgcgcccaggtagctggcccataatatttaatgattctttcaggaggccatttattatctttcctgttttctaatactggtcaggctagtctcgaactgattttcttatataaatatttagagagatatattttcctctaggcatcatatcactccactccacaagtttttgatattttcattattgtttaatattaacatttgctaatttcctttataatttcttagttaatctatacattatgtagcagcatattttttgcctttcaaatgtatggctgctgatattgttttattatccattttaacttgattaccttatagtcaaagaatctcatatatatagccagattcttgaaatttcctttttttattttttatcttttttgagacagagtctcactctctcgcccaggctggagtgcagtggcatgatctcaggtcacttcaacctctgcctcccgggttcaagtgattctcctgcctcagcctcccgagtagctagaactacaggcacgtgccaccacgtctggctaagttttgtatttttagtagagatggggtttcaccatgttggccaggctggtctcaaactcctgatctcaggtgatccacgtgactcagcctctcaatgtgcagggattataggcataagccactgtgcctggcctgaaatttcttaagacttgctttggtgcatggtatgtgatcaattttatgactgtttcatgtgtgctcaaaagcacatgcctccttctgccacatatatatatatatatatatatatatatatatatatatatatatatgtatgtatgtatttccattagctcaattttgctaattctgttgttcaaatcttttatcatattactattttgccagtttgacctatttgtttctgaaggaagcgtggattgggcaaattttcctcctaattctgtccatgttttatttctatattttgaggacatgctgttaggtagtgctatagactgaatgtttttatctcctttaaattcccatgttgcaaccctaacccccaatatgatggtattaagaggttggaccttagggaggtaatcaggttgagatgaggtcctgaaggtggggtcccggatggagttttcttccttataagaaaaggaagagaccaggtgcggtggctcacacctgtaatcccagcactttgggaggccaaggcgggcagatcacctgaggtcgggtgtttgagaccagcttggccaacatagtgaaaccctatctctactaaaaatacaaaaattagccaggcatggtggtgggtgcctgtaatcctagctacttgggaggctgaggcaggagaatcccttgaacccaggaggtagaggttgctgtgagccgagatcgggcccctgcactccagcctgggcaacagagtgagactctgtctcagaaaaaaaaaaaaaaaaaaaagaaagaaaaggaagagacaccagatatctctctgtctctctctctctctctcactcactctctctctctctctctgtaccatataaggagacagcaagaaggcagcctttggaaagccaggaggagggccctcaccaggaaccaaatcagtcagcaccttgatcttggacttcccagccttcagactatgaaaaataaatttctgtttaagccacctagtctgtagtattttagtacagcagcctgaactgactaatacagtatttgtgagggctctgattttttctaagtgttggcaaggatgtggagcaattggaatcctcagacgctgctggtggagatggggaatcgtgtgcctgctatggaaaacagcgcggtggctcctcaaaagttaaacattgaattgccatgtgacctagcaattgtgttcccaggtatatacccaaaagaattgaaaataagcattcaaacaaatacttgtacacaaatgtttacagcagtgccattcacaatggcccaaatgtgaaaacaatccaagggtccatcacagataaacaaaatgtggcccatccagacaacgcaatattagccataaaaacaaatggaggtggagcacggtggctcacacctgtaatcccagcactttgagaggccaaggcaggtggatcacctgaggtcaggagtttgagaccagcctgaccaacatggtgaaaccctgtctctactaaaaatacaaaaattagccgggtgtggtggcacatgcctatagttccagctacttgggaggctgaggcaggagaatcacttgaacctgggaggcagaggttgcagggagctgagatcacaccactgcactccagtctgggtgacagagcgagactccatctcaaaacaaaacaaaacaaatggagtttgactgtgaacccaaaactgctctgaaaaacgaagtctatgtttgaaaaaaggatgaagtatggacacatgctgcaacctggcttaacctggagaacactgtgctaagtgaaagaagccaggcacatactgtacggtcctatttgtatgaaatggccagcatgggcaaatccccggaggtagaaagcagattggcagttgccaggggatggaggtgtggggaatggggagtgattgcttatgggcacacagtgttctagagtgttggagtgttggagtgttgaaaaagcccccaagggccatccagcctccatcttctgacaccacttttgcttcgtggctctcaagacaaggggaaaatttagtgtttcttagaaacttaacaggatgcggtaaggtcaggcacttccaagagctgacccatcagtcagcccttactcatccccaagcagaggtatagtggtattgtggagggcctttgctggacactctgccaaataattggaccttacttgtactctagttgaactggctatcccttttaccctggcaattcatcaaccagaaaaacaacaacaacaacaaaaaacacgacatcgtaaaacaagagaagccagtcttgggtcctttgacccccatgtttatttagatggaactagcattccacaaggtataccaaataaattcaaagctagagatcaaatagccacggggttcaaatccctcctcccacaaataacaataaaaacatagggacatcagcagaagaatgtaagtagggtaatctatacattttataaggggacaatccaacatctttcctaggggcagttttaatttttaataaagcaataggaagacgtttagttcatggcaagcaagtcattaggactgatttagttacatgatttttaagagtttgatttatcctttttactcctcccgaagaggatggatgccaaggaatgtgatattcccactttatgtctagtacttagggcagtactagataataacacgtgcagtaaaatgggtttcattgtgtgaattaatattttttattaagctaaacctaggtacaatatgtttaattaaggctttgactgcattactggcagttacacttgaaaaaacaatggcttttacccagtgggtaaaatgatctactattactaataaatattttaggccaccaattgggggcattttactatagttaattggaacactttgaaatggccatcgtcctggattttttcctctaaggggtaactttttttaaggcttgtttatttgtgttttttttttttttttttttttttgcaaattaaataactgtaacttgtttggctaaagtataaactttaatgcatccataaacagaactgcatcacacatagcttggggatcctaattacttccctgatgtagttgggacaaaatttctcttataagatgcttggataacatttctctttgatctggaagtatccatcttccttttgaattttttttgagctctaatcttttctaactttttcgtcttgagagaaaataggaactacaataggagaagggagacaaggggttaaatgaaaaatgcacgtctcagaaacagcagcctgctttgctatttggtctgcaagattgtttcctcgacttttaaaagaaaagttaggttggtgtcctggaacatggacaatggctatttcttcaggtaactgaagattattaaaaacatgaacaattagtgtttcacgaggaagttctttacctttactgttaattagtccttgcttagccccaattttcccaaatgtatgagataccccaaaggcatatttagagtcagtatagatggtttttacctggttctgtaaatattttagggcgtgactgtgaataactcgcaaggttgggcagactaactatttgataatcttcctgattttacttcttttaagatcttcctataattatagcatatccattatgtcatgtcccttcaattacccgggaggagacatctataaatagatgtcgctctgttttaaaaggggtctctactaaatctggcctaacttttgtatgatagtcaattaaatctaaccacaaatgttctttttttgagcagtaggtttcctgttaagaagcttgctggatttcaggaattatctgttaaatcatctttttttttaatagaatagcctcatattttaagattctagaatcagtaagccatctcccagctttttggtttaggatcaccttaacttggtgaggggtgctcactgttaggtacccttcaaaagttaatttcttactttcttcaactagtattgctgtggctgctagagactgaatacacggaggccatctactggcaactggatctaatgcttttgatagaaaggctactggttgttgaccgcctccatgttctttagtgaccaccctactctattgtctacattcacaaaaagatgacatgattttctgaagagggtaaggctaggatgggagcagtgatgagtctttcttttaatttctccacttgattaacttctttagaagtccatataaggggatgcgtttcctctttagttaatttcttatataagagcttactttttaatgcatatgagtccatccataaacgacagtacccaactaatcccaggaattttttaagttcttgtttggttcggggcaagggtagagacatgattttctcaattttggggggtcttatttttcttttatctgcacttattaaatggcctagatatttaactttaggttctacatattgaagcttttcttttgaaacccataaccctttatcttgtaggtggttaagaacttttgtagaaagtccagctaccttttctatctcttccttagatgtaagaatattatctacatattgaagaaagcataactgttttgggacaataattttttttaaatacttgacaaaaaagattgggaaaatctgtaaatccttggggtaaaaactgtccacctgtattgttgcttttgcctaaataggggtcctcccactcaaaggcaaatatattttggctgtctttagccaaaggacatgcctaaaatgtatcttttaagtctattactgtgaaccactgatgactatatggaattttactaagaatagtgtaggggttaggcccaacaggatgagtggtttgaactatttgattgatagctctaagattttgcactaattggtatgattcatctgatttttttgactggtaacattggagtattgtatggagacatagaaggttcaatagcccatctttaataagtcttttgattacaggctttaaccctattcttccttctaaaggaatagggtattgctttctttttactatttcccctggagtctttaactgaacatgtgttggaggaatctgtaaatttccctgattaccttcccttgaccagacagctggatgaatgtattttttatctgctatagctaacaaatttaaagaggttaggaaaccttttggactaacttgtaaacctatacctaactttaacgttaaatctctttctaacaaattggcttttgctttaggaattaataaaaattgtatataaactaatcaatttatatatttaacttctgtattttctaaaacttttgccttgaatccttcccctttaaccccagaaactgttaattcctttggggaacaaactaaatgagctgaaggaaaacagacaggtgaatgggcttctcctgagtcgactaaaaaggtgattaatttatgtctgggtcccacctctaaatttatcaagggctcttggtgggactcaaaatagaaaagtcagagcccctgacccccctattcttctttaaaagtggtcacaagtgggggagctttttctgccttttctaacttgggacattcccttttaaaacgacctggtctcccgcatctgtaacatctgtcttttccttcctccctaccaagcccaaagcttctttgcttctcctctttattttcacatccacagctcctatgacacttactttgacatttttttctaaaatactgacctggccgggcgcgatggctcacacctgtaatcccagcactttgggaggccgaggcgggcagatcacgaggtcaggagatccagaccgtcctggctaacacgtgaaaccccgtctctactaaaaatacaaaaaattagctgggtgtggtggcgtgggcctgtggtcccagctactcaggaggctgaggcaggagaatggcgtgaacctgggaggcggagctagccgagatcgcaccactgcactccagcctgggtgacagagtgagactccatctcaaaataaataaataaattaataaattaataaattagtttaaaaaaataaatactgaccttgccttctttttttgttttgcatttttgaattcctaaactttttccttttgcctcccctagagaattttataggcccaggtctagatctggtctctggcatcgtctgccagagactagtgaattttgccaaaagatttttgctttttgcctttgtctttccttatttttttacatatagtttttgagcctttttaaataacttttttattgattttttaaattttctaatttttgtaactttttagtaatgtctggccaactgtgagtaacaaagtgcagttttaacattccttgcccaagagggctttctgggtctaagttagcattttttttatttgttcttttaatttatctatgaacctcataggtccttcatctttcttttgttggacattaaatgctttggaaaggttttggggtctgggtgctgacttttgaatccccctgattattattttttaaaaaattccttatattatttcggtgggcagcattattttatcccactgcgggtcctgagcagggaatttatgatttgctgccagaacattttgacctggaggatgtttacgttcccagatcgtatttctttttttccttgaaaaaataatacctaggatgcacactgattcagcccaagtatataactgtgggcctaaaaactgatcaatttgatctgccaccctgttaggattatttaacagtggctttagttctctttttatactccaaacttcagacccagtaaggggagcatccacaaaaccaatagcttctcctccttggggaactttccttaaaggaaagaatgttgaagttaacttttttggggggcaggaaaagggaaattctgaatatccttcttacattgttttaatttttgttggagtcttttctttaaagaaggatatttagaatttttaggctcctgggattcacaagaatctgggttatatgggggaggcctggagtggcaggggggcctggagtggcaggggggcctggagtggcagctgggtcagggatcaggtccagaaggggatctaggacagcagcagctacctggggaggtgtcagcaggttattaagaaacgggggaaggtggtctagagggtcctatctcttattagataaggccatttttgactgttttttattttctagtccccctttgatcgtttttaaaggataaagaataatataggcccttgccgctagcataaagcataatcaatttttcttgtgacacaggacttttgctataaacatatattattaaaagttgacagatttaatctttatctgacctaaattttgaccaaaaaaccgctggcttgagaattggctttttagtccaaataaagcaacaatacttaattatctgctgctttttttaaatttagtttttttattatctttccaatactttaacatgagccttaaaggactatcgggagggatttgataacttgcatctttttttgcccccgatttactagaaacctttcccatattgaatatcaggtagacttaacctcttaatcctagagatttcttgtctatcctgttttttcctggcttgcttatatttttaaccttaacgtgcttgaggtttcgttttccctgaggaggatttaactcctctttttctttctggaggctttttacactcttcactcgctttgtcctacctggccactttcctcacgggaatttaggcccctcttagcattggcgtgccggtataaaccccaaggcaagatccgccttaagccgtatgaggtagccacggaaccgcaggcaagactcactcgctcggtccagcagtaggacttatcatgatttacacaagcaacaccagctgcagtgaggcttgtgactattcacacacacttttaacctccagaatatcccgaccaccaagcaagtactttgtcgcacccttgcgacgtttctttactttgctctgtgaacagagtttatctggtccccgaggcagtgcaatgcaagcctattcgccgttttccacgttgctgagggtccgggtttattcatcacaacaggtaagtccggattcccagtccctgaggccaccgcagtaaggcagtggggcgcctccccttggtgggggggcgggaatcagagaccccgacccgaaggagactgggtgatcccagacgagcccccaagactgttagaaataaatccttattccccgatgtcacaaagaagaatcagcagacgaaaagcttcctcagcaaggtgatttttaccttctgcagaaagagtgctgcccgtccgcaatcctgccacgatcgcatacaaaataaaaaaggcactagaatatttatcccttacgcatgaggtccctattgccatgtcactggctggagccagaccttaccacctaaactaaaacccgattggctaacagtttaaacttttttaaataggtaaaggcagggaggaacgaaggaaaaaaaggaagttgcttaggaaaggacttagaaaagtaataatattcccaaataagggaggagtgtacgctgcaatctgggaaatgcctggacacgtccagcacgaatattttgactaaggtacaaggacgtagaatgtactacgtgcctgtgagcatgtttaacatagatattgaagtcagagtatgcttattctgttacatttgctacataaggcataacagagaggtattactataaaataagaaacttgaagaaagttagttctgagaaaagatatcaataacatttatgatttaaaggggaagctttgaagaggaacctttgctttctacagtcaaggtctcactaagttgcccaggctggtcttgatctgcccgctgtggcctcctaaagtctgggattgcaggcatgagccactgtgcctggcccttccttttggaagcccggtttgaatactgccctcttgtttttagctatttgttatggcagcaacccacctgcaatacaaaaatccagacaagttatctgctgcagtataacaaattaccccaaaactgagaggcttaaaacagttctcagttatgattccacggcttctccaggtcaggaatctggctgcagcttagctgggccctctggctcacagtccctcccaggctgcaacccaggcatcgtacttgatgtgggaattgctgtggaccagtgcctgcttcaggcttcccaccaaccccttcctggctttgaacagaaatagccacagcaggcatcttaggtgtcatagacagagagactctatttttgttgtttgatcaccgacagcttctatgtccccatccctccactttgccccatatctgggtggcccaatcagagagcccaagggtgccctctgtctcttggcatgagtgggaatttcaaaccacatcagccccaggctgcacctgggcacctccacccgggtcatccttctgcacggcagaaacctgaggccacttcttccctccccacacagcttattctgctccagaccaaccttgagccctcctgtgggaggaagggctgtttctcctcttgctgtttattatgtgagtgataaatttgatgtcatgtccattggtgccaatgtctttcatcccagtatccacaaatccctgggtgggggccgcccagtgtccggcagggatgccaggcacccaaatcacacaatttatgctgggaaccggagggctggatgccgatcctacatagcatgtgtttcttctctcactcttggcttactcaccaggtccataccacaggtagtgggctcagactggcctggaccgtcttggccgattgctggcacgcctgtgctctgggccacatcactttagggtggttctcctgggattttccaagcatctgctttaaaagtagcagcttaagccagaggtaatgatggggaaagggggctgaggagccagacataaagtgaatcctgaccccagactggaccctagtagttggtagcatcattcattggagggaatggttatatgtctcagccagaagctggccccacatttcccaaacgctgcacgtaaaaaggcaagaactccccgcgggggccactgtttgaacaagaatttatgtggtgttcagagccccaggattcccatggcagaggttcctcagggctcggcaagcaggtacattactgctgctgtcctcactgccgtgacatggtcatgcacactgagactccctggagaaaaaaattaaataaaccccccccctaaaatatccctaattacaaaaggtgaagataaaatgactcaggtcaaggaaaaaaattgtcctaactgtcatccaaaagaccaccaggacggctacacagtcgaaagaggagctttactggcaaactgggaggagagactcatctcaaacaaacaaaaaaggaaatgtaattgccattgtaacaatgtcgtggaggggaccctccataggcgattaggtcatgaaggctctgcccccatgaattaattaatcctgttatggcaggagtaggttagtgatcacgagactgggtgtgttataaaagtgaggtcggcctgatttcctccctgtctcacatgcttgcttctgccttacacccttctgccacaagatgacccttgcccaaagccagcaccatgctcttggacttcccagcctccaaaactgggagaaataaatttcttttatcagttgtccaatttgtggtgttaatttgcagactaagacaggctttctaataacgtttgttggggctacttggatttttgaggcaacatattcccacttacacatttcatgaaaacctctttattcaatttctcctaagtctgctcattataaacagccacttcacacaagccctccaggctgtgtagggaacggctccaccatggcaccctggtggccctgaacatatccacacaggctacagaggcgaaagctcaaactgaggctcatctgagtcatgacaggacactttgtgatcctccagagagtgggaggcctgtaggagctgctaccactcccgttggctccctgtctcccccaggaggctgtcatgagaaggttctgcatggccttcgggttctgatgaggcctgccactgtctgtcctgccctcttctgaacagagttgctgttgcaggaaatcagggaccctgaacggagtgaccagctggagccgtgccataggaacataaattgtgaagatttcattttaatatggacatttatcagttcccaaataatacttttataatttcttatgcctgtctttactttaatctcttaatcctgttatcttcataagctaggatgtacatcacctcaggaccactgtgataattgtgttaactgtacaaattgattgtaaaacatgtgtgtttgaacaatatgaaatcagtgcaccttgaaaaagaacagaataacagtgatttttagggaacaagggaagacaaccataaggtctgactgcctgtggggtcaggcaaaaagagccatattttcttcttgcagagagcctataaacggacatgcaagtaggaaacatattgctaaattcttttcctagcaaggaatattaagattaatatcctgggaaaggaatgcattccttgggggaggtctataataaccgctctgggaatgtctgtcttgtgcagttgagataaggactgagatatgctctggtctcctgcagtaccctcaggcttaccagggtggggaaaaactctgccctggtaaatttgtggtcagactggttctctgctcttgaaccctcttttctgttgtttaagatgtctatcaagacaatatatgcactgctgaacatagacccttatcagtagttctgcttttgccctttgccttgtgatctttgttagacccttattagtggttctgctttttgccctttgaagcatgtgatctttgtacttactccctgttctcacaccccctccccttttgaaacccttaagaaaaacttgctggttttgaggatcaggcaggcctcatggtcctactgatatgtgatgtcaccccggcagcctagctgtaaaattcctctctttatactgtctctctatttctcagccagccgacacttatggaaaatagaaagaacctacattgaaatattgggggtgggttcccccaatatctggcacaccaacgtggttttctttttcctaagtgcatgtgggaacccgattccctttggtaggtatgtagaaacgttcatcggtccggtccacagaaacccttgttcggctccctgacaactggtgagttgtctgtgtattgtccggggtaactatgagtcatgcagaatctaaacattatgcttatctctgctatattaaactcctgttaaaacagggaggagtttgggtacccatggaaaatatggtcacccatttcagggcggtggaagaacactgtccttggtttcctcaaaagggaacgttagatgtggaactttgggattgtgttggtgcaaaattccgggaaccggtcccaacaggaaattatgctcccgtcactgtttggggtgattgggccttggtacgtgccatcctaatgacataccaatcctgtgaccccctgcagttaccacagttttctgaatctggagaccctctacctcttcctcagctttcctctcccactcggcctttgttatctgctcagcttctcccttcacctactcctccccaacctgagaatgttgaggattcaatatctaactccggtgactttggcttaatgtcaccccctgatgattttatttcttttcacgaattgctggtacttgtagctcccgcggccccgacttggacagcccgagaccatatctatgctatcttccctcttcaaacctttgcagcctttgcctccggagccatctaatggctctgggaccaaactacaatttatctgtaattctgcagaccctcccccgtccaccacagcccctcaccctcctgtcatttcggtccctcaaccggtcactttgccatccactcaaactgcttctctgtacccttcttcaagcatggacacccctgccactctggttgcacaggattgggcaataatcaccagcttctgccccttctgctcccccaatgcccctttctcgtgctctcatactggcccgacctcctcaacctcagtttcccttatctacacatacttttcctgtcacttctatgctgactccgtctcatgtgcctgttcttgaaacttccatgcaacacttattatgccagaacaaagaaacaagtggattagaggcgtgggcttatccggtcgcgctggaacctgccaatgctcaaggggtacaagtgcgtcaatatgcgctgctcaatcttacctttttaaaaaaattcaaggatgcttgtactcagtatgatcctgcttctccttatgttaaaaggtattacagactctttgtactgaggtcattttgcttcctttagactgggaccttttggcaaaagctgttctaactccatctcagcattaaaattctgtacttggtggtcagaggaggcccatctgcaggctcagctaaatcaggctgatggcattccaattactcaggctcagctcacaggctccaataattactctgacaataccacccaattaggctttgatgctgtcaccacggatcaagtaacaaaggtgtgtgtaagagcttgggataaattacacactcctgccaagctcctgtttcttttactactgttaaacagggtcacaataaattatatcctaattttttggctaaattacaagatgctgttgaaaaatctgtaattggacaagctcggtgtcaaatacttaaaatttctggatttgatccaaatttaactatggttcctttaaatcagctcgaagttcaagccgcttttcaacattgcatactgtggcaaattcacttggctgattttatcggtgttattgatgatcattatccaaaaaacaaattgtttgattttataaaaatgacttcttgggtggtccctcgattgaccaaagatcagcccattcctgaggccgttacagtgttcactgatggctccagtaacagaaatgctggttatgtgagtcctacagacaagcttatttctaccccttataccactgatcaaaaggcagagttaattctgaaattattgccttacaagatctccccaaaacgttattgtctctgattctgtttatgttgtacatgccacaaaaaatatagaaatcgctactatcgaacataacgataattctgaattgtctcctttattttcaaggttacaacaggtggttcgccaacatagacaccctttctatattaacacatattagatctcatgccactttaccaggacccatgtctgctggtaaccagaaggtcgactgtttggtctcttttgcaatccatgaggctcaggagttccataatctcactcaggtcaatgctgctggattaaaagataaatttgttctcacctggaaggaggttaagcttattgtccatggctgccctcagtgccaagtttttgtacttccaaatcaggaacctgacgttaatcccagaggcctaactcctaatgattcacggcaaatggatgtgactcatgttagctcctttggcagactttcatatgtacatgtttctgtagacaccttctcaggttttatttgggctatttgccaaacaggggaaggcagagcctatgttaaaagacatctgggccgggcgtggtggctcacacctgtaatcctagcactttgggaggccgaggcaggtggatcacgaggtcaggagatcaagatcatcctggctaacacagtgaaaccccgtctctactaaaaacacaaaaaattagccggatgtggtggcgggtgcctgtagtcccagctacttgggaggctgaggaaggagaatggcgtgaacccgggaggcggagcttgcagtgagccgagatggtgccactgcactccagcctgggcaacagagcatgacttcgtctcaaaaaaaaaaaaaaaaaagaagacatctgtattcttgctttgcagttatggggcttccatatcagataaagacagacaacacccctggatatgttagtaaggcttttgatttatttgtgcaacaatggggaatttccaatattactggaatcccttacaatcctcatggacaggctgtggtggaacgggtcaatcacactttaaaaactcaattgtccaaacagtctgagcaacaaaagcataatttaaccactcccactcccaattacatttagcattgtttactttaaactttctaaatgttcctaaagacaatactctgactgcagctgaatggaggcaaaaaattctccctaaatgaaggcaagccagtgttatggaaaaactcccagaccaatacctgggaacctggaacaattataacatggggaagagagtatgtttgtgtttcacaaggagatcatcaatcccctgtctgggttcccactaggagacttaaatttcgtgtgaatactgacaatgaaaaccacagggaaaagacgtccgcgtcagaggccgccctcatacctggtgaaatctgtgctgattcctcaaaaactggcacaccaaatcaaaaagggtctgggtcaatcctccctaatgacaacataaacccctctaactaattccacttctcctaattacctttctttttctccttacaaacctaaaaatctcaccatttctattagcctgaaaataacatccctctgttcttctcttcctccttcagtaccggatcttgcttacaataggttttatttaataatttttctacttatactttctgtctcaccagtttttcctcaaactgatttacctgctacacaaaattattcttattgggcttatatgccttttcctccacttattcgacctctcacctggatggatgctcctgtggaaatctacactaatgatagtgtgtggaggcgtggagctacagataaccattggcccgctcaaccaggagaagaagccactgcatttaatgttactatgggttataaattccttcctctgtgcctcggacatgcaccaggttgtatccatctagaaactcaagtctgggctgcttatcttctggagagattagccacaggggaacagggacatttggtctccggcccctccctttctcctttaagacaaatgaaaaggggagtaataggagataccccatactttcaatataaacctgtaggaaaactatgccctaaaaattttgagggtccatctaaaactttaatttgggaatattgggttaattcacatgcagtagtattaaaaaatgactcatatggtttagtaatagactgggcaccaaagggctatttaaaaaacaattgctcctctggcggaagggaatgcctggaggctgtttattttatttcttgttgggaggatgaggatcatcatcctactttgcataggaggttcagctcgttctttcccttaaaatgggaagataagggctttacaccccccacccccgaggccttgtatgatactccccattctaagcccagaacacccagaactttggaaattggctattgccatgtccggactgtgggtatgggaaggggaaacttttctgtctgttgtccccactaccgccccctgcatccgtgattctgaaccccatgataaatcccctttgaaccttttcctctttttgatgccgatcctcctttatgggactgcgattggcattatgataattcttctcgaccccggtatgcccctctacctcttcggcatccccaggcatctcggattgcttctgtacgatggagaacattgggttttgccaccgccgctcctctccctcagtatcaacatagattcaaacattccgctttgtttacctccagcctgactattcctatacagagttgtcttaagcctccttacatgctattagtgggaaatatcaaaatttggacgaaaaatcaaactgtccaatgcattaactgtcatttatacacttgtgttaactcccgttttgactccaggaaaagtgtaatgttggttcgagctcgagaaggaatctggatactggtaactttacgcagaccttgggaatcctccccctctgtacatttaattaatgaagtgttacaacgaattctcaaaagatctaagaaatttgttttcattttaatcactggatcatggacctaattacagtcactgcactggccaccactgctggagtggcatcacaccaatctattcaaacggctcattttgttaatgattggcaagccaattctacccaaatgtggaattctcaacagggcagttatcaaaaattagctaatcaaattaatgatttaagacagtctgttatttggcttggagatcggctaaaagtcttgaatattgcatgcacatgcagtgcgactggaatacttctgatttctgtatcacaccatattcctacaatgagactgatcattcatgggaaatgatcaaaggacacctaggtagggaagataatttatccttggacataattaaagaaacaaatttttgaagcctctcaagctcatttatccattgtgcctggagctgaggtgttagatcaagtggcagaaagtctttctggactaaaccccatgacttggattaagtctattgggggctccactgtagtgaattttggaatcatgtttctctgtttaattggcttgtttttagtgtgccagaccagtcaaaaaatcctgcatcaaaaccgagagaacgaacaagccttcaccaccatggcacatttatataaaaagaaagggagagatgttgagggaagtcagggactccgaatggagggaccagctggagccatgccagaagaacataaattgtgaagatttcattttaatatagacatttatcagttcacaaataatacttttataacacaccagcatcagttaccaaatgctgcagccaagctgtcgctgggcagcagtcacctcaaggctggcctggatgctgcctgcttccaagttcatgccctggttgctgacaagattcagtttctcctggcttgttagaatatggacctcagttcctcccaggctgttgtccagaggctgctttcagttcctttaaaggtaggcctcaaaaagaacaccagaaagtgtgaccaagacagaatccgtcttcataacctgccttccgaagggacagcctgttactttttgccattgtattagttttctttttctttttactttttttttttttttgagacggaatttcactcttgtcacccaggctggagtgcaaaggtacaatctctgctcactgcaacttctgcctcccgggttcaagtgattctcatgcctcagctccctgagtagctgggattacaggctcctgccaccacgcctggctaatttttgtatttttagtagagacggtgtttcactatgttggccaggctggtctcgaactcctcacctcaggtgatccacccacctcagcctcccaaagtgctgggattacaggtgtgagccaccgtgcccggcctctttttctttttaaattgagacagggtcttgccccatcactcaggctggagtgcagtggtgcaatcacagctcactgtagcctcaacctccctggctcaagtgatcctccccacctcagcctccctcagaactgggactacaagacatgcaccaccacacccagctaatttttacttttatttttgtagagacgggtctccgtaggttgcccacactgatctcaaactcctgggctcaagcaatcctcctgccttggcatcccaaagttctgggattacaggtgtgagccaccaatcccggccttgtatcagttctttattgctctgtaacagattaccataaattccaaagctctaagcaacacccatgcactgtcgcactgtggatgtgggtgatgtgggtgaggagtctggcatggtgcagccggggactctgcccagggcctcacaaggctgcaatcaaggtgtgggccagccacgttctcagctgggatttggtgtcctcttcacaccccttctggttgttgccggacttcagttccctacgttggggcactgaggtccctgttttcttgcaagctgccatcagggaccactctcggcttccaggggcccccttgtaggtggcaccatggccacttgccctactccaagcctgcagaagagcgcctctctgccatgtccctttcttttaaaagacttgcctgactggttcaggtccattaggtagcgtcccatttgattagctcaaaagtactgtagcccatcacattcactcacaggagggcattagcggggtgtggacaccagggagtgagactctctcaggccagtttagcattcatttggttagccaggtttggtggctcatgcctgtaatcccagcactttgggaggctgaggcgggcagatcacctgaggccaggagttcgagaccagcctggccaacatggtgaaacccagtctctactaaaaatacaaaaattagccaggcgtggtggtaggtacctttaatctcagctacttggaagcctgaggcaggagaatcgcttgaacctgggaggtggaggttgcagtgagccgagatcgtgcctttgcactccagcctgggcgatacagcgagtctcaaaaataaataaatgcgaaggctgctgagcgcagtggctcatgcttataatcctggcactttgggaggccgaggtaggaagactgcttgaggccaggagtttcagcctagcatggacaacacagtgccactctatctctaagtaaaataaaataaaataaaataaaataaaataaaataaaataagtaaaataagaattcagttggttaaaagaaactcactaggtccagcccacaatcaagggatggaaattacacaaagttgtgaagagtcaagggtgggagatcgctggcagccccttatagaagctgcctatctcacatacctgttggacagcttctctctcctagctgggggtatttggagcgggtgtcaaatcctgctcttttttatgtctgttgccttttctcgcggtgatgtgtttcctgtgtgttctgtaattttggatcgtgagctgagcttcagaggggctttatgtggggaatcctgggtggccaggtttgagggagccacctagagaggttttctatttggcttttccaggggccccagggtaccactaagccaaggcaacttttttttttgagacggagtttcactcttgttgcccaggctggagtgcagtggtgcaatctcagctcactgcaacctctgcctcccaggttcaagctattctcctgcctcagcctcctgagtagctgggattacaggcacacgaggcttggctaattttttgtatttttagtagagacggggtttcaccatgttggccaggctggtctcgaactcctgacctcaggtgattcacctgcctcagcctcctgaagtgctgggattacaggcgtgagccaccatgcccggcccaaagcaactttttagtgttaatttctcaactctggcattcctagaccacacaggtggcatgactttattgtaggagttccacatttatataagagaggcctgaaaacacaacgatctcatgggaaagttgttcaccacctaaagctcaaaatttctcacctctctctgttcccctgggtggaaatgtttctgtccctttctctaaaggtgttgcatttctgtgaccccaacttcatcatgcttgactgtaaccctgaccccctgccttgtaagggcttccaacgctcaacccagccctgccctcaggcagttgcagcaccagctcctctgtccccaccttggttctcactcccctcttcacttctggccttaggggacttaacttattttctgaagaactcagctatatatttattttattttattttatttatatattttttgagatggagtttcactcttttgcccaggctggagtgcagtggcgtgatcttggctcactgcaacttctgccttccgggttcaagtgattctcctgcttcagcctcctaagtagctgagattacaagcacctgccactactcctggctgatttttgtatttttagtagagatcgggtttcaccattggccaggctggtcttgaactcctggcctcaggtgatccgcccacctcagcctcccaaagtgctggaattataggcatgagccaccacgcccggcctcagctctatagttaaaaggacatttgtttcttacccagcatttctaggtgttttgaagagggagacttctcaggttatctaacctgctactgagaacttaaagatagggaaaatcttggactggagattcttggaatcacataattgaaaaatcccagccaggcatgatggctcacatctgtaatcccagcactttgggatgccgaggcaggtggatcacctgaggtcaggagtttgagaccagcttggccaacatggtgaaacttcgtctctattaaaaatacaaaaaaattagcctggcatggtgttggacacctgtaatccccgctactcgggaggctgaggtaggagaatcgcttgaacccaggagatggaggttgcagtgagctgagatcacgccatcgcactccagcttgggcaacaagagtgaaactccgttgcaaaaaaaaaaaaaaaaaaagaaaagaaaagaaaagaaaaagaaaaatccccacagtgcacatggacaaaatcacagagttgctttgggagcgagggtggcaatcagacacggaggccatgacacaacctgctcgtccactcaggggtccagaacctccacccagtcaccttatccgggggtgatggagacaagggaggtgccacctacgccagtgtcatctcttacaatgagctcttctcctgctcgaaaagagccagcctgctgagcttgctgccagggcccgtcgcactgcctgcgctgtgttgcccgtcgcacagcctgtgatatgtgtttcccgtcacacggcctgtgatatatgtttcccatcatgtgtgcatgtgtgttgtcatgtagtgtctgtcacaggtgttacccgtcatgtgtgtttgcatgttgcatgtgtgtggcctatcaggtgtaaatatgtgttgtctggcacatgtcagcatctgggcattctccgtgtgccaggagcagccaggtggcctgtgaagccttctcatgggaaatgcccagataggaagagcacagccaggagccaagcccctgagtggccactccatgtgcctggatcaccttcaagtctgctcaacaccagagcctctgttccttggcaccatggacattggaattgactcggaactgggaagagctgtagacccactatccaggcacccgctctccgtttgcccagcatcccaggggcccacacccttccaaatatcatcttgccctccattcagaggtgaatcatccgagcgtcaggttgcccaactccgactggttttgctggagcctccatggaggatgtcaccagacacctccagagaacactcagtctacagatgccgagggggaactggaagcacacagtgctggccttcacccaggttatggtggcaccttgggaccgcttctgagtctgcttgtcactgaaggtcggcgtgaggcaggcagcgttccctcccagatttagaaaatgtcaagtctcccgccgcacccttttgtgtttcttacagggcctggggagcttgctgccgccacactaagggctccaacatgttccctcacacactcaacagagaaggaaactgtggctcagatggcagactccctgtccaaggccacagagtctggccccagggaccactagaggcttcaagaaccaaactcacatgagggcagagaggagagatggggccagtttagggctgggagaatccatagagcgatgctgaggcaggcatggagcctggaggtacggacgagggtctcgccaaactcaggggtaaagaggctgtggggagtgaggaatggtgtgggccagccccgggcctgctggcgtgcagctgggggctccatggccctcccacggcccccacttgtcctcacccaaccgttcagagctcttcatggcgggggtgtccctctcctctggccacaagaggagcgggtggaggaacggcaccttcaggccttgtagggggtctgcccctccaccagcctgtttctcgtgggcatcgcagctgaggctgtagccgggaaagggtagtcaccgagcgtacctggcctccaaccaccacttccaaggcccctactgggcacagggtgaccccaccgtggctcggaagtagaccctgtccgacgcggggatggtcgctggagggccgaggatgcctacacaggcccctggagggtgtgcctcgggagtctgtctcgccctctggacccatgggggaccagcaacgccgtcacaccctcctctgtctctgccagccgctccgccgctcccttctcctggctggggctggcaaaggcaggcaggtatggggggcggggcctcaggagggaggaagggctggtgggcggggcctacggacacctcgccccgcccccagtagggcgccgcactccccacaccctgcggtccccctaggtcagggcctgtcaccaccgcgcccagaggccgggccagccgggcgtgcatcccaggggcgctccgtcccccgcggcctgggactccccagtaaggacagtacaaaatctctttattgctcattttctgtaaaaaaatcgtggctctcggcggaccctggggataggaggtgcaaagcgcggtcacacgcggcccgggtccgcggccgacagctgggaggatctggagcggggccgggtcgcaagaagaccctgaccctgctcccgcgctggggcgcgtgctaagggcccgcagggtttcagctgtattttcgaacccctgtgcttggccgaggggttcccaaggctccactccgccttggagggggctgcggaagcccggaggtgacccgggctctgggaggggcgtccccaatgtgggggaggggagacaggggcctttgaatacagcgcgggactcagagggggtccccccgacctaagacgtggtaaactgaggccggcgaggagggaggctgagtccggggaccaggcggcccctcactgctcctccggtccgtctcccctctgcgcctgttcgtacgggcagggccggcggccgagtccagcgggctcggggccaggcctgggccccgcgggcggcgcctcctcctccgcgccgtccccatgctcgtcctcagcgtcgctctcctccgagttgtcctccaagtagcggtaaccgcgcaccttgtgctggggccgcgggatgcggggctgaggcggggccacgccccgccgcagcttctgctccatccgcaggtaggagaccgcggccgccaccagcgtcaccagcagcatcgccagcttagcctgggcgtaaggagagggatgccagggacccgcggccgcctcgcttcgcaccttccccgcctatgcccctcgctgagataggcccttccctcctccgggagcctcccgggccacgcggccctcaacttctccagcccctccacccacgcttcctggaccgcctcttgcaggtgaggctcacatccagcactgtcccttacagtcgccacgcccctggcgacctcagtgtcccacactgtaaggggacaatgcaaatccctttgcctcatagggtgcatgcgccagtgttgataaagtgctggccacaggccctgccttcccagggctcacaacactgtgtccctgacacacccgtgggctgtagtgatgctcttcatggggttttgactataacccgcagtcaggaatgatttcacaccatagcccagtacatacacacatatctgtatgcatacttcctgctcttttcttttttccagacacggtcgctccgtttccccacagcccccccacccactgctggagtgcagtggcacgctcacttcagcctcaatcttccaggctcaagccatcctcccacctcagtctcccaagcagctggaactacaggcacgcgccaccacgcccagctaatttttaaattttttgtagagacagggtctcctatgttgcccaggctggtcttgaactcctggcctcaagcaatcctcctgcctcagcctcccaaagtgttgggattataggcgcgagccaccatgcccaacccactcactgcttttcttttttcttttttttttttgggagacagaatctcgctctgtcctccaggctgaagtgcggtggcgcgatcttggctcactgcaacctccatctcccaggttcaagccattcttgtgcctcagcctccagagtagctgggatcacagggacgtgccaccatgcccagctaatttttgtgtttttagtagagacagggtttcacagcctgttacccaggccggtctcgaactccagatcacaggtaataccccaacctcagcgtctcaaaatgctgggattacaggcatgagccactgctcccggcccactccctgctatttttagttctatttttatttttatttatttatttatttttgagacggtgtttcgctcttgttgcttaggctggatggagtgtcaaggccccgtctcggctaactgcaacctccgcctcccagttcaagtgattctcctgcctcagcctcccgagtagctgtgattacaggcacctgccatcatgcccggctgatttttatatttttagtagagacgaggtttcaccatgtcggtcaggctggtctcaaactccctacctcagggaatccactcgcctcggccccccaaagtgatgggattacaggcgtgagccaccgcgcccggcctttagttctattttttaaaaatatttagcaactgggacttgctagaccgagccaccatcttttgtgagcagagcatgaggagcctgctccccttcaggccatgaagggagacagacccaacatctggagaacagggtaccaaacagcccacaggatggctgtgatgcatccacaaatcccctcagagatgggcaaactgagactggctggaggtgggccagtaagtggggtgctgagttgggggccacccagtgggctccaggaatggggccttggcccagagactggcttgagaaggggtggtgtttaggaggctgtgaagccagggcaggagctaaggaagtacctgtcattgggcatgggacccccaaccctgcccagtctcaccttcatgtgcaggctcgagcccaggtacacggtgaagatggccacagcctgccaccagtggtagatggtgaagatgaagtcctgtctctccttgtcttcgtacaagattcccaggagtgctgcaggcaggcagtacagggcaggcaggggagaggtgtcacctggggcctggggctgcctagctaccatctatgaactttactaagccctgtatgtgtcccagcccgggaccagagaacgcctagaaagtgctgtgaggcggtcctggcctgccccctggtggagaccctggtcaccacactgctcacacgctaagcagaagtaggagcaggtgcgccgggctgtgtggatgcaggtggtcccgctccgcaccacatgcgtggcctcaaaagaagaaagctctgtgcttagtcatgtcctgtccccaaccccaggtgtgcagtgccaagcttgcaggcgctgtttctccttctcagccgggactagagggatcgaactgtttgcagctgccaactctgcaaatcaaacctgaagctaagcatggagaggggggcttcctttccagtgagtcctcccagggtggacaacaagagtaatggattgggagtcagaagatgcacactcgttctcaggactgtaatgttggctctgtgggtgatttgggtacttaactccccagagctgcttttcccaatggtgagatgagcttatgcctattgtgtgctgtgttctgaagttctaaagtgagaaagagggcatggcacctgccaaatcataggggccactattaacaccttcaccaggcactcaggacatgaacactcctgtcttggggccctgcagggtgactttacccccacagtgctgctatgaagagacaaggatcccccggggttcaccagctgggcagaggagatgccatgaccagacagggcacaacatgggttcaagatgcccaggttggactctgcccagaattggctatccttgagcaaaacggccaagagactgtggtgcagtatgaggctccagcccctgctacagacagagacaccgagccagcctctgccctgccagcagcaggcatgacctcggccactccacacccccaaggatgacgttcaaaactgttcacagcttcggcccatcagaacagacactgacatggatgcccggcaggactgcccatgtgtgctagctgtgtgtcactgtgtgtgcccatctgtggtcagggagcatcctggagctgaacatgggcccacccgctgccttctgcaaacagggccctgttccccagcagcccagacctggggcctggactctggtactgagcagactgggctggggctgcaggcctgctcctctctatacaaaggcccatgtctgtatctatgccgtggatgtacaacaggccacttgctcctaccatatgctccgtgaggcagagaccaaaatatctgctccaaatgtcacgaaaacaatgccagggtaagccctgtcccctggtatgaaaagggagaatccctgatgtgtttttcacactgtccctaaggggtgtccacagagccccacacctgccccgtgtagccacgagatttcacactgaccctccagtgttgatgcggccctgtgcccgccctggggtattaacggaatgtccatggcgtggaacccccacaactgtctccagggtgtccacaccctacccatctgtccccagtgtgtccatgagactttcctcccacccccggagtgtccacaggaagccccacctgcctctgccatgtccacaggaccctatgtgaccatgggaccccatatctgtctctgggatgtctatgcctagccaaccacccacagatagccataaagccccctgccccgccccctccagtgcccacagctatactcactgctgagtccagtattgttcagggcgctgcccacaccccaaagggcagctgccacacagaggatccagatgtgttgcaggacccgaggcacaggggcccagaaaaagaggatgaaggtgaggagcaggtgcacccctgctccagccatgaggggcaccgggcgtggcagccacaggcccagcaggcccaggagtgaggcggctgaggtgcccaggctgtaagccacgaggaggtaagccagccgctccagccccaccaagcacacgccatagccctgcggggggacaaggggtgagtgttgaagtccggaacagcccagaccccagtctcagccctccccgcattgcggggggtgcctcacccccctgcgataggtgccctaagagccaggggaggagaagggctgactcgtactccccgcatcgcggggggtgcctcacccccctgcgatgggggtcctaagagccagggggggaagaggggctggctcttactattcctgagggaatagtttagagggactcattccctgctatggtgggtgagatgtctatgaaaaggacaaccagtgggggagggtagcaaaattttgaagtagatttctgagaccccccagcacaaccaggaacagaaactccacactctgctgagcggatagtttgcacattggtctcctcccatctgcccagcgcactctcctgtttgtcctgaagaggaggaaaccaaacaaggctcccgaccgtccctcagcactcacttgaaggggtggtccgtccctccacacctgtgggtatttctagttgggtgggaagagactgagaaaagaaataagacacagagacaaagtatggagaaacaacagtgagcccaggggaccggcgctcagcataccaaggacctgcactggcacaggcctctgagttccctcagtttttattgatgattatttttattattttagcaaaaaggaatgtagtaggagggcagggtgataataaggagaaggtcagcaacgaagatgtgagcaatagaatctatgtcataatgaagttcacgggaaggtactatgactggacgtgtgcgtaagccagattgatgtttctctccacccaaacatctcagtgaagtaaagaataacaaggcagcattgctgcaaacatgtctcgcctcccaccatagggcggtttttcccccatctcagaattgagcaaatgtacaatcgggttttataccgagacattcagttcccaggggcaggcaggagacagcggccttcctctctctcaactgcaagaggatttcctctttgactaatccacctcagcacagaccctttactggtgtcaggctcgtggacggtcaggtctttctcctcccacgaggccacttttcagactaactatggggagaaaccttggacaatacgccgctttcaagggcagggctccctgcggctttccacagtgtattgtgcccctggtttattgagactagagaatggcaatgacttttaccaagtatactgcttggaaacatcttgttaacaaggcacgtcctgcacagccctagatcccttaaaccttgatttcatacaacacatgtttttgtgagcttcaggttgggtcgaagtggctggggcaaagctacacattaacaacatctcagcaaagaaattgttgaaagtacaggtctttctcaaaatggagtctcttatgtctttcctttctacatagacacagtaagagtctgatctctctttcttttccctacactcactgaactgcccttcccctctgctgggccatgaccacggagaacaggtccagtgtcctccttctgtggtgcaccatggaggctcagactccatcctcaaggctggcaagaagacagggtgagatgtgagcctcctgatacaggtgacggaagtggagcccacaggactggaacctcacactgtagggctggaggcacagactgactatttactattctgtggcctggggggctcaaggcacagagctccttattagacaaagtcacccaagttccccaacctctaaggatttcctcataataatgcaagaagaagagaaaagtgagtgtccatagaagctttggggctcttcctctaatcaggagaaagctggtgtgtattctttgcttctttcttttctttttaaacatccaactgctttaattttcatcttttattaagggaaaatataccacgcataaatatttaaaattataaatatatattagttcatatagaatggccggtataaacatttataatttccatgctttttcagtttacagtttcatgacattaagtacgttcacattgtttaccaaccatcactgccatcgtctccaacacagttttatctttcaaaatgtaaattgcacccattcaccaagctctccactcctctctctcgcccacccctggaggccacctttctagtttgcaactctatgaatttaactactctagacacttgatagataagtggaatcaaactgtgttttattgttttggaaacagagtctttttctgtcaccccggctggagtgcagtggcgtgatgtcgcctcactgcaacctccacatcgtgggttcaagcgattcttgtgtctcagtctctggagtagctgggattacaggcgtgcgccaccacgcccagctaatttttgtatttttaatagggaccatattggccaggctggtctcgaactcctgaccttaagtgatccacctggctcagcctcccaaagtgctggggttacaggtgtgagccactgagcctgggcgtgtttatccttttgggatttatttatttcactgacgataatgttttcaaggttcatccatgttgcggcctgcctcagaagtgcgtctctgttttttgttttttttgtttgtttgttcgtttgactttgttttgttttgtgtttccatggagtctcactctgtcgcacaggctggagtgcagtggcacaatctgggctcactgcaacctccgcctccctggttccaaccattcatgttcctcagcctcccgagtagttgggactacaggcacatgccaccacgctcgtctcattttttgcattttcagtagagacagggtttcaccaagatggccaggctggtcttgaattcctgacctcaggtgatctgcccacctcggtcttccaagacgctgcgattacaggtgtgagccaccgcacctgccagaagtgcctgccttctggaagactattaaggctgaatagtcttccattgtatgaaggaactgcagtgtgctttttcattcatctgtccacgaacccttgggttgcttccacattttggctgttgtgaatactgctgctatgaatatgggtgtacacaaatctgtcttccactcctggcttctaattctttttggtagctacccacaaatgcaactgtgggaacatctgatcattctgtttctaatttttccagtagacgccatactattttccccgttccttcacggttttacattccctccgatcatattcgagcattcctacttccctctagtctcaccaatgcttgtttgtttatcatatccatcctaatgtgtggtatcacattcttggtttgatttgcacttccctatgatgagtgattttgaacatcattttcgatgcttattggccattgctatatcttctttaggaacacgtctactcgagtcttctgaccattgttgatgggatgctttgggtttcttgttgtttagttctagctgttctttatatatgatggatatcagcctcttttcagatatatgctttgcaaatatttttcctaatccatgggttatcttttcactcagttcacagtgttttttgctgcacaaaagtgtctgtcatttagatgtcatccaaggaatctaattttcttttgttgcctatgcttttggtgtcatatcccagagaacattgcccaatctgatgtcatgaaagcgtgaccaatgttttcttttaggtgtatgatacttttagtgcttggggtgaggtctttgatccagtttgtgttaatttttgcacctggtgtgacatagggtccaccttcattcttctgcatgtggaaatcaagtttctccaacaccatttcttgaaaaggcttcttttccaccaatgagctttcttagcactcatgtgaaaaatcatttgaacatataggtgagaagttttttctgggctccaaaacaaacaaacgacaacagacaacagataaggatacagcatgggccgggcgctgtcactcacacctgtaatcccagcactttgggaggccaaggcgggcagatcacctgaggtcaggagttgaagaccagcctgaccgacagggagaaacccccatctctactagaaatacaacattagctgggcgtgctggcacatgcctgtaatcccagctactcaggagatggaggcaggagaatcgtttgaacccaggaggcagaggttgcggtgagccaagattgcaccatgacactctagcctgggcaacaagagtgaaactccatctcaaaacaaacaaacaaaaaaacccagcataatttcaagagcagaaagagaagagcttaaaaaccagtacaatgagaaagttaggaagtttcttaccaaagcatctggaaatatgcaagcaattcttgtgaactaaaattttcatactgtactatcaaacactagaacacacttattccatctttctgtattttgggacccaattatccacttgtcttcattccctatcccaccccttttcttcctagtgtctgctaaccacctttatactttccaccttcttgagattccttttgtgtgtaggtgtgtgatggagtctcttactgttgcccaggttggagtacgcagacacaatccgggctcactgcaagctccgcctcccgagttcaagcgcttcttgggcctcagccctctgagtagctgagactacaggcacgcgtcaccacgcccggctcattgtttgtgttttccgtagagacggggtttcaccatgttggccaggtggatctcgaactcctggactcaagtgatccgtgcgacttggcctcccagagtgctgggattacaggcctgagccaccgcacctggccaaggtttccttttttcttcctacatagaagtgaggacatgaaatatttgtcattctgtgcctggcttctttcatttaatatacagacctgcaatctcatccattttgtctgcagcggagaggagtttcttccttttttggatgaataatacttcactgggtgtgtataccacagtttcttcattgaaacaaatttctgaagagcaaatatttttaaaatgtctcgggatgtgaaacttcagggatactgtgcccattttattctttactatttcccatcttatgtatatgcaagtgtataacaaagcagcaatcaatgtgtgtataaatctataacttcaacagatgtaaaatgtaaatgctaagtggtggctgggtgcggtcgctcatgcctgtaatcccagcactttggggggcggaagtgggcggatcacctgaggtcgggagttcaagaccagcctgaccaaaatggagaaacactgtccctattaacaatacaaaaaaaaaaaaaaaaattagccaggcatggtagcgcatgcctgtaatcccaggtacttggaaggctgagacaggagaattgcttgaatacgggagggagaggttgcagtgagccgagaccatgccattgaactccagcctgggcaacaagagtgaaactctgactcaaacaaaaaggaaaagaaagaaatagaaaatgcgaaatggtaagaaaaaacagcataataaacatttgtatggtgttgatggacaatgcatttgaagataatatttgaagatattatattacaataaatttctgttcttactcattggagcttgatgcccctaaaaacttcgtcattggaaccacctctggtgctttaaaagaaaaaaaaaaaaaaaatccacatactcacacaggtgcaaggaaatcagaatctcaggtattgagacccaggcctcatcatttgtaagctccccaggtgatttgactcaaagccaagattgaggaacggcgacatggatctctctacataacctgcctaaatagattctctagaagcagtttataaagaaattccgcaagaactgcggaagaggatatgaatttgatgtacggtatgtcctcacttaacatctttgaaagtctcttggaaacttcaccttgaagcaaaattatgtatagtgaaaccacttatttttcatcaacagtataactacacaactttgaacaaccaatggtgttggaggacctcctgtacattgtttccataaagtcagttttcagggaattccaaaacgaagtgaggacttcatgtatataaaaagatggttgtgattccacctggatgacagggttattgctcagaaactaaaagaggccgcctaggtatagaggattcagtcatgaggtttctgctaaacaaagggtcccagaatcctcacccattccagtgaaaggcataacaaagaaagcaatattcacaaaggaaatgcggaaaggaataaaagccatcaagccacaaaaataatgtgactaaggggcaggatttgcagatgtagagatttaatgtggttgccctttctcacccacacaagaaaaaggatggaacagatcatgagatttgactgctctgctgtgcagcctccgcagggcactttgtatgtccctgtttctcaggctgtagatgaaaaggttcagcatgggggtgaccacagcgtacatcactgacaccatcacaccattcctggggggtgctgacacagctgaagtcaggtacacaccaatgcctgttccataaaatcagcaaacagctgctaggtgagagccacaggtgaagaaggctttatacttcccatctgatgatgaaatccttagaatggaggggatgattttatagtaagacaaaaggatccctggaatgggaagaaaaccaaacatagtactatcgaaatatatgaatatgctattgatgacgctgtcagaacaggcaagtttgagaagttgagaggggtcacagacaaaattagagatttccacattcttgatgatggtgaattgtaacacaatccaactgtgcagctgggaatccaacaagctaaggaaaaaggacaccaaaaagaagaagacacagagctgaggattcacaatgactgggtagtgcagaggacgacagatggctacaaagtagtcataggccatcacagtcaggagcatgccttctatacatgcaaaaaggaccaagaaagatatctgcgtcaggcagcccgcatgagagatgactctgctatgtgactgcatgtccacaatcatcttgggaaccgtggccgaggtgaaaccgatgtcagcccagcacagcttggagaggaagaagtacatgggggtgtggaggggggagtcagagctgacagccaggatgctgagcaggttcctcagcaccgtgaccagatacatggacagggacagggacagcaaagtgaggataagctgcagttctgggtcctctgagagtcccaggaggaggaattctcggacacctgtgagattccgtggccctgtgtgtcttggacaccttgagaaggaaagaggattggaaaaataacagataaaaaccagcccttaatgctggatgcaagcaattcacaaggaacatcttcacacttgcggacatacaccgctagcaatgtttctcagttgtgacaattccaaaaatctcagaattattatgtgatttacttttttgctatacaaagctttctgtacatactactttagagaaaatccactgaagaatattagaagaccaaaacatcatatataacaaatcagtgatctcagtaaaatacggcctactcttttcagaaaaaatacaatgcaatgacaatgtccttctctctttaagagaaacatctcagtctaattgaaaggaattaagaagccatgaaatactctctactttattcggacccgtgctacaacttccattgatgtagaatatgtaaaaggacgacacaagagctaggaccccattatctgaaaacgacatcgaaccttatagttctcaatcggaagaccttttcccatgcctgttacttttcatatttattatcatccttcggttttctgacatcatttcttcataaaagtacatgcacactcaaagatgggagctgtgtttccaaatgaattgaatctataactcttggcccagcaccatggctcacacctgtaatcccagcactttgggcggccgaggctgatgcatcacctgaggtcaggagttccagaccagcctggccaacgtggtgaaaccccatctccagtgaaaattaaaaaaaattagccgggtgtggtggcggctaaccctagctactcgggaggctgaatcaggagaatcccttagaacctggaaggcagagattagacaccctgtgataggatttttgatatcctggggggatattgctcctgacagcagagtgggcatacaccctgtgatgttatttgtaatatcctagaaagatattgctcctaatatcatggtggctctacaccctgtgatcttaattgtaatatcctacagagatattactcctaataatacagtgggtgtacaccctgtgatattattcataatatattacagagatacgactcctgatatcacagtgagtgtacaccatgtttgtacaccctgtgatcttatttgtaacaacttagaaaaatattacagctaatatcaaactgggtgtacaccctgcgatgttatttgttatctactaggtagatattcctcctaatatcacagtgagtgtacaccatgtgtgtacagactgtaaaattactcataataccctaggaagatattactcctcatatcacagtggctgtacaccgtgagtgatatttttttctaatatctagtgggggagaggatgatattgcttccaatatcacagaaggtgtacaccccctgtgatattgttcctaatatccagggaaggagaggatgacattattcgcaatatcactgggggtgtactacctcccgccggtatatttttcttaatatccggaggtggagagaatgatgttactcccaatatcacagggggtgtacaccacccctgtttgtagacaccccctgtgatattgttccaaatggcctgtgaaagagtaaacatgactcccattatcgcggggggtgttcagccctgatgatattgttttctaacatccagggaaggagagtatgctattactcccaatatcgcaggggttgtacacccttttgtgtttttgtgcccaatatccaggaaaatagaggatgatattactcccaatgtcgaagtaattgtacagcacccctgtgatattcttcctaatatccagaaaggaaaagaatgatatttctcccaacagcgtagcaaacgtatacccgcactgtggtatctttcccagtgtccaggtggggagaggatcatattacttccaatctcgcagggtgtctacaccccctctgtgatctcgttgctaacatccaggtttggggaggacgacattactcccaatatcgcagggggagtacaccccctgtgacctcgttagtcatttcctgggtggagaggatgatcttactcccaatatcgcagggggtgtacacacccctgtgaaaatcttcctattttcagagggagagaggatgatattactcccagtaccgcagggggtttacacagccctgtgatcctcttcctaatatccacagggagagaggatgatatgactaccaatatcgcagggggggtacacaaccctgtgatattgttcctaacatccagagcgaaagaggatgatataactctcaatatcgcagggggtgcacacccctcctgtaatattgttctgaataccctgggagggagaggataaggttacgttgaatatcgcagggaatgtgcaccctccccctctgatgcccttcttaatatccaggggaagagaggaaaatttcactcccaatatcacacaggcagtacaccccacctgtgatgttgttcccaatatgcaagggggagaggatgatactactctcaatatcgcagggctgttcacatccccagtgacatttttttcctaatatctaggggagagaccattatatgacagcaacggttgcagggtctgtacatctgttccttatattgttcctaatatccagggggaaagaggatgatataaaatatgaaagggggtgtacatcccccacccctacgatattgttcttaataatcgtgaggggagatgatgatattactccaaatattgcaggggttgttcacaaccccctgtgatattgtttctgatatccagggggggagaaaatcatgttacttccaatattgcaggtggtgtattccccacctgaaatatggcaccgaatatccaaagagggagaggatggatatcataccaatatcgaagtgtgtgtacacgccccttgtgatatggtttttaatatccagtgggcgggaggatgatattagtcccaacatcccagagggtgtacactacccctgtgatattgtccctaacttccagaggggagaggatgatatcactcccaatatctcagaagttgtacattccccgtgatattgttcgtcatatccagggaggcacaggatgacattccattgaatttcaccacaggcgtacacgcacagtgtgatattgttcctaatattcaggaagggagaggatgatattactcccaataaagcagtgggtgtacatcacccctgtgttattgtctctaatatccggggctgggggaggaggggagaggataatattccctcaaatttagcaggtgtcttgatcccccttgtggtgttgttttaaatatccagtggggaagacaatagtactatttttgatagtccgattcatccgctccacctttccggaactctgaggccgggaggcggcatgcagtttccgtgtgatccccaatacctttgccgtcttctctaccaaggcagccaaaaacccaggcccattttctgagccggtccgtaagggcggtcgaaatctaggaatcagatctcgaagaagcacaggggttacttcacgagctttctcagttcatgttggataggcctccacccacccagagtgggtacacacaagaactagtaaatacttgttacctccacactttggcatctctgtgaagtccacctggagatcttcaaagggggctgctccataagctcatatgccgggcggaacagctggacctagcctcgcatcatgctgtcggcaggtaacacaccgctgcctcaccgttttggcaagggctgacaaaggtgagatgtagaaataccggcctaacaacttttccagtgactcctgacctcgatgggtggtttcttgcacagccagtacaactgcagctcctggcagctgtggcacagctactctcccatctggtaaccgaatccatccttcctccatcacttgtcctccctctacctggagaaagtccttttcttctttagaagaagtaggtccaagatcaggtgcctgagggagccctgatgcccagaagggggaagatgctgcttttggagcctctgagtcagtgcgggaattccccaaacccagcaaggtggaagctcgctggtgtcctctgcaatgcataactgccaccttgcggggtttccatactgcttctaatcattgcaagatttcctgttgatattttctgtcttttcccccggagttcaataggcccttttctttctatcatggtccatgcacttgaagggttaaagacatactgagaatcagtgtaaatgttgacagtctcaccctcactgagttctaaggcccgaatgaaagcaatgagttcagctttctgggctgaggtggcctggggcaacgatctggcttcagcaacagtgtccagggttatcactgcataccctgcacctctctctccttgggagttgaagaagctgctcccatccacgtatagttcccagtctactgatgcccaaggctggccccagaggtcaggtctgctagagtcaattgcgtccaacacttctacaccatcaggctcgacagggctctctgatactgggagcaaggtggcggggtgtaggctgttacaaacttcaatggttatacggggattttcacagaataaagcttggtacttggtgagtgtggcattcattagccaatgatgtcctttagtattcattaaagtcaccacagcatgggaggcctttatgttcaggttttgcccaagagtcagcttatttgcttcttgtactagcagggcagttgctgccaaggccctccaacaggggagccatcctttagaaaccccgtctagttgttgagagaggtaggccactggcctcagccagggccccacagtttgggttcaaagtccagctgccatcttttctctctctgatgcatacaatggaaaaggctttgtcatatcgggtagccccagggctggggctgccagaagtttttcctttaactcatgaaagacttgctgttgttgggatccacattccaaaggttcctggtccccgcccccttggtgacctcacacaaaggcttggctaatactgcaaagtttgggatccacagtctacaaaaccccacagctcctaagaattctctcctgccttctgctcttaggctccgctagattgcaaatgacctgctttctttctgatcccgggctgcgttccgacccctgtctgatagtaaatcccaagaaatgtacctgctgtcggcagatctgagctttcttcttggataccttctacccacagtcctccaggtgccagtgtagggaatcggttcccttggtacacccgactgccgtggggtgtcccagcagaaggtcatcaacctactggagcaacacgcagcctaggtctctcctgggaaacttctggaggtctcgagcccacgcctccccgaagatggtgggggagttcttgaacccttggggaagaccagtccaagtgtactgagtagtgaaacctgactccggatcttcccactgaaaggcaaacagcttctgcctctcaggggctaatctgataggaaagaaagcgtctttcaggtccaagcaggtgaacctgctgtcctcagctggcagcaaccccaacaatgtggacggcttaggtactgctggatgtaaagtcagtgtagcttgatgaagcaagtgcaaatcctttacctgccggtagtccttggtccgtggctttggaacaggcaggaggggagtgttccatggagactgacaaggaacaataattcccaaagttcttaggtgcttgagatggacctggataccttgaagggcttctctggggaccaggtcctgtttttgcctcaccggctgggccccagtcttaactggccaatcctggagggttgtcttctgcccctactcttggccaccgcttagccagagctggtcttctctcttggcccggctcagttaagaaaagtctccattcctcctctcgagggaccataagggtcataatgactccagttctgggtaactttagcagcaaagatccatgctctgtcaaagagttagtggctctcagcttgctgagcaagtcccttcccaaaaaggtcaagggacagtcaggtatgtaccaaaactgatgaatgactttatgtcctcctacagtacaagtccgagacaagcagaaagctagctttgctgaaacccccgtggctccgatgacgtcaatagtctttttgaataagggggcgaccggggcagttactagcgaatgttcagcaccgctatctacaagaaagtcaatgtctccacccccgactgtcattctgagcagaggctctttggggacgcttgagccgggtctccctcagtccaagaacccttctgccaggttgagcagggccccttcctccttgtccagggcctcctgctctgagtcaccttgttttcttttgagctcagggcatttgttcttccactgtcctatttctttacaatcagcacactggttacgctgcaaactctgacagccaagctgagtttctttcccagggccccccttcccttgcctctttgcgggggcccctctgattgctgcagctgacaaacaggttggcgtgtcaccgggcctgacctccattctctttgccgttttccttagggcttactgcatccctgtttacaaacacctggctagctatttctagtaattgtgatggattcatccctgcaagcccagcctgtttctgcagttttcttctcatgtcttctgcgctttgatggactaaagccatgtgaatcatgcactgattttcagggctatcgggatcaaagggagtatacatacgataggcctcacacagtctctggtagaattgtgctggactttcttcttttccctgaatgacctcagagagcttgttaacatttgtggccttctgagctcccctcattaatccttccaggagagcttccctgtctcgctttagcctttgcatatcctctctttcatgtgggtccaactgggggtcggttcctggcaactgggtccttccatactcttgggggttttgataatcagctggtgcatgttcctctagccacttagctgctgcttggcggactctccgcctttcttcgctgttaaagaggaacaggagcaactggtgccaatcagcacaggtggggttgtgggtctggataagagcttggagcaaatcaattagggcttgtggcttttcagtatagggcggtgtactgtttttccagttgagaaggtcgacgcaggtgaagggcttgtacccaaaaacacgcttctccaccacgtgaccatcctcatctatcccagtataccgctgctctctcaggggcatttgtgtccccgttttggttggtaaacgagctgccgagggaggagtggaatgacacaatgtgacttactgcaattaataatctccattattaattgacactagtaattatcaatattaataacccataatataattttaaaaatcaataccgataataatgataattaatattaaatagttatactaatgataacaatacatgattaatattaatgattaatgacacctgatattaataactgatactgaccttattaattagaaaacagtcatattagctcctaataagtaatattaatattaataatgggaaaacattttattagcaattatttcttaatatgaatattaatatcggtcattcatattcatgttaataataaatgaggaataattcatactaatattacgccctaacacctcagtgggtgtacaccaacatgtgatattgctcctaatgtccagggagggagagagcatgatattacgttcaatatcgcagtaggtgtacacccagccggtgatattgatccgaatataatctccagggggtggagtatgacgttactcccaatatagcactgggtgtgcatccacctggtgattttgctcctaatattcacggaagaagagaatgctattactcccaacatcgcaggaagtgtacacccccgtgtgagatggtccttaaaaatattccaaggcggagggggtgatatgactacatatatggcagaaagaggaaaccaccaaggatattgttcccatgatcctggagggaagaggataatactactttcaatattacagaaggtggacacgcccccaactgatattgtttgtaattgcaatctgggagaggaggacctgacacccgatatcccagggcgtagaaatacccctgtgatactgttccaaatattcagagaggaagaggatgatattactcccaatacagacgggggtacaacctctgtacacccagggtgtacaccggtctgtgaaacagttcataatcttcagaggcggagatgatattactcacaatatgataaaaatgctgtgagtccaccgcgggtcctaagagccaggggggcaagaggggctggctctttagtccccgcatcgtgtgggggggcgcggcgcccccctgcgatgggggtcctaagagccaggggggcaagaggggctggagaggcgggtgctattagtccccgcatcgcggggggcgcctcgcccccctgcgatttggatcgtaatatccggggaggagaggtgggtgctattagtccccgcatcgcggggggcgcctcgccccactgcgatttggatcgtaatatccggggaggagaggcgggtgctattagtcccagcatcgcggggggcgcctcgccccccttcgatttggatcgtaacatccggggaggagaggcgggtgctattagttcccgcatcgcgcggggcgccctcacccccctgtgatttggatcgtaatatccagtggggagaggcggttgctgttactccccgcatcgcggggggcgctctcacccacctgcgatgtggctggtaacatccagtggggagaggggctgatattactccctttctcctattttgttttctctactgtcacacttacttaacaccctgggacattattttccatattctaggatggtgtcactgtttaagtcccaggggttatacaccctgtgatattattcgtggtattggcgcgaaatgtgagtccttatttcacaagtctctacacactctgatattattcgcaataccctagcggtacgttgataataatgccacaatatgtgtacagcttgtgctattattcttaatctcctaaggggaagttgattttattgtcacacggagtattttccctttggtatgattcggaatatcctggaggcatgtcactccttatgtcacagggtttgtacaccttttcaaattactcgtattacccttataagatgtcactcctcatatcagtgagggtgtacactctgtgatattatcgtcatattctagggaaatgtttcttttaatgtcacagatgttgcacaccttgtgaaattattcgttataattttgtttgatgtgactgctaacgtcacacggggtgtacacatagtgatattacgtgtaatcttctatagaaatgttactcgtaaatcacaggtcctgtaccccctttaatattcttcatcttattctaggaaaacgtgactactaatgtcacagggcgtgtagaccctgtcataaaattcgtaatatcccagcgggagttcactactaatttcacaatgcgtgtacaccctttgatattgttcgtattatcctaaagagatgtgactactgatgtcccaatgcatgtacattctctgatattattccttatatcctcgggggatgtgacttctaatgtcacacggcgtgtagtccctgtgttctatttcataatatcccagggcaattgtactgttaatgacacagggggtgtacacattgtgatattattcatgatattgtagaaggatgttactcctaatgtcacaggggtgtacaccctgtgatagtattcataatttcccaggggtctatactcctaatgtcacagaagataacacactgtgacattatttgtaatattctggtgagatgattctcctaatatcacaggaggtgtataccctgtgatagtattcttactattctagggggatgtcactcgtaatgtcacaggtgtcttccttctgtgatattattgaaaatatgctagctggatattactactggtgtcacaatgtgtgtacaccttgtgatattattagtaatattctggggggaagatacccctaaagttacaggggtgtacaccgtgtgatattcctcccaatattgtagggggatgttactcctaatgtcacagggggtgtacagccttcgatattatttgtaatcttatagagagatattactttaatgatcacagtgggtgtacacacatgggctacacccactgggatattatttgtaatatcttagggagatataactcctaatatcacagtgggtgtaccccatgtgtgtacatcctgtgatattatttgtaatatccattgtaaacattacttctagtatcccacagagggtacaccctgtgatatttttcataatatcatagggagatactgtttctaataaaacagtgggtgtacaccatgtgtgtacactctgtgatgtgatagcttatatcctagggagatattccttctaatctcacagtgagtgtaaaccctgtgacatcatacgtaatctcctagaaagatattgctgctaatatcacagagggtgtgcccccagtgacatcatttgaaatatcctagggagatgttactcgtaatgtcacaggggttgtacaccctgttatattattgtaatattctaggggggtgttactttttaagtcacaggggtgtagaccctgtgatgttattcgtaatatcctaggaaggggctactcctaatatcacatgggttatcctaggaagagcttactcctaatatcacactcctaatatcacaccctgtgataacattcggaatatccaaaagggatgttacttttaatgtcacatggggtgtacaccctttgataatattcgtaagatcctagggacatatgacttcagatatcacattgggtatacacacatggtgtacacattgtgtgtgaacacctcctgtgatattatccataatatcctaggaaaatgggactcctaatatcacggtcagtggacaccctgtgatatgattggtaatatcctaaagagatgttaccactaaggtcacaatgtatgtacgccccctgatattattcgttatatccttggcggatgttactcctaatgtcacacggggtgtactccctgtgatattattcgtaatatcctagggggatgttactttcaatgtcacctggggcgtatatcatgcgtattcaacgcctgtgatactattcctaatatcctaggggcatgttcctcctaatgtcacatggggtgaaccccatatgtgtacacctgctgtgatattattcgtaatatcctaggggaatattctcctgatggcacaggagatgtacaccatgtgtgtcaaccacctgtgtcattattcgtaatatcctagggggatgtttccttgaatggcacaaagtgtgcgcaaaaggtcacagaaggtgtgcaccttgtgatgttatctgcaataccctagaaggatgttactcctaatatgtcacaggggtgtacacactttgatattatttgtaatctcatagagagatatgacttcaaatatcatggtggatgttcacacatagtgtataccctgtgatattattcataatatcctagggagatgcaactcctgatatcacagtgcgtgtacccagtgtgtgtacacccttgatatgagtcgtgatatccagggtaaatatgactcctcatatcacacagtgtgcacaccctgtgatatttttcatcatacttatagggagatattgcttctaatatcacagtgggtgtaccccatgtgtgtttactctgtgacaatatattctatatcctagggaggtattactcgtaatgtcacagtgggtgttcaccctgtgatatcattcttatttgacctcgctgcctttttgaacccaccctacaaaaggaatggaacagataagaagatattgagattagactgtgctgccgtgcggccgccgcaggacacttttaatatccctgtttctcaggctgtacatgaaggggttcagcatgggggtgaccaccgtgtacatcactgaggccactgcactctttcttggggaagatgacacatctgaaccgaggtaccctccaacacctgttccacaaaatcagcaaacaactggcaggtgagacccacaggtggagaaggtttatacttcccacctgatgatgaaaccctcagaatggaggaaacaattttacagtaagagaaaaggtccccaagatgggaagaaaaccaaatacggcagcagggaaatacaggttgatgttcctggtgaaggtgtcacaacatgcaagatgggggagttgagaaggttcccagaagaaattaggaattccacatccttgaagccggtcatttgtaaggcaatcaagttgtgcagctgggagtctaaaagactgagaaaaacaaaacaaaacaaaacgaagacaacaaatctaggaagccacagaaacatgggttcaagattgctgaacgatatagagggtgacagatggctacaaaccggccataggccatcacactcaggagcatgtctctcttccatgcctccaaaaatggcaaagagagacatctgagtcaggcagcctgcataggagatgactctgctgtgagactggatgtccacaatcatcttggggaccgtggtggaggtgaaaccgatgtcaggcaagggcaggttggaaaggatgaagtacatgggggtgtggaggtgggagtcagggctgacggccaggatgatgagcaggttccccagcactgtgaccaggcacatggacaggaacagcccagcgacgaccggctgcagttctggatcctctgagagtttgaggaggaggaatatagagacatctgttagactatgtggatctgtatagtttggacaccttttgcctggaaaagagggttgaaaaatcagaaacaagtaaaccaatacccagcattgtgtctgcattttggatataagcaattcacaagtaatgttttcagatttcagagcaatccacactcagcaatattttgtagttctgacaagctcaattgccttttaatgctttcaacatcgattgctgtgttattcacgtcttgctgtacacacttgccttagagacactagcttcaagaacgttccaagaaccagctcatcatataacaaattcgtaattgctaggaaatacagcctatcttttccgaagaacaagatgtaataaaaccattgtcttcactttaagaaaaaggttatcctaattaaaggaaattaagaactcaaatattttatttattctactagatggatacaaattcccttgatttagaacatttgtaaacactgtataacagctgagaccatgccatctggaaatgaaatgaaagttgatagttcctaagaagaaaatagttccacatgccagttaggtcctagtgatttcatcattgtgttttcggacttttctccttcgagagagtaattgcttactcaaatcggtgggtcttgttttaaaattcatggaagctctaactcctgtccttagcttaggtggacttagagttttcatcagaaagtttggccggacacggtggctcacgcctgtaatcccagcactttgggaggccgaggagggcggatcatggggtcaggagatcaagaccatcctggccaacatggtgaaaccccgcctctactaaaaatacaaacacttcgcccggtatggcggcgcgcgcctgtagtcccagctacttgggaggctgtggcaggagaatagcttgaacctgggaggcagagactacagtgagctgaaatcacaccactgcacgccagcctgggcaatgagagcaaaactccgtctcaaaacacaaaaagaatcaagtaagtcaaagtcacgctgatgacagccaattttgatgaagcaaggaagagtcaattcaaccattaacatagattttgacttttgctgtctcctatgtgccaagaaagatataggctctggggaatcagaaaccaaagagactcacttgttcctctcacagtactcagcacttactgatagaaggacaaaacaaaatgtcctgtctggaatgcagggaaaccagaacttcaggtcaggggatatttccgttgaattgtgtggagttgaagctgaaaatcttaaggaatgtatcaaaaattccctttgcctttaatttatgcatccgtcacctagagatcacgcagcgggcgcccacgatcagcttaatcatcactcacttccatcggatgaactggaaatcaagtcagatgagagtgctgagtctcagaggatggacatttcaccccttgccatacagagaagtagaaagggtggtattcaaaattcatggccagactcgaagtcccgggtactatacttcctggtcttccaactctcaaaaagttgtgggtttttttggtttttgtttttgtttttggtgttttgagacggagtctcgttccgttgcccaggctggagtgcaatggagtgatctcggctcaccgcaacctctgcatcccaggttcaagctattctcctgcctcagcctgccaattagctgagatgacaggcgcccgccactacgcctggctcatttttttctattttgagtagagacgtggtttcaccatgttggccaggctggtcctgaattcctgaccttgtgattcgcctgcctcagcctcccaaagggctgggattacaggcgtgagccgccgctcccagcttccaaaagttttaagcagagctcagagatcttaaccacgggcacattggaggagcatttttgaaacgctttccagcttcctcaataggaatggaaaccaaactccgaattgatgactcctttgaggaagccgagagctgtaaggaaagccaggaacaggggcaagggagagatgcatcccgaatgattgctgtgccaattcattctggaatcctcgatgtgatctcagctgccctttccatacttgacacagtgattgtggcaccaactggtctagctgtggtctacaaggaacccccaaagggaggggcacagtgagcaggggcatccgcctgagtgacgaggatttgagagggcaggttggttgcagggagaggactggccaaatgccatgtgtctggacttaggctgcctggttcaaattggacttcaccctttttgacttcacgatcgagtacgagttatatgaaaagacgttgctccttttctagtctgtaaaatcatcctgaaatgtgcactaataaggtggagactacacagatgaaatgaaacaagctgcatagagcacagagctcagagcctggcctttaggaagccctcagtaagggttcatgatgccatggtgtctgttgtcatcctctttatcctcatcatcaccttcataatctttttgttgttcttagggaatagtttagatggactgattccctgctatcatgggtgagatgtctatgaaaaggacaaccagtgggggaggaaagcaaaattttgaataagatttctgagacccccagcacaaccaagaacagaaactgcacagtctgctgagcggacagtttgcacattggtctcctcccatctgcccaccacattctcctgtttgtcctgaggaggaggaaaccaaacaaggctcccgaccgtccctcaacactcacttgaaggggtggcctggccctccacacctgtgggtatttctagtcgggtgggatgggagactgaggaaagaaataagacacagagacaaagtatagagaaacgacattgagcccaggggaccagcgctcagcataccaaggatctgcaccggcaccggcctctgagttccctcagtttttattgatgattatttttattattttagcaaaaaggaatgtagtaggagggcagggtgataataaggagaaggtcagcaacgaagatgtgagcaatagaatctatgtcataatgaagttcacgggaaggtactatgactggacgtgcatgtaagccagattgatgtttctctccacccaaacatctcaatggagtaaagaataacaaggcagcattgctgcaaacatgtctcacctcccaccatagggcggtttttcccccatctcagaattgaacaaatgtataatcgggttttataccgagacattcagttcccaggggcaggcaggagacagcggccttcctctccctcaactgcaagaggctttcctctttgactagtccacctcagcacagaccctttacaggtgtcaggctcgtggacggtcaggtctttctcctcccacgaggccacttttcagactatcacatggggagaaaccttggacaatacgccgctttcaagggcagagctccctgaggctttccacagtgtattgtgcccctggtttattgagactagagaatggcgatgacttttaccaagtatactgcttggaaacatcttaacaaggcacgtcctgcacagccctagatcccttaaaccttgatttcatacaacacatgtttttgtgagcttcaggttgggtcaaagtggctggggcaaaactacacattaacaacatctcagcaaaacaattgttgaaagtacaggtctttctcaaaatggagtctgttatgtctttcctttctacatagacacagtaagagtctgatcgctctttcttttgcctacactcactgaactgcccttcccctctgctgggccatgaccacggagaataggtccactgtcctccctgcatggtgcacgatggatgctcagactccatcctcatggctggcaagaagacagagtgagacatgagcctcctgatacaggtgatgtctctggagcccacaggactgcaacctcacactgcagggctggaggcacagactgagtatttactgttctgtggcctgggggctcaaggcacagagctcctcattagccaaagtcacccaaattccccaacctctaaggatttcctcatcatcatgtaagaagaagaagagaaaatgattgtccatagaagctttgaggctcttcttctaatcaggagaaagctggtgtgtattattcgcttctttcttttctttttaaagatccaactgctttaattttcatcttttattatgggaaaatataccacgtataaatattaaaaattataaatatatattagttcatatagaatagccagtataaacatttacaatttccaccctttttcagtttacagtttcatgacattaagtacgttcacattgtttagcaaccatcaccgtcatcatctccggaacagttttatttttcaaaatggaaattgcacccattcaccaagctctccactcctctctctcgcccacccctgggggccacctttctggtttgcaactctaggagtctaactactctagacacttgatagataagtggaatcataccgtgtttaattttttttttttagatacagagtctttctctgtcgcccaggctggagtgcagtggcatgatttcggctcactgcaacctccacatcggggttcaagcaattcttatgtgtcagtctcctgagtagctgggattgcagacgtgcgctatcacgcccagctaatttttgtatttttaatagagatgagctttcaccatattggccaggctggtctcgaactcctgagcttaagtgatccgcctgcctcagcctccgcaaatgctggggttacaggtgcgagccactgagcctgggcatgtttatccttttttgatttatttatttcactgacgataatgtcttcaatgttcatccatgttgcggcctgcatcagaagtgcctgtttgtttttgttgttttttttttaatttggttttattttgttttgttttgcgttttcatggagtctcactctgtcgcacaggctggagtgcagtggcacaatctgggctcactgcaacctccacctcccgggtttgagcgattcttgcgcctcagcctccttagtagctgagattacaggtgcgtgccaccacaccagctaatttctgtatttttagtagagatggggtttgccatgttggccaagctggtcttgaactcctgagctcaggtgatccacccgcctcaacttcccaaagtgttaggattacagacatgagccactgtgcccagcccaaggatgtgtatattttctatagacttttgatgataatactttgacagcaaatatattgtgactatctatatatcatacatatatatatatatatatatatatagagagagagagagagagagagagagagagcgtgagagggagagagcaagaaagagagagagtctccctttttcacccaaactggagtgcagtggcacaatcatagcgtgctgcggccttaaatttctgggctcaaacaatcctgtcacctcagcctcctgagtagctgggactacaggcatgtactaccatgcccagctaactttttattatttttttttgtagagatgaggtctgactgttttgcccgggctggtcttaaactcctggctaaaagtgatcctcctgccttggcctccccaagtgctgggattacaggtgtgagccattgcaactggtgtgaagctgggattgcaggtgtgagacatggcatctggtgtgaatatcgcctggtaaataccttgtactttcactttcattaagatgtctttcgacctcatgaaattatctgaaaaacagggatgaaacactgttctgctccatcttccctgcaggcacttgggccccatcctgctctcttgcccccctcttctagtgaatggccagataggaactattgcaggtttatgggccatgtggtctctgttgcaaatataacagctctgctgttgtagtgcaaaagcaaccacagcccatatggaaaccatctttcctgcatggcctctgtaatcttttagaaatacccgttgggtcacaccactgcctgacttaaaacgtatagatgacctcttctgtctcctaagctattaggttggtgcaaaagtaattgctgtttccattaaaagtaatggcagaaattggctgggcatggtggctcacacctgtaattccagcagtttgggagaccgaggcaggtggatcacttgaggtcagcagtttgagatcaacctgggcaacatggtgaaaccccatctctagtaaaaatacaaaaattaaaattagctgggggtggtggcatgtgcctgtagtcccagctacttggggggatgaggcaggaaattggcttgaacctgggaggcggaggttgcagtgatgaagatcacacctctgcactccaacctgggtgacagagacagactctgataaaaaaaaaaagtaatggcggaaatcacaattacttttgcaccaacctaataaaagtcaagtcctgaccacagcctaggaagccagctatgacctggcccttgtcaccctctccaagttcaactcccgagaacttccgtttcctctctgctccccgctccggcctcccattcctcactcgtgttgcatcagatgcctgcgcaccctggtgtttccgcatgtcctcttctgttagcctggaaagttctttcctccctcttcatccagcactactagatacctccccctgccttagcctagccaggtcccctgtcatttagtctcagagtatcttgaatgtcttcttcacagcccaacttacaatcctcactcactcgctgagtgggtgccatcctttctctccacctagaatgcaagcttcctgagggcaggggctggaaccatcttgttctttgccaaatccccagtgccatctctggcacaaagtgggcattatgaaaatatttgctgagtgcataaaaggagggaatcatggatttgagccctcggcttggtgccctggggatgtggctccataaaatcagttcccatttttctctctcctcttctcctgggaggtgggtgtctgggttctcctgccaggagagcttctctctcaaaagactgcaggtgcctcttggcctaggcctgcctcctgctaagtgagactctttagggctagtctgcatcgactctgctgagatgcagccaccagatgggtaacgtgcgcaacccttggaaggtccctgggaacgaggcttccgagtcatctggatcaactagtttgaagttacaaactcaccagatgttggtcagctggaatcttagtgatgagctgctccgacccctcctgttgtagtcaagtcacttgtgcaaagccaccacttggctgggaccccaagctcaggcctggactctctccttggtcccaggctttacactaagggaatgtcaactgttctgtagaatcacttggactactttatacttttgtgtctccttttcctattctgtattctggaaaaacaaacttttccttgtgattgaacagaatcttcacactgtgttgttgctggcattgttctaaatttagcctcggttcatccccagctggagtgaatgactttaatttgatcagctgctgtatgtgcttgggagcctccgaagggcgacctgtggcctttaaggcccctttccacccttagatcctgacctggggcaaacacacactccagctcgttcatgtccagataagacacccagaggccatggcgagggttccctctgtaggggctctattgctgttgagaggatcaaggcagcagtcagggcctgagggttgtccagaagaaagcacaaagcataccgagcgctggtctgacagcacttaggagtgtgacagaaaccttctgtcatgggaccagagattggagaccgtgggaacacatccgaacccacatctccgtgacaaggtggtgctgatttccagtggtcctccctggtggggaaatcacgtagctctgactctggagcgtgttgttgtgtttctctttcagtatgagcttgtctgtggccctagagttcctcccttatgaaataatgatgcctcccaacacaggatatcccaggctgcaagcctgtcccttctgcccagcttccttacccctgtgcccccaaagcccacagcagggcctgccagaggctgatgacatatctgtcactgtcccaagggggcaggggcagcgacggagtattaggccacaaaaggcatgcctgcaggcacatatgagggaaacacccaaagccagacgtcaatgaaacagtaattcggtggaataggagaggtcatattctcatgcaagactgtctaaatacataagtctccttgggcacaatctgccaggggacaatggttcatgccgagacagctattacaccgccttgctaagaacttccaacacacacttacacacacacatacacacgcacatatacaagcacacacacatgcatacacacatgcacccacacacacacatgcaagcacatacagatacacacgcacaaacacacatacagatacacatacatataggcacacacatgcacacacacagatacacacacatgcacacagatacacacatgcacacaaacacacgaaggcacagacacatgcacacaaatgcacatgcatacagacacatgcacacacaggcaacacacacgcacacacatacatacacacaggcacacacagatatacatatgcacacggagacacgcatgcatgcacacgtatgcacacagacacacatatgcacacacatgcacacacacagatacacatgcatgcacatacaggcatacacatgcaaacacatgcacacagatatgcatgtacacacatgtacacacatgcacacccatacacatgcacagaaaaacacgtacacacacatgcacacacatgcacacagacacatgcacagatacagacacacatgcacacacagaagcacacacatgcacatgcacactcgcacacatgcgcacacacatgcacacatgcacacacatgcacacacatgcacacttgcacacgtgctcacacgcatacacacgcacacacatgcacacatacacacacaccactccttttccatttctctaatttccaatttttttctatgagcttcctcagactcatgatcttgattctagaatgaattcagggagtaagtgtgtattattgaaataacagtaaattcaaacatgcctaagaacctttttgaatgttggggaaaccacctcacagatcattcaaatgacccgagcagacacttcaccagggacccttggacatctccctgtcccttctgccaacctctgtgctttaatatcaggggacaaacctctcgattttggtttctcatctctgtgtccccatgtacactggactgcactactgtgtcaaagctacttgcagcctgacctggcaaatgtacttttggattcactcgatttgccacctatttgggtggtttgggctggaaattgccctgctcacactcttggctcccagctgctcctgctttgggggtgcctagagaccccagctcatcccgtgggtcatatccccacagtggggccggggatgtgactgagagttgtctgggcacctctctccagcagcattgaggatggcgctcagcactgtgtgacgttggctggtggccactgcctgtttaggtcgaaatggcccagcctgatgtccgcatgcacctctgcggcacactggcctgcagacccccgagcatatgctgcatgcttctcacctctagagtggccacccagacagcgatacagacataccaagaaaacccacaggcaagcccagaggtgcccgttctactagggccttgtgagcctctgtgatttgagtcatgagcttcttgtggtgatttcacttagctaacatccaacacattgcatttagaggctctttctcttggacattatatggaggcgtggccatggtttgctgagataaatgtcccaaaacacccctcaataaaaccaaataacagctcatcaaccccttacatttaaaaaaaaattgacatcttataaatagcaaatattggatgacaataaggcacaggaaaaagctcataagcccagaacagcagtcatcattcaattgttccttaactactgactgtgcacctgttcagtaccagcaccgcatcctagatacagggataccacacgaaataagatgacaaagcacctgcccctgtggagctgagccactagcaggagagacagtcactaaatgaatatctctatcctgtggtttctgggaatgacagtcacataaaaggatagaaagggatggaggaaagctaatttagacaactcaggatcagaatcgggaggtggttgcatccctcaaaattcagagtagctggagtgcaagccttgtattagctgagcctgaatcctggccctgccgttgtccatggtgtcctcaggcaaatggctcaacttctctgaccaccggcttcaagtgcagaacaggagaccagagtcccatctctcagggttgttgctgtggactgaattgtgttccctccatttcactcattaggagctaattaacgttaaaggaggtcataagagtggaatcctaatctgataggattggtggatttataaaaagaagagatgtctctgtctctctccctctctgccatgtgaggacaagcaagaaggctgctgtctgccagccaggaagacagcccttaccagaaagggattggtggatactttgatcacgaacttctggcctccagatcagtgacagaaaatcaatgtctgttatttaggccatccggtctcgggtactttgttatggcagctaggctggctgaggcagttgttgagaggaaccgacaaggtagttggggtaaagcacacagcacggccacagctcactgagcacaatgtcagtctcatttcccttcaattgttattctctgtctggaggattttcatgatggcttttctccaagaagctccctggggtctttgtaaatatggggatatttctgacaagaaaaatccttacggttcttaacattgacaatgaccaggaacagcaagacatgaaaatgagaaggtggctagaaaagagaggacccacagaagaaaccaacaaccacacaacacacacacacacaggaggaatcctaatgcaggaggagaatagaacatcaggggaccccgagactgaactctgcatctcatgtattgagatcattccctgatacggtttggctgtgtccccacccaaatttcatcttgaattgtagctctcctaatccacatgtgtcatgggagggacgtggtgggaggtaattgaatcattgggtgggtctttcccatgctgttctcatgatagtgaatatgtctcatgaaatctgatggttttataaaggggagttcccctgcacaagctctcttgcctgctaccaagtaagacgtgactttgctcctcattcaccttccaccgagattgtgaggcctccttaaccatgtggaactggagtccattaaacctctttcctttataaattacccagcctcaggtatgtctttattagtagcatgagaatggacaaatatattccctaagcctctattttcctctgagacaggcttaaactgaatagccccatctttgcaggccttaaatagtaatactgttatgtgttatattaacatgtattttattgaaagtctctggtttttgtctctctgaacacaggcaggccttgctgaaacttgcagatgacattccaaaatgcattctatcttaagataagcagagagggtggtgaggaaaaattgtacataccttcccctcaatgaagaggtccccgaggtgtggccggccttggtataagctttttggctctgttaattcatgagggctgagtctgattgatcctcatggggaagactaacaaaggaatccttgcaaccattaggaataacactcatgacccagaaagcggttctgtcttcatggggcatcatctgtcttgtttactgagtgaccttctggctcatttttcttccagccagggttggaattcaataatcctagttccttcccaaattttagagctgggaaatgcattcctcaggtttctacttttcaaaagcgaagaatatctgtggagctcaactcctaaatagtgtgactttgtctgtttatgtggttctcttgctgactgcctggttgcgactgtgcctgaactcaggcctctgtgtttctgaatcttagaagcggtggttggcatgtcaaacttgaagtcattgtcctttagttatctgagtgttataattgaacagcacatttattaacaagactttagtaaatccatcagcattctaggaatctttgattcattgacctatctctaatgtaagcaaaggctgccagagagttgctaacaagaattccatctttcctcagaaccttcagttctcttgggtcgaagttgatacctgtttcatgaaaaatgcaaacccaattaattacagctgttcatagtatgcctcttctaagagacctctgctgttcctaccccagggactgccagaataattaaaagtcacagaaatcaaacaaatgggcctctggctaaattatagaagattaacccaggaagagcacttattaaatagtaagcagtccccaaaaatattaaagtacaaaaaggattagaaattgttttaagcattggttccaacttcaggtgctggtcttccactccactgtggaagggaacaaatggattttcctgtcctaaagccagtgacattgatcacgccccttggaggcttaataacatctcactttattttattttaattaattaattatttatttatttttgagatggagtttcactcttgttgcccaggctggagtgcaatggcacgatctccgctcactgtaacctctatctcctgggttcaagcgattctcctgcctcagcctcctgagtagctgggattacaggcacgtgccaccatgcccagcaaatttttgtatttttattagagatggggcttcaccacgttggccaggtgggtcttgaactcctgacctcaggcgatctgcctgcctcggcctcccaaagtgctgggagaacaggcatgagccaccgcccccggccaataatatctcacgttaagcatggagttgctgtccactgtgtggccagagagaaaacaaactgccattacagagggaggtggtattgggctactttttttttggaaacaacagcaaaatgtgaggcaaatccgcttttagatcctggttacactgctggatggagcttagcaagcctgtgatagggtagcctggtggtggcttgggggattcctagccatgtcacacaggacagatgcctttgaggagagatggcacagcgctggctctcaggcccccattgcagggggaccaggctgtttatggatcgggtgggaaccctgttagaaaaataagtggaggctgggtgtggtggcccacacctgtaatcccagcacctttggaggatgaagtgggtggattgcttgagcctgggtgttcgagaccagccagggcaacttggcaaagccctgtctttagaaaaataataataatagttaattaattagttaatttttttttaaaaaaagaaacagaagtggagctaaggaacacagagcctgccagaaagccaaggtggccagctagaaggacacagaagaacattaccatagttctctctgagcatttggactaggggtgctttcatgtggttttcatatcaaacatactttatttttatacttaggggggaaagacctaatacatacaataaaggtaacacgagacaaaactctcaccaaagcctcacatcttagatgctctactgggtctctgcaatttctattaggggccccatgggtttgaattccattctagatttgataagaaaatccaaatgctcaaccccgtcaaccccccccccacccgtccaccccatttacaaaagccaagtgaaaactaaggaggggccgggtgcagtggttcacacctgtaatcccaccactttgggaggctgaggtgaggggaacacctgaggtcaggagttcgagaccagcctgactaatatggtaaaaccccgtctctactgaaaacacaaaaattagcaaggtgtggtggtggacacctataatcccagctacttgggaggctgaggcaggagaatcacttgaacccgggggcagaggttgcagtgagtggagattgtgccactgcactccagcctgggtgagaaaaagtgaaactccaaagaaaaagaagaaagaaaggaagaaagaaagaaagagagagagaaagagagaaagagagagagagagggagagagggagggagggagggaaagaaagaaagagagagaaagagaaagaaagagagagagagagaaagaaagaagaggaggaaggagaagaaggaaggaaggaagaaaagagagagagggagggagggaggaaggaagggaggaaggaaactaaggaggaaggtggcgtgtacagaggtacagaggccctcaggtcctagctggccctgggtgacaagagtgaaactccgaagcaaaaggaaggaaggaaggaaggaaggaaggaaggaaggaaggaaggaaggaaagaagtaaactaaagaggaaggtggcatgtacagaggacctcaggtcctagccggcactggcacctatgcaggttccaatgggctgagctttgcaaaagttcattgtgtaacccaggaagcccaaatatatttctgagcagatgtcttttcaaagtgattttccttttaggaagtgagaggagaatgaaggggaggtttttcctacttctgatgttaaaaaagtcaaaacaaaataaattggtgttcattgcaactattggccaaagcactatcatcaccaggacctgtacctcaaacacacctcctgacagccccttccattctaatcaaggtatgcccaactgtggtcacccaggggctgtttacctttacttaaagagaaatgctggtagtaagccataaaaattaccatattcaccatctttctgcttcaaagaaggttttagattagcaatggctggatcaatcactgtgagtatgttcttgggaactaaaagccaagaagaaatattttaaatatgtggtatatttttaaaatgtggactcttaatatatttttaaatgcaatgtagataagattttaaaatcactttccaaattggtgcaggagtcactccctctccctgttacatacacatacatacacacaacccaatggcatccacgtgatcatcaaatgctccagagaggtgggtttaggcccaatttgcaatatttaaaaaatggagaataaaaacaagatatgatatatccatccagcagaatacacctcagtaataaaaaggaatgaaaagctcggcatggtggcttacacctgtaatcccagcactttgggaggtagaggtggacagattacttgaggtcaggagttcgagaccagcctggccaacatatttgaaaccccatctgtactaaaaatacaaagttagctgggcttggtggcacaaggctgtaatcccagctacttgggaggctgaggcagggagaattgcttgaacccgggaggcagaggttgcagtgagcgaagatcacaccactgcatcccagcctgggtgacagcgtgagacttcaactccaaaaaaaaaaagtgaagtactgatatgatacatgctacaacatggatgaacctctgaaacattacattcagttaaagacgtcagccatgcacacacacacaaaacatccattgcataattccatttgtatgaaatattcagaaaaggcaaatctagagagaaagtagatgcgtggtgtcctgggactggggggttggaaatggggcagtgatggcaaatgggcacaagggagcttcgggggattgtgaaaatgttttaaaactggagggtagtgatggttgcacaactctaaatttattaaaaatcattgaattttattcatgtgtaatagaattttaagaaaaataaacaacacctcaatagagtggttaactctgggccgggcatggtggctcacgcctgtaatcctggcactttgggagtctgaggcaggtggaacacttgagtcaggagttcaagaccagcctggccaacatggtgaaaccccatctctactaaaaaatacaaaaattagccggacgtgctcacttcaacccaggaagtggaggttgcagtgagctgagagtgtgccactgcactccagcctgggtgacagagcaagactccatctcaaaaaaaaaaaaaatatatatatacatatatatatatacacatatgtatatatatacatatatatacatatatatacacatatatacacatatgtatatatacatatatacacatatgtatatatacatatatacacatatgtatatatacatatatacacatatgtatatatacatatatacatatatatatatatatatatatgcacacacacacagtggttaactctgaagatgagcttccctggacttagtaaagcaaaatgactgtgaccaactcaaaatccaccattaaactctcccagcacctgctcttctgctttctaccccaagctctttgcctctgtgtttccatcgtaaatctggaaagaattcgaagactctgtgctaaagtgatttgctaaatattatcagaaaggaagacagaaagatgcagagaggatggcagcgtgaccgactcctttgaaggtggttgaagactctgctgaactgacgctaagagtaagccctgggatgtcagaacccccaggcaaagcagctggcagatgacaacacccgctgaaacagagggcagagcaagaattctgcaggccaagcacactgccgcaggctgggagaagggagtggaaaccaaatattcctcctgcataaaattgcttatttttgtttgttcctcagcccagctgagatcttggagaagtagcaacaggaaatggaaagaaagcaaaaacaaactgcaaattcaattgcactgctttttaaaaaaagaacaagtgagacatcttcagcagcaagaaaaccttgtttcctttcttggagggcttaactaaattcttctggggatgtcccaggatcaacaaccacaggacattcctagattgtgagttttccaggtacaggaggccctggtgccttcgtgcccatcagcagcaagggagacttcccagggaggcccggtgaagctgctggagttggctgatgatttccagggcctcaaggaatgtcccttggctgtcctcagggcacaccactgatcctgggaccatgacagcttcggagagctgagctgagctgagctgctgcaaaatgctttctgctttaattgcctctcattcatttctgggccctgagaaggatgcagtagcccgggaagtgtcagctctccctgccaggggtgggacttctttctcatgtctgcctcttggcttgttctcaaactgtggcttcaggagggccttggctcttggcaaatgccagaggctttacagtttgagaaagaatcagaattttgaagaggagctcagagaggaaggtcattctaggatgcactttgcagaatcaccaggcagtgaaaaggtgaaattggctgtgtatgacacaggccactgcagggaatgtgcccctctactatgtgaaattggctccgatatccagagaatcttttaggacctttaaaatcaccgttgtcaacacacttgtcagatttttgcatctccttgtttcatactgttttagaatgaggtcggggactggggtgtgattgatcaccgtcctgctccacttcagatatgttggtgaaaacactagggaccactcttcatggagctcctactgtgtgcaggaccctgttctcagcagtttaaaccagggccatcttcctccttatcaatacctttcctctcccactcagcagcctcagcgtctcagcccctagtgtgcagctagtgcacataccctagtgttcaccgtacaggatggttctctttggaagacttaaaccaccaacccaagctaaattaggccccctccactgctatagtcttcttcccttttctaaaatagcatttgtcacaatagggcatgatgatgtgtctggctatttggttaatgcttgcctttctccctcaactgttcaccccatgaaaacaggatggtgtctttttttttttttttttttttttgagacagagtttcacccttctcacccaagctgagtgcagtggtgagatttcagctcactgccatcacccaagctgagtgcagtggtgagatctcagctcactgccaattccgcctaccaggttcaagtgattctccttgtcacagcctcccaagtagctgggattacaggcatacttcaccatgcccagataattttgtatttttagtagagacagggtttcaacctgttagccaggatggtctccatctcctgacctcgtgatccgcctgcctcagcctcccaaagtgctgggattacaggcgtgaaccacaatgcccagcattagtttagtttttcagagacagggtttcactctgttacccaggctggagtgcagtggtgcaatcatagctcactgcagccttgaactcttgggctcaaacctaggctcaagggatcctctcgcctcagcttctcaagtacctgggaatatatgaatgcacaccatgcccagcttacatttatttgtttaaaagacaagaaagaggccaggcactgtggctcacacccgtaatcccagcattttgggagggaggctgagggaggaggatcgcttgagcccagaatttggagaccagcctgggaaacatagcaaggcctcatctctaatttaaaaaaaaaaaaaagcaagaaagatgatatgataccaaatcaaatcatttcctttactaggaaaagggcaaaaacaaggcatggtgtcagttaaggatccctccttagagaagcatgaaaagtctgccccaaatctggtaaatccaggaacaactgactgtcaagctgatggtgcattctaggtaaggatgatttggaccaggttgtactttgttcccaaagaattcaaggaaaactttgtttgtttgtttaatctgcttaacatagtaaaatctttctttgcaatatcatacaaagttggcattacatatgcactgttgaagaaaacatagttaatttttttttaaagaatgtactccaaaaccatttaattagtaaaaatgtttaataatgattttttttttttttttttttgagacggagtcttgctctgttgcccaggctggagtgcagtggcctgatctctgcttactgcaagctccacctcccaggttcatgccattctcctgcctcagcctccagagtagctgggactacaggtgcccaccacaacacccggataattttttgtatttttagtagagacagggtttcaccgtgtgagccaggatggtctcaatctcctgacctcatgatccacctgccttggcctcccaaagtgctgggattacaggcatgagccactgttcctggccctttgagtacattttctaagaagttggtcatgagttcagatgtctgcctcaaagagatacttgtggtttccattaaagaacccaccttccctttctacaggagtatttatgggagatatgggcctggaggttggaatctatcctggttgtactttgctctactgaagtaaggagtaaacctacaaatacattcatattgaagtgtacaaagggggctctacaataggtaggaattctatttagttttgttgggtaacaaatcctttgagaagcaaataatagctcacctacaaaactggtgatctgtataagttgggatttttcatggatcagttttgcttggattgaactatataatcacaaatatatttatacctagagagacagaaagagtgtctgttgaaactgtatcatcttaacgtgtctataaaaggcaatacctggaaggtggtggatgccacacaggttaagctgtcttccctctgggaggcaggcttctgggaactacacatttggtaatcttgcccataaaatgccaattggacacttactgtagaatgccaagggcactgtagattcagatagtccccatcacaggcatagatggtgtggttttgcaggagtttggttaggtaacctagaaaatattcagtcgggttacaagaggcccaggaacccaccattcctccttgggtttggggacaggaggacgttggttcccctggggaaggactgttgagttaacaacatgtggggtagggcctccctagcagctctggtgcagaggtcacaaaaccaggcccagaggtggggcacaggagccaatgtcagctttcatgttgatatggaaagggggcaggggagtgctgggtagagaagggtggggaccctagcgagggctctgccctcgggcttgtgcccttggaccttagtgagaacaggcactcctgttttcatgtccaaatgttgcattttccaagactactctggcctgctgtgagccccattctgtgtccataaaaaacccaagaccctagtgggcacagacacaagtggctggacgtcgagaggagcagagaagcagaagagcacaccgacagacatcagcagatgctggcaggcttttgacagtggggagatgtggaattcagttgggggtggtcggtggagagtctggctactgtttcaatgtctgggtcagaaaccttggtctgggatggcccactgaatggtttggagagctctttcctcttcaggaagcactaaggtattggccaggagccaagaagtcctgaagcacctttataaaccaggaaaaaaaaattggggtgagtatcccctggacgtgtggatgcccatcctgagggaggctttcatttgctcatctcccactagtgaggccatgtcttattgggatgagagggtgcagtttcatttcaagaaatcactcgtggctctgtcttggtgctggagaggaaagacaggcagggtgccctgtgcagagaggtgatggtggggctctgctgtgggttgaatggtgtcctttcaaattcacattcatcaatgtggggaaaagaaagagagatcagattgttactgtgtctgtgtagaaagtagaaataagagactccgtttagttctgtactaagaaaaattcttctgccttgaaatgctgttaatctgtaaccctacccccaaccctgtgctccctgagacatgtgctgtgtcaactcagggttaaatggattaagggctgtgcagggtgtgctttgttaaacaaatgcttgaaggcagcagcttgttcagagtcatcaccactccctactctcaagtacccagagacacaaaactgctgaaggctgcaggaacctctgcctaggaaagccgggtattgtccaagatttctccccatgtgatagcctgagatatggcctcctgggaagggaaagacctgactgtcccccagcccgacacccgtaaacggtctgtgctgaggattagtgaaagaggaaggcctctttgcagttgagataagaggaaggcatctgtctcctgcttgtccctgggcaatggaatgtctcggtgtcaagcccgattgtatattccatctactgagataagggaaaaccaccttagggctggaggtgggacatgctggcagcaatactgctctttaatggattaagatgtttatgtgtatgcacatcaaaagcacagcacttaattctttaccttgtttatgatgcagagtcctttgttcacgtgttttcctactgaccttctctccactattaccctattgtcctgccaagtccccctctctgggaaacatccgataatgatcaagaaatactaagggaactcagaggctggtgctggcacaggtcctccgtatgctgaacggtggtcccctgggccctattttctttctgtatactttgtctctgtgtctctttcttttccaagtctctcgttccacctgacgaaaaatgcccacaggtgtggagtggcaacccaccccttcaatcaggaacctcagaatgtgacatttggaaatagcgtggttgcagatgtaacgaattaacttggcgacatactggagtaaggtgggcccttaacaccctatgactggaatccttataagaagaaaagaagagacacagagggaagacagctgcgtgcagctggaatgatgcacctgaagccaagggatgctgcgcattgccagccaccacccaaaactggaaaaggccaggaaggattcttccctagaaccttcaaaggcagcacagccctgccaacaactgcattcagactctggcctccagaactgtgagaggatgaatttctgtcgttttcagccacccaagcttaggaaatgggttgcagcagactcggaataagacaggcagccagtcagcctccgtggaattcccaggcagcttgcaggagccacagtgggccctgggctctgagaaggtctgaggcccagcaggcgcaggggcctaaactatttctctgcaaggaggaaggaaggttcatccagaacgtagatccccttcctccttctcacacctcacaaggtcacagcgaggtggctgggaggacagccagggacttttcactgagatgtgtgggagacagcttggtagcccttggcctctgaagggaggaggtggcatgaagaagggcagcttctgaaattcccagttcctgcttgatgacctgtgtgtaaagtattcctgtttaggtctcaaaatcctctcagaaatataattctcagaaaatccaggcacccaatccagctccctggccttcctgaaatctgaagtcaaaggggctgagccagcctgccctgggtgtcaggcctctgagcccaagctaagccatcatatcccctgtgacccgcacatacacatccagatggctggttcctgccttaagtgatgacattccaccacaaaagaagtgaaaatggcctgttcctgccttaactgatgacattgtcttgtgaaattccttctcctggctcatcctggctcaaaacctcccccactgagtaccttgtgacccccactctgcccaccagagaacaactccccctttgactgtaattttcctttacctacccaaatcctataaaacagccccaccccatctcccttcactgactctcttttcagactcagcccccctgcacccaggtgaaataaacagccatgttgctcacataaagcctgtttggtggtctcttcacacggatgcgcatgaaatttggtgcagtgactgggatcgggggacctcccttgggagatcaatcccatgtcctccagttctttgctctgtgaaaaagatccacctacaacctcaggtcctcagacccaccagctcaaggaacatctcaccaattttaaattgggcaagcagcctcttcttactctcttctccaacctctctcactgtccctcaaccactttctcctttccactcttcaatctctcccttctcttaatttcaattcctttcattttctggtagagacaaaggagacacattttatctgtggacccaaaactccagtgcaggtcacggactgggaaggcagccttcccttggtgtttaatcattgcagggaagcctctctgattattcacccacgtttcaaaggtgtcagaccatgcagggacacctgccttggtccttcacccttagcggcaagtcctgcttttctgtgggaggggaaagtaccccaaccacttttctccatgtctctaccccttctccacctttctgggggacaagaaacccccaaccccttttccttcacccttagtggcaagacccacttttcttggggaggggcaagtaccacatcttatctctgcacccgaatcccttatatccatgccctgacctcttatctctgtgccccaatcccttatttctacaacctgacctcttatatctctgcaccccaatcccttatttccatgcctggacctcgtatctctgtgccctgacccctttcccacttttctggaggggaagaacccccaaaccccttccctccatgtctctactctctcttctctctgggcttgcttcctacactatgggcaaccttccaccctcctttcctccttcttctcccttagcctgtgtttttaagaacttaaaacctcttcaactctcacctgacctaaaatctaagcatcttattttcttctgcaatgccgcttgaccccaatacaaactcaacaatagttccaaatagccagaaaatggcactttcaatttttccatcctgcaagatctaaataattcttgtcataaaataggcaaacggtctgaggtgcctgacatccaggcattcttttccacattggcccctccctagtctctgtgcccaaagcaactcatcccaaatcttcctcctttccctcctgcctgtcccctcagtcccaaacccaagcattgctgagtctttctaatcttcctgttctacagacccatctgacctctcccctccttcccaggctgctcctcgccaggctgagctaagtcccaattcttccgcagcccccgctcctccaccctgtaatcttcttatcacctcccctcctcacacccggtcccgcttacagtttcattccgtgactagccctccccaacctgcccagcaatttactcttaaaagggtggctggagctaaagacatagtcaaggttaatgctcctttttctttatcccaaatcagatagcgtttagcctctttttcatcaaatataaaaatccagcccagttcatggcttgttcggcagcaaccctgagaggctttacagccctagaccctaaaaagtcaaaaggccgtcttattctcaatatacattttatttcccaatctgctccctacattaaataaaactccaaaaattaaattctggccctcaaaccccacaaaagatttaattaaccttaccttcaaggtgtaccataatagaaaaaagttgtaattccttacctccactgtgagacaaaccccagccacatctccagcacagaagaacttccaaacacctgaaccgcagcggccaggtgttcctccagaacctcctcccccaggagcttgccacaagtgccagaaatctggccaccaggccaaggaatgcctgcaccccaggattcctcctaagctgcgtcccatctgtgcgggaccccactggaaatcggactgttcaactcacctggcagccactcccagagcccctggaactctggcccaagcctctctgactgactccttctcagcttagcggctgaagacagatgctgcccgattgcctcggaagccctgtagaccatcatggaccccgagctttaggtaactctcacagtggagggtaagtccgtccccttcttaatcaatacggaggctacccactccacattaccttcttttcaaaggcctgtttcccttgcctccataactgttgtgggtattcacggccaggcttctaaacctcttaaaactcccgaactctggtgccaacttagacaatactcttttaagcactccttttagttatccccacctgcccagttcccttattaggctgagacactttaactaaattatctgcttccctgactattcctgggctacagccaaacctcattgctgacttttcccccagttcaaagcctccttcacatcctcctcttgtatctccccaccttaacccacaagtataggatacctctactccctccttggtgaccgatcatgcacctcttaccatctcattaaaacctaatcacccttactccactcaacgccaatatcccatcccacagcatgctttgaaaggattaaagcctgttatcactcacctgctacagcatggccttttaaagctccttacagttgccccattttacctgtcctaaaaccagacaagccttacaagttagttcaggatctgcactctatcaaccaaattgttttgcctatccaccctgtggtgccaaacacatatactctcctatcctcgatacctccctccacaatccattattttgttctggatctcaaacatgctttctttactattcctttgcacccatcatcccagcctctcttcgctttcacttggactgaccctgacacccatcaggctcagcaaattacctgggctgtactgctgcaaggcttcacagacagcccccattacttcagtcaagcccaaatttcttcctcatctgttacctacctcagcataattctcataaaaacacacgtgctctccctgctgatcatgtccgattaatctcccaaacctcaatcccttacaaaacaacaaccctttccttcctaggcatggttagggcggtcagaattcttacacaagagccaggactgcaccctgtagcctttctgtccaaacaacttgaccttattgttttagccaagacatcatatctccgtgcagcggctgctgatgccctaatacttttagaggccctcaaaatcacaaactatgctcaacttactctctacatttctcataacttccaaaatctattttcttcctcacagctgatgcatatactttctgctccccggctccttcagctgtactcactctttgttaagtcccacaattaccattgttcctggcccagacttcagtccggcctcccacattattcctgataccgcacctgacccccatgacagtatctctctgatccacctgacattcaccccatttccccatatttccttctttcctgttcctcacctgatcaagcttgatttattgatggcagttccaccaggcctaatcgccacacaccagcaaaggcaggctatgctatagtacaacccactagcccacctcttagaacctctcattttctttccatcgtggaaatctatcctcaaggaaataacttctcagtgttccatctgctattctactactcctcagggattattcaggcccttccctacacatcaagctcgaggatttgcccccatccaggactggcaaattagctttactcaacatgccccgagtcagataactaaaatacctcttggtctaggtagacactttcactggataggtacaggcctttcctacagggtctgagaaggccaccgcagtcatttcttcccttctgtcagacataattcctcagtttagccttcccacctctatacagtctgataacagaccagtctttattagtcaaatcagccaagcagtttttcaggctcttagtattcagtgaaacctttatatcccttacagtcctcagtcttcaggaaaagtagaatggactaaaggtattttaaaaacacacctcaccaagctcagccaccaacttcaaaagcactggacaatacttttaccactttcccttctcagaagtcagacctgtcctcagaatgctacaaaatacagcccatttgagctcctgtacagatgctcctttttattaggccccagtctcattccagacaccagaccaagttagactgtgcccccaaaaaacttgtcatccctactatctgctgtctgtcatactcctattcaccgttctcaactactcatacatgccctgctcttgtttacactgccagtttacactgtttctccaagccatcacagctgatatctcctggtgctatccccaaactgccactcttaactcttgaagtaaataaagaatctttgctggcaggactatgctgaatctccttaggcactctctaatcagatgtcctagatcctcccaattcttagacctttaatacctgtttttctccttctcttattccatttagtttttcaattcatacaaaactgtatccaggccatcaccaataattctaaatgacaaatgttccttctaacaaccccacaatatcaccccttaccacaaaatcttccttcagcttaatctctcccactctaggttcccacacggtccctaatcctgctcgaagcagccctgagaaacatcgcccattatctctccataccatcccccaaaattttcgctgtcccaacactttaccactatttcattttatttttcttattaatataagaagacaggaacgtcaggcctctgagcccaagctaagccatcatatcccctgtgacctgcacatatacatccagatggccggttcctgccttaactgatgatattccaccacaaaagaagtgaaaatggcctattcccaccttaactgatgacatttatcttgtgaaattccttctcctggctcatcctggctcaaaacctcccccactgagtaccttgtgacccccactctgcccgccagagaacaacccccctttgactgtaattttcctttacctatccaaatcctataaaatggccccacccctatctccctgcactgactctcttctcagactcagcctgcctgcacccaggtgaaataaacagccatgctgctcacataaagcctgtttggtggtctcttcacgtggatgtgcattaaacaggtgtcctcacgcccaccagcccagagtgctctctggaggaaggctacagacacttcctggttcactcatccagacgttagctgtcttgctgaaactccttttttcacccttgaaaaccactggaagaatggcccagaacccagctatcctgagtaagttcacttaaagaagcaaaatctaacatgagtggcaaaacggacattggcaccaagagtgtgggtcggagtcctgccccttggaagtacattatcgcttgtacagtgtaccccccaggcaccaagagaccaggctgagacccttcagtggccctgggcctctggttcgtgtcttccctcctggcacacaggcagtctctcataaaacaatgagtactgaaagttccagccttctgggtgggttctcagcaccccgtcatgagccacaccctgccacagggaaatcagggtcaccctgatgctacccctaggccagtgccccttctgcagtgccccaggctggcacccctatacttagatctcttcagcctcctcatgaaaaccttcttgtccatcaccccagcattccctggactgtgccaaatgagcagctgaccacacgtcagatcaattttcagagtttgaatttggtttaatattcatggcttatccaaaagatcttgtcaccatagctagatgaaaaaaatgacaaggctctggagaagcagagccacaagatggaagatacctgggtcccaggttcatgaggagaggagcttcctgctccacagactgtcacatgagtgggaatgaaacttttgctgtgtttagaccattacctttcttcactctgtcacatagtctatccccgctaaacagaacttgacctccgccagaccgtttacatcaagacctgtatgtgtagtgcagtggcctgagcctccaatccatgccccacctatccagccggccttaccatattcttactctgagagtggttttctgggggccgaagctcagcgcatagaattgactaatgccagatccttcaggcgctttgcactttgaagtctatctgtcctagcacattccaagtacaaagaagacacttcagcagtacaatctggcctacactcagttcaattccttcttcaaaaacctaggcccagccaggtgtggtggctcacatctgtgatcccaacactttgggaggctgaggtgggtggatcacctgaggtcaggagtttgagaccagcttggccaacatggtgaaatccagtctctactaaaaatgcaaaaaattagatgggtgtggtggtgccccactttaatcccagctacgctggaggctgaggtggggaaattgcttgaaccctggaggcggaggctgcagtgagccgagattgtgccactgcactccagccggggaaacagagcaaaaccccatctcaaaaaagaaaaacaaaaacaaaaacaaacaaacaaacaaaaaaaacaagcctaggcccacatccagacaatggaatgttatttagcactaaaatgaaatgagctatcaaaccacaaaaagacatggagaaatcttaaatgcatattcctaagtgaaagaagcccatccgaaaaggctgcacactgtatagttccaactatttgacattctggataaagcaaaactatggagacagtgaaaatatccatggtttccagaggtcaggacaaaggaggaatgaattggtgaaacacagaagatttttaggcagtgaaactactctgtgtgatactacaatggtggatccacgtcattgtccatatgtccaaacccacgcaatgtacaacaccaagagtgagccctcatgtaaactatggactgtaggtgatagtgatgtgtcaatgtaggtttattgattatgaaaaatatcccactcaggtttgatattgctagtgggggaagctgcacgtgtgtatgtgtggcaggtgggagtagaggttgatgaaaactgcactttctgttccatttttctttctttcttttcttatctctttctttccttttccttcccttccttccttccctccctcctttctatctctctctctgtttctttctcctttcttttcttctttctttgtcacccaggctggaatacagaggtaagatctcagcccactgcaacctccacctcccaggttcaagcagttctcctgcctcagcctcccaagtagctaggattacaggcatgcaccaccaggcccagctaattttttgtatttttagtagagacagggtttcatcatgttggtcagtctggtctcaaactcctgacctcgtgatctgcccacctcagcctctcagagtgctgggattacaggtgtgagccatggcacctggcctctgctccatttttctatgaacctagaacttctctaacacattaagtctatttaaaaggaaaaaaaaaatccctatccccaggatagcattacctttgggaggagaggagctagcgttagggaggggagaatgaggcgctcaggcaagctggccatgccctgttccttgatctgcatggcgtgcatgtgctttactttgtgaaagctcacccagttatccactttggatatgtgaacaaaaatttttaagaaaacttcacctgcagttatctgacctacacttttaaacaataaagaaatcctaggcacgtggagccctgggtaactcatggagcaagggggtgcggaacgctttccatagccagcctcagtcccaccaggatgggctgctaggtgacagcaggacaggctcatgaggaccagccatcacccaaatgctctggtcctcctggctacctgccgatggctcaagctgtttggtctacagtgccaaaagctcaggaagaaggacagctaggacaaccccatagtttcagcaacacggaggccatcaagatccattttgaaaccatatggaatgggtggtggggacagaagcttgtttggaaaaggttgaaaaatgagtggaggggcctggtgcggtggctcatgcttgtaatcccagcacttcgagaggctgaggcaggtggatcacctgagattgagagttcaagaccaggctgactaacatggaaaaaccccatctctgctaaaaatacaaaattagccaggcatggtggcaggtgcttgtaatcccagttacgtgggaggctgaggcaggtgaatcacttgaatctgggaggcagaggttgcagtgagctgagattgcgccattacacgcctgcctgggcagcaagagcaaaactccatctcaaaaaaaaaaaaaaaaaaaatgaaaagtgggtggaagttaagaaagtcaaagatggtccatgtggtaggcagaataacggcccccaaagatgtccacagaccttaatccccaggaccactgattatgttaccagagattgatggtaaaagggacttggcagatgtgattaagttcaggattttgagtgggggagattatcctggattatctggaaggggtttatataatcacaagagtccttaaaaggaggaaggtggctgagtgcagtggctcacacctgtaatcccagcactttgggagaccgaggtgggtgtatcacctgagatcaggagtttaagaccagcctggccaacatggtgaaactctgtctctactaaaaatacaaaaaattagccgggcatggtggcggatgcctgtaatcccagctactcagtaggctgatgcaggagaatagcttgaacctgggaggcggaggttgcagtgagccgagatcacatcattgcactccagcctgggcaacaagagcaagactccatctcagaaaaagaaagaaagaaagaaagaaacataataaaatggaaatggtttatactggatcatgctacctggggaatgcagagaggggatattcccaagcagggagtgtcttttctcctacgattgactctggaacggtgaggagctgctggattctatcaacagttcgagagtgccctatataaccagctctcaactcactcacccccagctgtttggtgtctatgaatgacaatttcgaggtgaacaaacaacatcctgtttggagggctgctactctggctaaggacggtaaaaatcagtcagctcagtgagctgaattgcatgctgttttcctagccactgatttatactagaatgatgccagtaactgattttcaaagaatcatggtatgtgtcccaaagtgttccacaggagtgtgatattgtgaaatatatatttgatcagttgaacagtggtagaagccccctgtttgggtttttactgactcctgggcagtgaccagtgtcttggctgtacactcaggcaagagggcaatcgccacctggcttattaacggatgtccatatggggcacagccctgtggagaggtgaaagatgccttgaagtagaacaggttcacgcccatcagaaaaactcccttccaggctcaggaggtggctggagtcaccaagtggattttttgtgtgtgctcctgtgaggtggtcacctgggcccatgaaatgagtgaacaaggccgttctgcagcagtgtagagatgggctgaatctagccatgccccttgggctcaaaatgccaataagaactgttctgtcactgggtgcggtggctcaagcctgtagttccagcactttgggaggctgaggcgggtggatcacctgaggttgggagtttgagaccagcctgaccaacatggagaaaccccatctctactaaatatacaaaattaccggggcgtggtggtgtttgcctataatcccagctgaggcaggagacttgcttgtacccaggaggcggaggttgcggtgagccgagatgatgccattggactccagcctgggcaacaagagtgggacaacgtctcaaaaaaaaaaaagaactattctgtctgccagcaagagaaacagagactgcccactgctgcgaggcacattcactggtgggaaagctcttaacataactggcaagtgagatggatgctggcagccctggggggctgcatctaggtcttgacaggaatagacactgtctctggactgggttttgtttgtttttagaagatgcaaacagcagagtgcaattaaaaaaaagaaaaaaggccaagcatggtggcgcatgcctgtaatcccagcactttgggaggctgaggcagacagatgacctgaggtcaggagttcaagaccagcctggcaaacatggtgacaccccgtcactacaaaaatacaaaaaaaaaattagccaatcccagctactcgggaggctgaggtggaagaatcacctgaacccaggaggcggaggttgcagtgagccgagatcatgccattgcactacagcctgggagacagagggagactctgtctcacacaaaaaaaaaaaaaagaaaaaaaaaacagaacaggagatagtgcatgaatcttgatggccaacgtcattgcttcagaaaaaggagcactctgtacagcccataatgtccaacaatgggcagagaggcatcctcttcagagtcataatttggcacagaagtagaacaggcaattcaaaccctggttgtttaaaacgggggaggtgaaagcagaagggctggtgatagagtttggatctctatctccaccaaattgtgtgttgaattgtaatccccagtgttggagctggggcctggtgggaggcaactggatcatgggggcaggtttcccatggatggtttagcactattctctttgatattgtactcacaatagtgagtgagttctcgtgagatctggtcatttaaaagtgtgtggggccgggcgtggtggctcatgcctgtaatcccagcattttgaaaggctgaggtgggtggatcacctgaggtcaggagttcaagaccagcctggccaacatggcaaaaccctgtctctagtaaaaatacaaaaagtagccagcgtgtttgttggcccctgtaatcccagctacttgggaggctgaggcaggagaatcacttgagctcaggaggcagaggttgcagtgagccaagatcacaccactgcactccagcttggatgacagagcaagactctatctcaaaaaaaaaaacaaaaaaagtgcacagcacctccaccagtcattttctctggctcctgctcctgccatgtaagagaactgctcctccttcatcttctgccatgattggaagcttcctgaggcctcaccagaagcagaagctgctatgcttcccgtacggtctgcagaacagtgagccaattcaacctctttccttgtaaattacccaatcccattgcttctcagccttttggctaagatcaagtataaattacccagtctcaggtatttctttatagcaatgcaagaatgaactaatataactggcttgcacactcacaaagtgtgcaatgctaaatacttagcatgagtggtctaaaggagtggacttccagatttttctccattttttgggttgatctggggaaggggggatggggaggatgctgacatgaccatgaatttttttttttttcctgagatggagtcttgctatgtcacccaggctggagtgcagtggtgcaatctcagctcactgcaacctctgcctcccaggttcaagcaattctcctgtctcagcctcccgagtagctgggattacaggcgcatgccaccaggcccagctaatttttgtatttttagtagagatggggtttcaccatgttggccaggttggtctcaaactcctgacatcatgatccacccatctcagcctcccaaagtgctgggattacaggtgtgaaccaccgcacccagcccaatgaacagttcttgaatgaatgagacagtgaagaagactaccagaacaagagcagatcaaaggtgaataagtgagtagtagcttctgattaatcctcatcagcaaccaacataacccagggcttatagatttctctgtgtaatatgctacacacacgtctacggaaagagagagagagagaagcacatcagtcaagcaattttcaaaagttactctaaatgtgctgtgttggtcttgtattacaatctttagattacactactattttatttcaaacaggactggtagaaacttcttcatgccttttcaaccaaaggccttcaatcctataaaaatgatcaccttgttctttgaccaagtaccaaccttagaaagttatgcagcgaacaccatctgacttagattatttgaaaagtaactggatcaatccccctttaccccaaacatctaaacggaacaattttcttttcttcgggatgcatcataatcctcaaactgcagagccacttggcgatgaagccaggatcacagtgcatttgataacttcatgcaactttttactagcacttaatactcagatatgaaatctgtacttgatcttttctgcttggaattggccagattagtggttctgcccccacattcaacaaaaggctctcagaaacactcagggtcgctaaccaatcagaaggaccaacagagcttgacaaacagacaagaaggagaagggcaccgccttccaccccacccgcttagacagcctttcaactctgcccactttgaggatgtgtaggatgatccaggtaatcatgatacctaccttaacttcaaggtagaaattaaggcttgagggcacttatttggtgccttattcagttaattggaagattatatggtaatttcactgctcataataattaaacctttttttttttcactttagggatgataatgacatttggagagtagcactataaacctcaaacatctattttgaagatgattggatttaggagcaagacaggtttgccgtacacttgaccgaacatgctttgttccccaaagcagcaaaaaagccagagcctggaagtttctaaaacttgaagcagatgtaagtggcaaatccaaaaagccgtgcctagagaacaggtcgggtgaccggctgtgtctattccagcctccccattggcttggtggaggacttcgcacaggtctctcagtttctccttctttggtttcaccgtagaatgaggggaagtcacagcatttcttcctttgtatttcacagaaacacagtcagcaaatgtaaagaaatacgggcgcctacatggtgattatgctggcctggtctcaagcttcatattcatccttaattgatttccaggcacactcgccagtgaccgggctttgcttcaccgaatggccccaagggcctacactttcttaattctcctgtggaccctttattcactccccctcatccttcctttgctgagggtgtttgcttctgactgcctcaatcttttttttctttttctttttcttttttttgagatgtagtcttgctctgttgcccaggatggagtgctgtggcgagatctcagctcactgcaacctccacctccccagttcaagcgattctcctgccttagcctcccaagaagctgggattacaggcgtgtgccaccatgcctggctatttttttttgtatttttagtacagatagagtttcaccatgttggctaggctggtctctaactcccaacttcaagtgatccacctgccttggcctcccaaagtgctgggattacaggcacaagctactgagcctggcctcaatcttatgcttactattcttaaatctgttgcctcattttatagccacagctcaggtgacagctgagggattaccttcgtctgtctctgagcctctaagacttctattttcttcaccaccttccaggaatccttttttctagctcttggtcgctggccatctcctggacggttaagttgaaaatctgacctccagttcattggtgcatctacaatcaatcctcattacctgcagattctgtagctgcaaattcacctacttgataatgtttatttatagcccctaaatcaatcccagcagagctttcctggatgtgcgccaagtgctgaagaggttgaatggctgataagcacggtcccagcagagctccatcgaggaacctctgccttttggtttccgctcttataccataaatgaatgtccttttcttggtcgttttagggtttttttttgagacagagtctcactctgtcacccaagctggagtgcagtggtgtgattgcaacctctgcctctcaggtttaagcgattctcctgcctcagcatcccgattagctgggactacaggcatgtaccaccacacccagccaatttttgtttttcagtagagatggggtttcgccatattggccaggctgatctcaatctcctgacctcaggtgatccacctgccttggcctcccaaagtgttgggattacaggtgtgagccaccatgcccagccagggttctcttaaatgtaatggaaagaggagaattggaatggcagagagagagagaactaggagcctgcatgaatgaatcaagttgagttggagagaaactgaatttataggaaagttaaggctctgagtttggaggccaagcagggtgggggtgtgcaaacccgtgagaaggaaagccgggcttcaaaaaatagctgctccttcttgatagatgcagagaggaaacaggaaagaccgggggccatgcagtgttatttgtagcacttgaatagcttggctcttagagtcccaaggcctccagctggtgatccagagatgccattagagggcaaaagtgctcgctgctccctcgtttgtcaccaagaagacatggtatggccctggtcttaaggacaagttagtcaattgcttattgtatatcacgggatgaacgctgggagagaggaaacgcagggtgtgtaggaagagggcaaaattggctacatctgacccaccccagagatgaggaaggcttccaggtgggaggtgatgccaggaggtaaccaggtggaaatcaccctcaagtagcagggacaggtgtgcaaaggctcagagggagcttctccaggatcagcagggctcaattgtagggtgtgagcctgtcacagaggctggagaaataagcagtgccttgctaagaagtctgaattttaacctgaagcgacatgggagctactgcaggctggtaagcaggggggtggtgctggttggattgcaatgcagagaaaccctgggttggcctgcgtctgatggactggagagacccttgaagaaatcagagtacagacagtcctccagagtagaaatgaggaaggtgctgagaccacagcagtggggaagagtgtgagagggatggaaattgagatgaattcatgggtgtttggcctgtgcagtcacacagtgccccatgctgagagggacccccagcgtggcttaatgctctgctcttactgtcttaaaattcctcctcattttatgtttgaatctatgttttgttttgttttgagaaagagtctcgctctgacatccaggctggagtgcactggcgccatctcagctcactgcgacctccacctcccaggctcaagtgattctcctgcctcagcctcccaagtagctgggactacagccacctgccaccacgcctggctaatttttgtatttttagtagagagtgggtttcaccatattggccaggctggtcttgaactcctgacctcaagtgatctgcccacctcagcctcccaaagtgctgggattacacgtgtgagccactgcacccagtctgaatctatgttttatcagtgaaatccaacggggcaatagaacatgtgcatgggcagatgagacaccaacaataagagttaccccgtcccttgccaccgcactccccatggagtgtctgccctgccctgagcatagaatcttagggggtccgcagtgcatgggagcccagcaaggctccaagtgagcataagggaagcctactatgtccacaacggagtccgcgagagatgctgacagcaccaagaggtcgcactttctcttattatagaatcagaattgaaaaccaagtcaatggcattctaagaaacagaaacaaacaaggaaccctctcccagccttttctacccatctgattccctgtagtagccaaccacttccactggaaatgatgacataggagaggcaaagatagcggagtcatagttatttttcctttcaattcttccttacacatcagtaagccaaaggtagagtggtggtagattgtataggtgtgaaaaagtgaaataaaaacagctgaatggcgggtgtggtggcttatgtctgtaatcccagcattttgggaggctgaggcgggtggatcacaaggtcaggagttcgagaccagcctggccaacgtggcgaaaccccatctctattaaaaatacaaaacttaggcgggtatggtggcgggctcctgtaatcccagctactcaggaggctgaaggcaggagaatggcctgaacccgggaggcagaagttgcagtgagccgaggtctcaccactgcactccagcctgggcaagagagcaagactctgtctcagggaaaaaaacaaaaacaaacagacaaacaaacaaaaacatcgaattagtttcctgcaacgtctcactgtttgtgtgaggcaaaaaaaaccacacatgcaaagtacaaattatgtaatttctgtgattccacatttgagtccaatcctcctgttgaaatctggcattgcacaatgtaaagaggaacattataatccatgctagtaatttaaaatgttaattttttttttacttagaaggacattaaataacaaatgaaagcatcatgataaattgagacacagagaccacagaagaaagaaaatatatgttaatacttcagtagtggttttcgtctgatttttgaataagggggcccatgtttgcatcttgcactgggccttgcaaattctgcagctggtcctgactgtcaagacagggatttagccataaaatcagcaggggttggtcgtggggttgtgggttacaggaagatagagaatttaggcatggctgcagggttttaagctgatggtactattggctgggaaatctaggaaatccagcattgaaggacaggcattgtgaatctgttgtggatgggctgagcctgcagtggccatggggcatcctgcctgggaggggggcgagcagcaattcatcagcacaggtggtgactgaggctcaggaggggctactgaggcagaaactgtgggcagggatgcagggcaaggcagacatttaggagatgggacaacagcttggtacagtggctcacatctgtaatcccagctactcaggaggctgagacaggaggatagctagaggccaggagttcaagatcagcctgcacaacatagcgagaccccatttccccccaccaaaaaaattaatacgaagtaaaaatacaaaaaagagatgggacaacaaagaaggcctcataaaggagatggagaggaaggggacaggaggaaaggggagagggaaggtgacagccagaagcaggcatgagaggttccctagagtggggttttattatctcaagtgaccatgagtaaactatttaacctgtctgtgctgcagacatcatggataaagcgaagatgaaatgaagacaataacagcagcacttatgggtggggcagttgtggtgaagattaaatgaagagtttatatgggaagggctcagaatgctgctgtattaaatgactcgggttgctataacaaggtaccacaagctgggtggcttagaactacagaaatgcatcgtctcacacctgcaggccagaaggctgagatgaaggcgttctcagggccgtgcttactctgaagatgctagggaaggatctccctcccagcttctgccagctccttagcttgtggcagcagaagtccaatcttcacgtggccttctccctgtgtgcatctgtgtccaaaatttcccctttccatatctatatctatatctacacacacacatacatatatatgtagtgtgtgtatatagagatatataaaattttatttatttatttatttatttatttatttatttatttatttatttaattttaagacagaatcctgctctgtcacccgggctggagtgcagtggtgcaatcttggctcactgacacttccgcctcccaggttcaagcaattatcctccctcagcctcctgagtagctgggattacaggtgcctgccactatgccctgctaatttttttgtatttttagtagagacaggtttcaccatgttggccaggctggtcttgaattcttgatctcaagtgatccaccagcctcggccttgcaaactgctaagattacaggtgtgagccaccgcgcctggcctatttattattttttaaagatgggggtcttgctattttggccaggttggtcttggaccttggcctcaagtgatcctcccacctcagcctcccaaaatgctaggattacaggcatgagccactgtgcccggcctattttatttattatctttttaatagagatgggagcctccctatattggccaggttggtcttgaaccttggcttcaagtgatcctcttgcctcagtctcccaaagtgctaggattacaagcatgagccaccgcacctggccaatttcccctttccataaggacacccattatactggataaagcccactctatcaacctcattttaacttgactacctttgtaatgactatctccaaatatgccacattttcaggtactgggggtcaggactccaagaagtcttttgtgggagaggggatgcaattcaatccacaacagtgccctgctctgttaaatgttcacctttatgaataagacaacctccatgagttgttttcttccaaggtatgaggcagagaccagtgagggacaacctgagggtggggaacataaatttgttgtggccacaatctccacaacaacccgatgtttctcctgcagcacttagcagcccaagtgaaggtaaatataagaagaagagggaacaaagatgagggagtgacgcatcctgataacacaccaaagacaaccacaggcagaaatactgatgacagagaggcagacggggaacactgctcattgctctgcctgcctcacttttgttcaggggctaccaggaagcctgaggtcccaggtggacagaaatcaccatgatcccctcttggccccaaccaacatacacacaggaggcaaaccaacttttgatcatttattaaaacaaataagaggttaatctgtgggtaaaaaggccttgtttgccagcagctcacgggatgccttcaagctgacaggcactagtgcgccttgaagtaggaagcatcacatgggttctggagataagcaatagataaacaaccggagttaccagaagtgtcaagccaggcatcaccttaacagaaattattcctggagctaatgtggaagtcattaatcccaagagaaaagacagaggtgggcgtggtggctcatgcctgtcagctcaacactttgggaggctgaagcgggaggatcccttgaagccaagagttcaagatcagcctgggcaacagagtgagacctcgtctctacaaaaactacaataaaataaattagccaggtgcagtggtgcacacctgtagtcccagctacccaggaggctaaggcaggaggattgcttgagcccaggaggtcaaggctacagtgacctatgatcacgtcactgcactccagcctgggcaacagagcaagaacctgtctctaaaaataagagaagagaagacagatgaagcaaagtgggccaaaacttagataaagggaattgctctgttttagatgaaggattgcgaaacaaaattttcaacagcagcaatgaaagacctgtctaccacagtgtagccctcagcaaaaccacaagtgggcagactctgactctcccacgcccctctcactaaccccaaaccccttctagatagaatgttttccttcctcttcatcctaatgccaggagcaactttggtggtgcgttccccacatctgccctctttgccaaagccccaggttccagagccttcccttcttccttctcgactgcattaaggcttgcttaccctgagttcaagacccttacatccttgttagataaatggctgagtaagatgatcagttaatcagagcgagtatggctgatgatgccttctacaatataatgcaatgaacctgcgcccaccttcactgaacgatcaacattcactttggtgtaatggggtaaaccatcagcatgtccctcctgatgcaacgaacagagaacatgacaccattgctgtgatagtcccaccccaaatgcataagaatatcaccgccaagaaacatcagccaaatccaaagtaagggacattctatcaaataaccgtcttgcgttcttcaagaatgccaataccatgaaagataaagaaaaactgaggaggtgttccaggctaaaagggacctacagagacacaacaactgaaaataatgcatgatctgggatgatcatttgctccaatgtacatcactgggttaactggcaaaatctgaatgaggtccatatattagaaaaccgtgttgtagcagggttagtttcctgattttgatcattgccttggttatataagagaaaatccttgttattaaggaatacacaggaatatttaggggtaaaggataactcatctgccacttagaaaataataaagcaaatggggtaaaatggtagcactggggaatctcagcgaagggtataaaggatgtctttgtactattcttgcaacgcttctgtgtctggaaaaataataataaatattatatatttaataactaaatgaatgaaaaagtgtgcaatgtttctgcagatgtcaaccttggcaatgcaataggatcatctcagaagctctgcatgaatatcagtgcccaggctccaacccagagattcatagtcagttagctgagggtgaaactccagacatcggcatgtgtgaaacacaccccaaggtcattctagtgtgaatccagaataataagcagccagcttagcctttagtgtcattgggtgacaggaaagttctaggctggggactttctgagccccccatgtctgcttgttttgagatctgatcttgggggcagcatggtgactcaaaacaggagcacagttgtgggtccagtcttggtccttccactaataagatgggagactttgcgtcagatcccttgcctgtgccaagcctgggttttctcagctgtgtaatgaggttaaccaggaagtgcctcagaggccaatgtgcattcagggaagaagatgcccagctcagtaactgatatggtgtggctgtgtccccacacaaatctctaattatagttcccataatcaccacatgttgtgtgagggacctagtgggaggtaactaaatcatggggtgggtctttcccctgctgtcgtcatgacattgaataagtctcacaagatctaattctttttttctttttttgagaccgagtctcacactgttgcccaggctggagtgcagtggcgtcatctcagctcactgcaacctctgcctcctggatttaagcaatttttgtgcctcagcctcccaagaatctgggacaacaggcatgagccatcacgcctggctaatttttgtatttttatcagagatgcggtttcaacatgttggccaggctggtctcaaactcctgatcttgggtgatccacccaccttggcttcccaaagtgctgtgattagagatatgagtcactgtgcccagcctgatctaatggttttataaaggggagctcccctgcacaactctcttgcctgctgccatgtaagatgtgactttgctcctcctccaccttctgccataatcatgaggcctccccagtcatgtggatctgtgagtccattaaacctctttttcttaataaattacccagtctcaggtatgtctttattagcagagtgagaatggactaatacagtaatccttaaagccccggaccccaaaatggagttgccacaggatggcagtctgaaatccttgtgatgtccagctggcagaaaggaatttggatgagtagggctggccaacttctggtattgctggtgggtcctgtcattgtgtgggtgactccttgcacccctgacccttcataggactgaaatctgggagtgttcttgggaaagggactagagaaagcaagaggacaccaatcttcttccaggcagtaggaaggcaagctggaggagccaagctcccaagtaaactgaggcacctccactggcccctttgtgaggcacgcttgacctgggtttcatggaaagaatgtgccctcaccaaagggtgctaaacaaggccccaggctccacaccggatcccaggtgcccccctctgccctgccctagactcacctaaagctgtactgcccagagtcatggcctcaggccacacgtggctactggtcatttgagatgtggccatctcaattgagatatgctgttagtataaaacatacactagatttccaaggtgtcatgagcaaaaaaaaaaaaaaaaagaacatagaatatctcattaagaatttttaagtattcattaatgttgaaataaaaatattttgaatatattggttaaataaagtttactaggagaattcatttcaccccttttactttttctaatgtggtgagtaaattatttaatattacacgtgtggattacattatatttctattggacagctctgttctaaagtctgcgcattgtccttttgtggcttatttccttgatacttttattaaaattaaattgaggggccaggtgcagtgactcacacctgtaatctcatcattttgggaggccgaggcaggtggatcacctaaggtcaggagttcgagaccagcctggccaacatggtgaaaccctgtctctacataaaaatacaaaaattagccgggcgtacgggtgcgttactataatcccagctacgtgggaggctgaggtaggagaatcgcttgaatcctggaggcagaagtagcagtgagccaagatcatgccactgcactccagcctgggggacaagagcaaaaatccaactctaaataaataaataaatagaaaaataaaattgagggccaggcacagtggctcatgcctataatcccagcactttgggaagccgaggcaggagggtgactagaggtcaggagttcgagaccagcctcgccaacatggtgaaatcccatctctactaaaaatataaaaattagctgggctttgtggtgggtgcctgaaattccagctactctggaggctgaggcaggagaatcacttgaacctaggaggcgaggttgcagtgagctgagattgcacgaagcctgggcgacagagtgagaacctgtctcaaaaaataaagaaagaaataaaaataaactgaggaaggattgagcatgcaaaatagaatcagcctttgaccctgaataccctgcagtgagaattcccctgtggttctcaggcttctgtcattccagcaaatacactcttccctcagcttcactaaaatgcagatattgtgagataatgcccatttctcacagcttgcttgaataataacaatgatcattatagtaatttacaacttaatagtcaacactgcctttttaactcagtctgtgagactgaatcgtaaacgtgacattctttaaagctgtcaattaatataccagactgcataaactctaataacttacctttccatggaaagagaatatgtgggtattctctttgaagacaaatggtggagagtagactctcatccaagaccctctggcagtaatgagttgcattccagaaggttctagaaggttctgtggaaggctgcagtttgggattggttctcaggtgtctgtctaactgctttctaaggatgaagactgccgggcgcggtggcttactcttataatcccagcactttgggaggccaagacgggcggatcacgaggtcaggagatcgagaccatccttgttaacacggtgaaacctcgtctctactaaaaatacaaaaaattagctggcatggtggtgggcgcctgtagtcccagctactccagaggctgaggaaggagaatggtatgaacccgagaggcggggcttgcagtgagccgagatcgctccactgcactccagcctgggcgacagagtgggactccgtctcaaaaaaaaaaaaaaaaaaaaaggatgaaaactcctggttcgtgctttagcaacatccacaggagcaacagactaagacattcctccacacaataacagacccaggcagtgcagagccatgtgggtcttatctgtccttttgtccacagtctggttttatcttagacctagcctggtgcaatcgatgatgcatataggcactccacttaagtttcctgtttgtaaaaagccccttttattcggtgattcctcagggctttaggggaactttctggaaaccaggaagaaggaaataaaggttgttttactgaggatgggtgacattgggtgcaggacccaaatgagtggtttgagcagaaagtagcctccacactggactaatgcttggcaacattatgggaaaatttggggaagcctggagaggagggggcagagtttctttcccagccagccagggggtccaggcagttttggtcctaggatgtctctctgtgcattcccaagtgattgcaaggcttcttcttgtcatcgtctgagacttggattccccaagcgtccttcttttcctggagcctctgagtcctctattcctgaggcctttcttcagccctcccaatagtcctgccatgatttcattgcagggctgtgaccatctatgacaagccggcatctttctttaaagagacacctctggacctgcagcaccggctcttcatgaagctgggcggcacgcactctccgttcagggcccggtaggcctcccatcctcagctgccttctctcctgctcaccactgtcctggcctctcccgttctcactgcagacctgggaacccactcatccaggggttggcacactaaggctacaggccagtctcctgcttttgtaagtcaagtttcattgggacacaacacactcattgccttctgagttgtctacagccgcctttgagctacaatagcagaatcgcgttttgcaacagagaacccgtggcctgcaaagcctgaagtatttactctctggccctttaagaaatgtttgtggacccctgcgctatcttactctcctgccagtgggttcccaggcctgtggcaggatctgtggacctgtgtgtcccctggggtgtctcacgtggttaaggaggggacctttgtgcagatccacacaccctaagctgtgcccctgggtaagttggggtggtgtgggagggagtccctgcaccctcatattgagtccaggggatgataagacagtaagtcccatggagaaaaggaatgagtcagtcttgtttgctgttgtaaccttagcacccagcaacaatattagagaaagcaagcccaggcctcggatggcaggggtggcctggtgctgctgatgtggccgggcaccccaacctttgggagcctgcaggccttgccacggcaggagatgcccgtcctgggtcctgggcctgctctgtggcctctcacaggcttttttcctgctctttcagttcagaacctgaggaaccagccacagagccgtcggccttcatggagtgggatgctgggagcgggctggtgatgcttctccgcgagcagccagccctgctggtcagcagcacaggctggacaggtctgcacgacccctgaaacacttgggcttggtgtgacgggcacctggccaatctgtgttctcacccctgccagtcctgcatgcccccaccccgccacggtctcaatgagaaggggagggtgtatgagctggaagaggggtgtctagaaacaagcccctgacattcaattctcttctcatagaggatgaagacttctccatcctgctggcagctttagaaagtaggtgtgtagctgtggtgaggatctctgggcttgttgggggccactgagctgtgagctgcttgtctggcctgcagcatgttcctgtcccgggccactgggcggggaagcctggggacagtggagatggtggaggtgggccgccctgaatccccagttgggtcattgagtgaccaggccctcaggctgaaatgcctcctccaggagagtatctcacagaggctggtggcctccccacaagagcagtgctgtttctccaactgaccaggtgactctggctattgtatatttaaaactttttttctgaatgggcatggtggctcacacctgtaatcctagaactctgggaggccaaggcaggcagatcacctgaggtcaggagtttgaggccaacatggcaaaacctgtctctactaaaaatacaaaaattagctgggtatggtggtgggcgcctgtaatcccagctacttgggaggctgatgcatgagaattacttgaacctgggaggcagaggttgcagtgagctgagatcatgccactgcattccagcctgggtgacagagcaagagtctgtcagaaaaacaaaaaagaagaaattctatcagaaattccatgtagaattgtttctttttttaaacacagagtttgagcaactgactgttgatggacacaaccttccttctctcgtctgtgtgataacaggtaccgcctgggaccctaggtgtctgtttggttgggggatggcggagggggaggggcacgcagcctttaccctgtgcttcccacgatcttgtctccttaatcttcactgcagctctctgcatagggtcttatactgcttgacatgggggaaactgaggctcagagggtttcacagcagggcagggagcccagatttgaatctgtagatacaaagctttctactttttcagtagtttccaagcatctttttgttgttgttgttacatcattagtgtctttttttctttttttttttttttgagacagtctctgtcacccaggctggggtgcagtggtgtgatcttggctcactgcaacctccgcctctcacattcaagcaattctcatgccttagcctcccgagtagctgggactacaggggcccaccacacccagctaatttttgtatttttagtagaaacaggatttcaccatgttggccaggctggtcttgaactcctgacctcaggtgatccacccaccttggcctcccaatatgctcgaattataggcacgaaccactgtgcctgaccatgtcattggtgccttaaccaagcctcttttaagttttcaaacggaagagcccctgtcccacagttactgctgctgagccctttcaaggtgactcagtgaggagggagaaaagcggaagtggtgtgggaagaggcgggatctgggccagctgctggtcctgctctcctccctcctctggcctctaggctcccaggagtggtttggaacccgctccatgtgctctggaggctgtggctgggcaggggcggtttggaacctgcgccatgtgctctgggggctgtggcagggcagggggagtcctcgtgtcccctgtgcacaacacagacaaaaggctgggtccacccagtgggcggtcgcgtgccaggccggtgcttaccccgccatgtttgcagcccgaggccagctggctgcaagagcagggctgtgcgtcaggggtcagtgtgcacacaccactgcaggtctcggggctcctgggttgcttctggaagggcccagatggggcctgactggagctgccgaggggtggatcttctgggaaagggatccctcctagtggggagtgtcttgggcctggggccacttggcagggtcagagacgggtccatggcagtatctgctcttctctgtgaaggccaagggcctctgacggagtattacagccgccccatccaccagaagcatttccagcacatccaggtctgcaacccttggctggaggccgaggactaccccctgcttctaggtgagaggccagcaggaggctcagggaggaggcggggccttaagcagggggaacagatgtgggcaggatgtactttttctgaaaaggtggctctggaggccacttggggacaggacctgggctctggctaactcccgggaggaggctacttcctggtgtgccagcccctccctgccaggtggccccagaggccctttaccaaggggtttgaggaggccatgtcctttcagcctgccacgccctccattcagtcctcttccttcctgcaggagggctgggcctggggttggggcactgttgcccaggtgtgggagggcagtggctttgggaggtacagggacgaggtgtcaaacagcgttgcctctcccagtgagatggttctcctttgcctccgtctctttccccgattgatttttccaaatggggagtcgtggcttggtcctgatgcatctctagagctgcatcttccagcttcgagtgagcagagcagttgaaggctgagggccttttcctggcaggactctccaggtagtctttgttttagacagtctcgctccattgcctaggctggagtgcacgatctcagttcatgcaacctccgcctcctgggttcaagcgattctcccacctcagcctcccgagtagattacaggattacaggagcccgccacaacacctggcttatttttgtatttttagtagaaacagggtttcaccatgttggtcaggctggtcttgaactcctgacctcaagtgatcctcccgccttggcccccctaaatgctgggattccaggagtgacccatcatgcctggccccagctagtctttagaaatattaagctgtttcgctttattttcacactgacagctggtttgtggtgggtgtgctgtggtttattattattattattattattattattattattattattattattttgagacggagtttcgctcttgtagcccaggctggagtgcaatggcatgatcttggctcactgcaacctccgccttcccgggttcaagcgattctcctgcctcagcctcctgagtagctgggattacaggcacctgccacgatgcttcgctaattttgtattttttttagtagagatggggtttcaccatgttggccaggctggtcttgaactcctgacctcaggtgatccgcccgccttgggctcccaaaatgttgggattacatgcgggaggtgaacctgggaggtggaggttgcagtgagctgagattgtgccactgcactccagcctgggtgacagagtgagactgtctcaaaacaaaacaaaacaaaacaaaacaaaataacaacaaaaaaaccaaattgtgatttagtagaaaaagtgtcaacttacattttcagatgtcccagccaggccgtgtggctgcttggccggcttaagccacttgtgcttggggctgtcgggggccttatccgattttcactcccctcgggggatgttgtctcactgtgctgggaggatttgtgttcccagggcagagaccagtgctctgacccacccctcttgcctagcagggtcggtggacctgggtgtctgtctgcacacatcctccagtggcctggacctgcccatgaaggtggtggacatgttcgggtgctgtttgcctgcgtgtgctgtgaacttcaagtggtaggagcagaacccgaatctttctggggatagcttcacagatccaccgctgagggggaagcagtgtagagtgagctgcccacagtgaggccctgcccctcggtcagtccagcacacactggaggccatgaggaggagccctgcggttactgtggctgggctgagcctcactgaagtagttgcttccatttagagctcatgttatatttaggttggtacaaaagtaatcaccgtttttgccattaaagatggcaattacttttgcaccaacctaatatggaaaaaaagcatgttaaatactagaactccactcggggcttttgctcctagagtagaattggcgggaattgcctgcaggcttacatggttttctttgtttctttctctcccaccatgtcccttttggccaagctcacgtggtgggtttgaatcagttaaatgagtgtcatgctgtggccccactctacccagcacagacgtgtgtttggaagggcggcgttagaggagattctagaagcagtagccccagcacaagctgagcccttggcccctgctcaggagccggctcctggatgggatccagggatgtgagcccctcctgtgagctgagctcagggaatgtcgggatcaaacctggtgccctagaaaagtcatcttttatgtgctgagccagtcccccgggtgttccctttacttgttccatggccatggagttaagaaaaacatgcaaaaataattcttcagtccttgaagagcatccagcacagaaggtacaaaccccccttaaggctccctcttcaaatcggtttggccatttagatgtgtacccccctttatacccttcagatgccaaatctaagaaccaccccccggaaaacacaccccctgttccaactctcagcctggcttgagcatggggtgggaggctgaagcccaggtgggcaccccaggggtctggtgtcttctccaggcagctctcaggctcccttggttctctctgcagtttacatgagctggtgaaacatgaagaaaatggcctggtctttgaggactcagaggaactggcagctcagctgcaggtagccacatctgccaccacgcgagggtggagagggttctggagactggcactgagccatgctccctgatccctgcttcccacagccagggtgggaccatgtggggtctggcggaaaagctagggagagagcagaagtcacagaggctggcctactctgctgtcccgtttcggtacagtaggctcgggaaagttaggacacacccccacctgccctctggatttatggagctgacactccacaaatgatgctggagccgggtgggccgggctgcagtttcggaagtgatcaggatcaggtaggtgcatgggcaaagggaacttctgggaccagccttgaaagatgggtggaattctgcaaaggttacttgtttcttattgctaaaagtaatacatcattcttgccaacagaatgattggcaggattttcagtaaaggtccaggtcagaagtcatttagactgtgtctcctagtctctgtcagaaccatggtactctgttgtggtgtgaaagtagccacagatcatcttcgattaaggggtgtggctttgttccaataaaactttatttacaaacacaggctgtgggctggatttggcctgcaggctgtagtttgtgatccttgattcagacagtttagcaaggctgaaaagaacaccaacacccccttgttacccacagatgggtgggacttggccagaggccaagaggagggtgctcgcaggggaacatacagcgtgtagaggccgggaggtgctccagggcacgaagtgtgggaaagtgggacagaaagcgtgatgtcaagttggaggcggagcgctgctggggcgtgaagagtctcgagtccaagtgagggagttaggaacttgggagggtttgttgttgggtcggggacctggggtcagccaggtggtgacctgggatggggtggggacaggaaatgagttaagctctgctctttatttttttgcagatgcttttctcaaactttcctgatcctgcgggcaagctaaaccagttctggaagaacctgcgggaatcgcagcagctccgatgggatgagagctgggtgcagagtgtgctccatttggttatggacacataactcctgggccagaggctaaaaccccgggacccctgctgtccttcccgcagcttcttctcggagtctcagggcaaaccctttcgagcagcgcctcccagtggccagaaggtgaaatgacggcagtggtgccgcctggtaaatgaattggttctgtgacccgggaagctgtgcttggctctgatttcttttctggaggctcggaaacacttcctatcttcttctgttcttcacgccccatgcccctgctagcggattactgttctgcgacttccgtgtgacctctgcagtactcctcatcctgcgtttgctctccaggtgtcatctttccgccgtgttcctaacattttgattcctgtcttgaaaaaagcacctgctgcactgtaagcccagggatgtggcagctgcagtgggcttggctttgtgaagaaccgagtgtgtccacggatgtggcagctgcagcgggcttggctttgtgaggaaccgaatgtgtccagggatgtggcagctgcagcgggcttggctttgtggggaaccgagtgtgtccacattgggggaacatcatacttgatacacacgtttttatttgcacaaagaaaatgctatttttggagccagagatttcatgtctgattgatggcgattttcttaagaaccagaactgctggcagaaagggagcacccacatgcttagatagctgatgtcttattagagggcagtttgtggttcctgatttggaaattaacattctccaaacattccagtccaatgaaagttttatccgctttcccatataaaaactcttcccactagagtgacttgattctcacaatcccgttggagtcgtatgtgagtcctacagtgtgaggttcagcattgccatctccaagtgctcttcgtagggaaacagtttctggtcatgacgaggttccacttcccatctgatcccagcccggcctggaaacagaggacatgtgtttcaggatggcagtgtttggggacaggacatgagcgtattgtgtggggctgctaggacaggcctggcggggtggggggtgtgtccaagtcagtttacttggttcacaggttcccaggcccacccaggtgcctagaattggcctccaggatgggacaagaaatctggttttgcatagaaatggctagcagcaggcaccgtgccgctgtccactctctgcccgcatctgccccagcacttggcacagcgggacagatgcagagatctgaacccacatctacctggctgctcagtcaacccactattcacaaagcttagaaagcgtccaggcacagtggctcacgcctgtaatcccaacactttgggaggccaaggcgggtggatcacttgagatcaggagttcgaaaccagcctggccaacatggtaaaacctcatctctacaaaaatacaaaaattaggcaggcacgatggtgggtgcctgtaatcccagctacttgggaggctgaggcgggagaattgcttgaacccaggaggcggaggttgcagtgagccgagattgtgccactgcacttgagcctgagtgacagagtgagactccatctcaaaaaaaaaaaaaaaaaaaaaattacacacacacacacacgcacacacacagcttagaaggggctggtgttctcataagcacagatgtctgaagagccgttagccagaatgattctttttttttttttttttgagatacgatcttgttctgtcacccaggctggagtgcagtggcacagtcattgctcactacagcctcgactcctgggctctagcaatcctcccacttcctgagtagctgggatgacaggtgcgtgccaccatgctagtaatttttttattttgtagagatggggtcctgaatgcatggcctcaagtgatggtcctgcctcagcctcatttattatttttttttaaacagagatttactctgttcccaaggctggagtgcagtggtgcaatctcagctcactgcaatgcatcccaggttcaaatgattctcctgcctcagtctcccgagcagctgggattataggcgtgcaccgccactcctggctaatttttgtgtttctagtagagatggggtttcaccgtgttggccaggctggtcttgaactcttgacctcaagtgatccgctcacctcagcctcccaaagcctcagactcttacagtgttggattacaggtgtgaaacactgtgacccgggatgattttcaatcacagctttttgttacgagtggaaaatgcatatttataaaaatgaagtagtacagacatgaacgtgtagaagtctctataatcctgccatccaaggatggcacctgttaacgtgtatatcagggatgtccaatcttttggcctccctgcaccacattggaaggagaagaatctccttgggccacacataaaatacactaatgctagcaatagctgatgagctaaaagaaaaaaaaatcacaaaaaaacctcgtactgtttttaagaaagtttacagatttgtgttgggccgcagcttggacgagcctgctatatatatattctaggttatcccctataggtatacttatgtgaaaatgattattgtgataatttgtttttgagatgaagtcttgctatgttgctcaagggggccacaaactcctgggcttaagccatcctcccacctcagcctcctgagtagttgggaatataggtactcataactatgtgtgggtgattattattattttttaaacaaaaatggggctgggtgcagtagctcacgcctgtaatcctaacactttgggagcctgaggcagcagatcgcttgaggtcaggagttcaagaccagcctggccaacatggcgaaacctcgactctacaaaaaatacaaaaattagccaggcatggtagcacgcacctgtattcccagctactcaggaggctgagatgggaggatagcttgaacctgggaggtgggaggttgcagtgggccgagatggcaccactgcactccagcctgggctatacaaagccagactctgtctcaaaaaaaaaaaaaaaaaaaaaaggtgggtgggggcttatactatgtgtgctgcttggcactgtttttttcacttcaaagatattgcaggtattttttcacataagtatctgaagaaagacttccttttttttttttttttttttttttgcctttttaagacagggtcttgctctgttgcccaggctagagtgcagtggtgagatcagggctcactgcagcctccacctcctgggctcaagccatcctcccacctcagcctcccgagtagctgggactacaggtgcgcacaaccatgcctgactagtttctgtatgttttgtggagatggggtcccactatattgcccaggtaagtcttgaactcctggtgtcaagaagtcctcctgccttagcctcctaaagtgctgggatgacaggcctgagcctcgcgcccggccagcctcctgtgctaggttgtgcgggactctgtcgtggaacccagtgtgtctttgtgtgctggcttgtttgttggctctgtagttaacgggctgctccacgtggacaggcattggacccgtgtctctgtgtgcaggcagaggctgctgcacgtgcatctgtgcacatggctgccaggaggggctgtgctcagggggagctggggcaaaggctggtggcaatgaggggcttgggtgtagtgtggaggcacgagagcctggtggccgggctgcagcctgtgggagctcgggggttgcttggcctctgtgtgtcccagtgtctttgtcggtgggatgggacaatgatagcacactctcacaggtgctgggggctgacaaatgtcaggtctgaggacagtggctggcccactacggggccagttccccttctctatagtcaccctgctcgtcttccatcaactgggtgctcaggacagtggcgtggtggatccgcctgtacagcctgtgctccagtgtcctgcaggccacagctgtgtccagccctgaccccgactgcccctcctgccacctccattttatagatgaggaaaccgaggcccaagggcttagggaaccttgctctgaagcacacagtagggctgctgggctcagatcctccctccctgtgctgagctgccctcctcctgccacaaggcccccacaccccgagcccacatttctcaccggcctctgccctagttccccacatggtgtgggagtgtggggcttcctagcttttccccggcccccagttctttcacttccactggagtcccgcagggacagcttggggaccatgcaggcccgggtgggcgtgggggctcacatagctcagtggtgaacagctggcacgtctctgggttgcagatggtaagggccacatagacttgaggagcccgctggtgctcccggcaggcagccagcctccgcaggaccccgaccagcgacacgatggcttctgggctatacagcacgtctacggtgaaagcttcaggttactgaaagggaccagcggacagttccaggtcatgctgacctcagcagcagggcgaggccagagaggcagcggtcatatgagactagtagatgccatttgaccatttgggccattagatggaaaggcaattacttgggtgaaaaaggagaacccttagtagagaaagctgcaaaagaccgaagcaaaagaaaaaaatctccagactcactggtgttccttaaaaaatgagttctggttctcggcctatctagagggctgtgaatgacacaaagcctgatcctgccatgaacttcgtgtttcaggcgtctgccaatttgtctgctggcttgcaggggtgggcctgtgtccctggccaccgctggacctgtggttttcagggctgggacccaggaccacaggcagagctctgttcgaccagagaggagactgagtgtgctggcaggggcgaggggttttcggtggcccagccaaacaccaccttctctcaagggccctgtcctcatcccagaagtggttgttttcctcctgtggtctctgaaagacacagtcatgactctgggacagagccatgtggtgatgactgtaacgggagtatgcctgtctccaacaaaagggctgtggctggaaggtcaccttaagagacacccctgtcctttgacgtcaccctggaggcccagagtaactcttctggaagccccatcatgtccatgcccgacagtgtccattgttcccttttcccagagccaagagctgggtagagcttcaaggacaccgcctgcacagagtgcccggggctgggcattacctgctgcaatgacaacatctggctggattgcagattgctgacggaccgtcgcgacgtcccagtccagctgggccactgtcaccctggggctgtctaagttggcagagatatctgcctctaatgagaggccactgagaaggacattccctcagagcttctcaaggacccggctgtgacagtcgctgaagatgtatgcccaggggcggcacatcttgcagatggccaggcctgtgaggccggcgccactgccaagctctaggaccatcctggtgggaggaaaggggaccatgtctgcgactgcaccagggtaagcctgcctcggtgccctgccgtgcaccccgaggtcacctatgagagaaggctgccgggttctcgatggcccattctgcaaggtagagggcagcatctcatgtgaccaggcctgtgatgccgtgggagatgatggctgtgttcttgaagagtgtgactgagcctcctgagggctgcaccaagagagggagagagagtcagtccagcgatcagaaggcaagtggcttagaagacaagtagccatccaccacatggctgaataaaccatgacaggaccaatcgccactcagcaaagagaagcagctaactgttgacatgccaacagcttgcacaggcctcaagggtgtcacatggcatgaaagacactcatctcaggccacacaggatttcattcattgaacattcctgaaacaatggaattctggtgatggagcacaggtcagttgtggccaggggccgggtgtggctatgaaggggtggctgccttgtgatgattcaatatgctatgtttttcctttgtggttttctgtatctatgttttatcttattttttttttgagctctgttccccaggctggagtcagtggcacaatcttggctcactgcaacctctgcctcctgggttcaagcaattgtcctgcctcagccgcctaattaggtgcaactacaggcatgtgccaccatgtctggctaatttttctacttttttttgagacagagtttcactcttgttgcccaggcaggagtgcattggcgtgatcttggctcaccacaacctccacctcctgggttcaagagattctcctgcctcagcctcccgagtagctgggattagaggcacccactaccacacccgctaatttttgtatgtttagtaaagacagagtttcaccatgttggccaggctggtctcaaactcctgacctccggtgatccacctgcctcagcctcccaaagtgctgggattacaggcatgagccaccacgcccggcctaatttttgtatttttagtagagacagggtttcaccatattggccaggctggtcttgaactcctgacctcggatccacccgcctcagcctcccaaagtgctgggattacaggtgtgagccaccacacccggacctgtcaagtattctttgaggactggacaccaggtccttgtgaagcaggtagagtgtgtcacctattggacaaatgcccaacaaccccatgagacatgctgttgttgttgaagtgcttgatttacagacagggaaactgaggctaaagaaggttgatggacctcatgtctaagactgcagactgggtgagtcaggatttgaacccacacccacgttttcactttgtctgtgcaggaagggtatctgggctgtgagggggaggagggtgtccttctcataccagcaaatagctccggtggccctgggtggactccttggccatcagggtctccgccagcacctcgtacagctcgtccaaaggctctgtgtggacagcctcgtgctgggggcagacagagtgagagcttgtttgctttcgttctaatctgtaaaaatggtcagatgattttcaccaagtttggaggggagatttgggatggaatggtgtaataccggccagctggcatataaaacattcacttcattgggcttggtggtgtgtgccgaatagtcccagctactctagaggctgacatgggaggactgcttgagcccaggagttcgaggacagcctgggcaagagaccttgtctctaaaaaaaaaaattcacttggtagggaaacctggatgggagggccttcaacgagaggtgttgagagggtagtgttaggtgtagtctaaggcaggagacaaggattccgtgagagctgccacatgaccatgacagagaggaggaaaaccaaaggtgcttttaagtgagcccaggcacaactgtgagggcggcccatgctgcaggctgtggctgtcagcaggctgcttctccacggctggccccatcctaagattcacagggcagcagcaagatacactgggtgactgctgccctctcctggtggcacagggcagacctgctggtgaccacagatgcacccttttggggaggattagggagaaagcaggtattggagaagcaggggattgtttacttgctaaaattgtggccctttcactcagcaggtctgctactgcctactgagcaacagcctctcgacatccttatgtcaaaccctgcatgttcgggcccatctttaaaatccatcctaggccaggtgcggtggctcatgcctctaatcccagcacattgggaggccgaggcaggtggatcacctgaggtcaggagttcgagaccagcctggccaacatggtgaaactctgtctctactaaaaatacaaaaattagccaggcatggtggcgtgtgcctgtagtcccagcttcttaggaggctaggcatgagagttgcttgaacccaggaggcagaggtttcagggagccgagactgtgccacggtaatccagcctgggcaacacagtgagaccctgtctcaaaaaaataaataagtaaaaaataaaatccatcctgtatcagtcaggaaagagcacattccagcaggatcaatgccgagaattcaccagaggaactagttccaaagttatggcaagagctaaaccttccaacaggggcccgtggggcaacccagagacggacaagagcaggaaactccaaacccttcggcaggcaggacagagggtgtgggtgcaggttccagtgctgtgggctgggctagcctggtaggaatgagaatccatatgctaggagctggggccccagagaagcagctgcggcggaaaccccaggaggcagagtgagggagagacgctggcctccccttcttcccgccctgcattgtctcccatgggtcacacgcggctgcagccagttgcctggttaggcccctgccatgctggggtttgcaaagcaggcccagggcctgggaaggatgggggctccagcacgcaggtggctatgctgtccagctactgggcggacactgcccataactgacctttttgatgagttctgagagaaagcaccaggcatacttgactgatggccggtgcttcacacacacaggatgcttcacagtctaccgcaaaggacagaactttggttgctcaagagcctgtcttaagtctcctatgagcttcaagccaacacggcagagggcaaactccaggctacccgatccctcagcaaagatgtagatggacacagcgttctggccccatgcatctgaagtttgtcttatgatataagccatttcctaaaaatgcttccactgcagtgtcacaggctatggcagcatttctaatgcccattctgagcaagaacgcagggcacgtgggcccaaaccacctccctcccaggggagccagtgtgaaccagggtttgcagtaaagacagtcgccaactgtctggctctatggaagaggagggaaggcccacttggcaactgctctcttgcagcgtgtgttcctggggatgggatggaggggaggggacgctctgggtgacactccagctaaagccgagagaaaccaagtgcaggacgagcaagttccagacagtggcaacaggtgatgcaagctctgaggtggccatgtcctggcacttggaaaggagggcagagggactggtgcagcaggagtggggatggtgggaaaacaggagcctggagggagagggaggagacagtctgcagtgcctgctggctgggagggatgcagattctgcccaagggcagcaaagtaccccacgcaatacacaggctcttcatgctcgtgctggtttttcattttttctgacacagtctcgctctgttgcccaggctggagtgcagtggcccgatcttggctcaccacagcctctgcctcctgggttcaagcgattctcctgcctcagcctcctgagtagctggtactataggcgtgcaccactacgcccagctaatttttgtatttttagtagagatgggtttttgccatgttggctaggccggtcttgaactcctgaccttaggtgatccatccacctcagcttcccaaagtcctgggattacaggtgtgagccagtgcgcccagccttctgctgggttttaaagcagctatccctacatttcatgcttcaccacctacgagagtgaggctcagggtgaaactcagagcagggtgcgagataacttcaggtatctccatgctcgaagccctgacctactgcattgccccaaaagtcttccctgctgtggctgcatcttttccacatggataatcttggttcacctctagcacaggaattcttcactggggatcctaggatgggctgggtgggtgggggtggaggatgtctgcctcgagtttgtatggaaaatgtattcttctggtgcacttctttctgggagggagtctattgctttctcttttcagaaggactcatggcccttcgaaggtgaagacccaggatgcagggtgatctgcacttggccctcaaggccaaggtcaggctgtggctgggccgggtggtgatcctgcctctcacctgcatgcagatgctcttgagtccaaaccccaccctgggcaaagtaagggcccatttaggtctagaagagacaggagtgggcaggacaggcctcatgaatgcaaaaaagaaagtctctgaacatctaccaaattctagaagctgttttgcacctgtcatctctgtttttgctgtggatggtttaaaaactttccctagattcccccctctcatgcagatttttgtatattctgatgtctttgtctaagtcttagaaaatgaaagagctggagctgtcggaggtgacgacacccacctgcagtgctgactcaatggttttgttctttgaacaggggtgtttttaaagggtacaagcacacctgtgcttcttctctcaggtcttccggagagattcaggaggcagggtcatgagtcccagggactctggaattcttaccttctgcaaaatatcccgcagcagctcagaatctgatgagtctcttaactttgcttctaagctctgtgtggaggggagagagagaaatctcaagggtgcattcacaggaacattaagcacgcaatagaatgtgttggcaaagcgctgtgtgatctctccccggggacgtggagccagttggaagtggaagccacagcagctgaaagcctgaccttcagatgttgcagggtgcacctggatgagtcacaggaagaaggctagaagactgactcttggccgcattagtcctggctacttagcggccacccgggtcatgggccagctccctggttgcacttgtcagccaggattgcactggttaccagggcagccatggcaccaaggtttgatgggcttgccatctgagtttaagtggaaatgcagaatgttcccataccagcctgggttacattgtcctcttacaggggcctcaagcccagcagcgaactttggctcccgaattaggtagactgtctcggctggtatgtgacacagggcaaggcacttcattgcttcagagctccttccatgccgtaaaaggtcctacaagacctggtcctaatccctctctctggcctgttctccctcgcccctggcccaccctgctcactccactccagccacactggctgccttgctgttgttcctcaacaacagctggcttgtttccaccacaggacgtttgcatatcctgttccccaagcccttcccatggctggctgcttcaccactcaggccccatttcaaatgccacctctttggggaaggcttccctgattccccgactttggtgactcttctccccagttgctccattcaccatttccctgttttattggctttaaagccactctcatctggtcttttcttgtttcttcatttatttgtttattctctggctctcccatgcaagcagagcctcatctgtcataggtactgctgatccatggtgcctggctcacggaaggcatttattaaacattttgagactgaataaaaacactagctaacaccaacatgcatttaccatgagccaggcactgatccacaggcttttgtactcaaccctgacaacaaccctaagaggtaggtatcattatatcccccattttattaataagaaaacaacagcacagagagatgcacttgcccaaggtcacacagggccaggggttgggccaggattcgaagcaggcaggctgtctcctgggtctgaactctcaactactgcacctaatcaaacaatccctctggtcaaatgtgagtgatgataatagtacccacctcgtgggtgttgagggtgagcccaagttagctttcagcgtggcatgtgaacaattatagtcaatattgaatggagacctatgatgcttttatgaaggtttctattttgggttaaaaatgcacaaatttctcctgaccagaaatgatctctgagtgctaaatatttcatgtcaatggaatagcgcaaatgattaagcaacaccccataaaatggggcagacccagggaggaatatatatccaaactgactcatcccagtgagctcaccgcacatggattacaaatggggccgggtgcattaagcccctctactggcagaagggaggctgctgcctgccatgcgcctgtgctgagaatggcaggtccccagggagacgagaggccacccccttctctgtctcttccatcacaggcgtgagagcctcagagcatgagccaattctgtgcagtgctcgacatacagatgagaacactgaggcacgagggacagcctgtgacctggtcaccacgctcaggaggacgtggttacccgcggtcctgagggcgctgactttttagaatgggcgagggcagctctgtcccagtgaccagaacggttactgcctttaaaaagtcgtgaaaatgatagtgaactgtaccccacaacgagtgcgcctctgccccccaagatggtggagaggcccccagcttacgccgccagcacgcggggcaggaggggtgcgagcgactctggccaggccccagggacgggaaacgggtcgcgcggacctgaccggcgggagcccaggcactcacgtggcgtgagcgccgggggcttcagcacagagacccatcccatctgcccctggactcccgcgagccccgcgggcctctccgctcgccccgccgcccacctgccaggggaaggagcgcagtgcacgcgccgccaggaagcggcgctccaaactctgcagcaagagttcggtccccgcgttctcctcgggcgccatgacgtgggcggggccgcagcgttgcccggagaccgggcggaagccaggcctggactgaagagggggcgggcccagggcagtgggcgggggcagagagggggcggggcctgggggtagggtgaggaggagagtcgtgggggcggctctagggcggggccaggatgagcgttatgaggcgggacctggggtggggccaggatgagcgtcatgagggcgaggcctggggtagggccaggataagcgtcgttggggcaggtcctggggagagttctggttggcgggtcctggggcggggccaggacagggcgatcctggaagcggggcttcggaagcgtccaggttggaggcgtcctggagtcggggccttgcgtgggggcaggataagggtcctggaggcggggcgttagggtgggggtaaacgatgattgggttcaggaggcgagactcggagcagagcccaggagacaggtcttagggcggggctaagggcagacccggagaagggctcaggaggcggggccagggcggggcgttgactatgtcgtagcacgtggccaggcgctgctcggactctgggaggcggagcttaggacgggccgacatggggaggggcccagggtccgggaggcggggcagagtccgggctgcgggctgcgctcaggaggcgggccctgggaggcggagcttagggaggggcaggtgtcggtagggaccaagggactgggaggcgggtcggggctgggctcaggggccgagagggagctgggcttggggtggggccgagacggagcgaggggtccagggtgtgagaaacggggaggggtttgaggaggggtttggagtgtggctcaagttcgggaggcgttacctgcggagggtttgaggcaggcccaggagcgagcccacggtctgccgaagcggggccaggggcgggccccaggatccggagctttgggcggggccgagtccgggttaggggcccgggaggcggggccggttagggcgagggtccccgggatcgtcgggtcaggccttgggccaacgtaggcactctcgcagttcctccgccttcaggaaggtctttttggcaggggccttaggggtgcgcgcttctgtcctggaggcgttatcctagcctcctctccatcagcgccacacatctggagcccgataggaaggagctttccctctgtcccccagcctttggactgtcaccaaacaagccatccgttcaccaaatacttatgaagctcctaccatgtgtctggcaagggagatgtaacagtgagaaaaactaggtgtggtccaggccctccaggggctcagggggtcgtggaagaagtggacattgaagtacttatcacacaaatgagtataaaagtacaatagcgatatctgccacgaaggcgagcagacagagctagcggggcttccaggaggagttttaatcttgcagggacaggaaggaggagttagctcctggggggcggaattgggggtggtggtgatatagacgtggggacagagtggaaaacaacaaaaatataattattttagtt

SEQ ID NO: 134 - DNA, 364853 bp, Homo sapiens
cttctttggaagagaacagatgagggaagcaggagagaaaaaaggaagaggcagacgtcacttccccttgccggctccggcagcgggttggtcggctgagcggcagaaaggcagacggggactgggaaaggcactgtcggtgacatcacggatagggcgacttctatgtagatgagccagcgcaggggctgctgcttcgccacatgctgcttcgccacgaaggagttcccgtgccgtgggagcgggttcaggaccgctggtcggacctgagtgtcccagctgtgtgtcagggctaggagggctggggggagggggggtgtgcgcggggcaagtgaccgtgcgtgtaaagggtgaagcgtgtgaggctgccggcggggcggagagtgcaataactcatacttacctggcaggagagataccctggtcacgaaggtggtttttccagagcgagtcttatccattgcactccggatctgctgacccctgcagtttccccaaatgtgggaaacttgactgtataatttgtggcagtggtagactgcattcgcgctttcccctgtatttttgtcgttttaaaaataggttttgtttgctgcagaaacgcatactgggcgtcagcgtaagctgagaatcaggtctttgttcccatctgtaacttcactgaaactaaaaatttgggacatcgtggttctcacgtttgtaatcccagcaatctatgaggtacgtcgataggttatgtttatgttaatatcgctcgacctcaggcgtgtgtgggcaaatatagtgaacccgtctctactaatctcttatctttttttgttgttgttctatagaaataaaactaagcttttcttttccctatgggattaacagcaaacagtccgctggagtgtatggcgcgatctcgccttactgcaacctctgcctcctgcgttcaagctattctccttcctcaaccagagaatactcagcctcccgagtaactggcattacaggctcaggcaaccaaaaaattaggtccggctaattttttgaatttttagtagagacatggtttcaccgggccgggcgcactggctcgcgcctgtaatcccagcactttgggaggcggaagcgggtggatcatgaggtcaggaggtcaagaccatcctggctaacacagtgaaaccccatctctaataaaaatacaaaaaaaaaaaaattagccggatgtggtggcacgtgcctgtagtcccagctactcaggaggctgaggcaagagaatcgcttgaacccgggaggcagaggttgcagtgagctgagatcgcaccactgcactccagcctgggcgacagagtgagactccgtctcaaaaaaaaaaaaaaaaaaaaagagtgacagggtttcaccatgttggccaccctggtcttgaactcctgacctcaagttttccgcctgcctcgcggcctcccaaaatgttgggattacaggcctgagccaccgcacctggcctgtttacagactttacagacacattttgtttacaagctttacaggtacagttcaattgcgattagtgtatattatgtttggcccaagacaagtgtcttttttttttttccagtgtggcccaaggaagccaaaatttagacaaccctgctctagagggtttgattcatggttccactgggttatgcttattgcctataattccatttgatattttccaaatttgattttttaaaaagcgttttcctgaagcaccctaaagctttcctaataatatgagaacttaaaccagattggatgtgacaaaaccctgctggaatcctgcaacttctaaccttaatgttagatcaagaagcaaaacacccaccagtccaagggtcagggaagctgaagatcatgcctgagctgtaacaacgcccttcccagtatacaaaagagtgtaacagccactcgaattctatcttccaagtgtctcctgttgcccaggctaacctagagctatctaaagatggcaaatctgggaaatgtgcattcagcttggcaaaactgatacattacaaatccaccacagtccacttcttctcaaagtggcatcaatgtacatcttcctcctcttctttttttcctcctcttcctcttcttttgcttcttcctcctcctttttcctccttgtaaaatcatacttaaggttcaaataaagacaatatgaaaatcatactttttctcattcagtgaaaatatgccaaccctttccccaacaggataaagtctttgtctttgaatgatgttcactccttttttagctagatagatcacattccatatttgctttcctgtaacctaaatattgagatttctaaaagttaattattaatgaatgtgctagctagggtgatggaagaggagaattctcaagaaaagttttggttaatatacacccaaatgtattcatctcaaaataatgaagaaatactcataactattacaagtcctgatttctgcaactggcactggcactagctggtatttgtaactatcttcacatcttgtacccacagccagttcctttgggcctgggccggtggacgtgagcgtgggaaggacaagaacccgcggtgccccccaccgcactatcctcgggtctccagaggtgggatccaccgggcaggggcctttgctggattctaaaccggctctggggatacaagaacagctgcctttgagaaacagttcaggtctctatattccagacttcctagtaggactaaacgcttaacgttcacacgggaattcatggttctcctaaaaccctgcggtggaatgccttccttcaccgagcatttattgggcacctactaggtgctaggctggctctgggcgaagggctgcagcctgtgcaaactccaggtccctgtccggtggatcccacctctgagggcccgagggtgacgcggtgaggacaccacgggttctggtccttcccacgcgcgcgtccgctagcccaggcccggcggaaatgactgtgagctcaaggtgtgaagcggggctaagaatgggaaagcgagtgacttccgccggagaagctgcagttgtcgcctgtagaggggccggcgacttttgagacggtgaagagcaggcgggggaaccagtgaagagcagacggtgaggagcaggcggccgtttggccgttggagtcccccagctgactctgcccgggtagaatgtccaaagtgcccaaagactcgactcttggcttcaatgtctcccgtgttctgggtttctggagtgcgcgggattggacaggctacaaacatatgagattatctacggccagaggttaaaatgccatttctggtatcagcaaatctaaaccattagagtctctgtggcgccatcggttagtgccttcggctgtttgaaccgaaaggctggtggttcaagcccacccagagatggtaccttttacttaggcaagattcacgctttctgtttaaagactttaatcctgggaatcttccggacctctactagctttaaattcgatgccaaaatacgctgtgcgaaggctcaagttccatggaagttcctaaaaacaagaatatttcagcaaaagtaatttttcaatagagcctgagcctggggcttcagagcttactccagagccactgcacttatttcatcacttcctgaagctgggtttttacaactgcacattcctggaaatccaaaactcccaataattgaaaacaagaaaatcccagtcttcacttgtggtgaagcctcaatttccaggttgaaatcttggttggttcatgatgtgacttttaaaacgttactgaattttctgtatctctatttcttcatctataaaaacagaaaaaaaaaaagtgcttccctttcctgggtgtggtggctcatgcctgtaattgcagcagtttgggaggatgaggcgggcagatcacctaaggttaggagttcgagacctgcctggtcaacttggtgaaaccccatctctactaaaaatacaaaaatgagctgggcatggtggcaggtgcctgtaatcccagctacttgagaggctgaggcaggagaatagtttgaacccaggaggcagaggttgcagtgagccaagattgcgccactgcactccagcctggtaacagagccgactccatctcaaaaaataataataataataaataaataaacaatgcttctctcatggattaatctaacatttgtgaatccaaaagtatgtgagacaggtctcaataaatttagaaagtttaccttgcaaggttaaggtggcacccatgacacagtttcaggaggtcctggcaacatgtgcccaaggtggtcgggtacagcttgcttttattcattttagggagacagaatacatcgatcaatacatgtaagatttacactgcttcaatctggaagggcgggacaactcaaagggtggggggcttccaggtcatagatttaaaatttttctgattagctattggttgaaagagttcttattccagaagggaatttctgggttagatagggggttgtggagaccaaggttttaccatgcagatgaagcctccaggtagcaggcttcagagaaaatagattgtaaatgtttcttatcagacttaaggtctgtgttgatgttaatgctggttggcttttcctgagttccaaaaggaaggagggtataatgaggcatgtccaacttcttcccatcatggcctgaactagtttttcaggttaactgtggaatgaccttgacctagagcaggggtccattcacatggctggggggccttagaattttatttttggtttacacatttgatgagaaatacacataaagcatttgagcacctaataaatgttcattaaacgttagctgctataattattttcagtggcatcatcatcaccactttcatattttacctcaggcttttaaacaactgcttatctttttatggtatggatgaaccagtatatatttaaatggccctcagctaatggacacaaaattgtgtctaatgcttattcttataaaaaattattcagagaacatccttatacaactatctttcatcatttgtgcagggatttctttttttttttttttttttttttttttttttttttttttgagacggtgtcttggtctgctgcccaggctggagtgcagtggtacgatctcggctcactgcaagctccgcctcccaggttcacgccattctcctgcctcagcctccagagtagctgagactacaggcgcccgacaccaggcccagctaatttttgtatttttagtagagactgggtttcactgtgttagccaggatggtctcgatctcctgatctcatgatctgcctgccttggcctcccaaaggcctgggattacaggtgtgagctgtgcaaggatttcttaaaacacacttctagaaatagacttccctggtcaaagtatttgtgcctttccagtttttctaattgatgcttaattgacctctaaagaagttgggcctagtcatattcccacatcctaagagaatgctccttccttggccacactatctgacatttaatagcagcacaaactcttcacttttgtttggggaatattattgcttgcaggtctcacacatagcactgaatcttacaggtaaggagctggtgctaccctgttctcctttgttctcctgacccctgagaattctgggaaagtggttcacaagagagacttgaggttggattcacctgactgtaaaagtgctgacaatgggtgttcccactgttcctgtgacagagagcccaggcttcagctgctgaagaagaactcagacctaaccctccagggcgggacctttaatttggcacagagttggtccttagccaaataaaaattgaaaaggggagattttaaattttcatctaattaagactttatataatggatctttttcttattgtggcaacaagaggagagattgcattcttgggcttttattgttggaacttaataatactggctattctactgctcttgtggaattgtttggtctatgctggtacatggtacttgctatgaaacactgtctggtgagctggataggcaagtagctaaagaaaacgtcataagaaacagaaataggagttgagtccaatctctctcctgcactgcaagattctgttgcagtggtacctacacctattgccatagcaccccccaaattttctttaaagctaagaaaatagaaatagaggatggattctcaaatagatatacctagagttagttaagtaaagtctgattttgattctttcagaggtttggatgtcttagttatctcaggctgctgtaacaaaataccatctactgggtggcttaaacatttatttctcacagttctggaggctgagatgtccaagatcaaggtgccagcaggtttggttcttggtgtgagtcctcttcctagcttctagatagtgattttttttttttttgtacagtatttaccctggcaataataatcttatttttccatttggttagtttttcatgtatttattacttaatactagccaatttctccccagctctgtaaatctcccctcaacacatagaaacacaaaatcattttgattggtttgcctgcttgtatgtttgttcaagaaatttttcctggcccagcgtggtggctcatgtctgtaatcccagcactttgggaggcccaggcaggtggatcacctgaggtcaggagttcaagaacagcctggccagcgtggtgaaaccccgtctttactaaaaatacaaaaattagtcgggcatggtggggggcgcctgtaatcccagctactcgggaagctgagggcaggagaatcacttgaactgggcaggcggaggttgcagtgagccaagattgcaccactgcattccagcctgggcaaaagagcgagactccttctcaaaaaaaaaaaaaaaaaaagaaagaaagaaaaatttttcctggcacatttctatctgttccgttctggatgacttgctcttcaggcttatcccacagctgttatcataatatctctctttactgcaccatcttgggatttccatcgcctctctcttttgttagatcccctgcttcatggatctcaagggggttcattcttcactcacttcttccttttgatgatgcatatcctccaaaacctcctataaagtggttaccttagaaataaactttttgagacactgcatgtctgaaaatgtctattatacccatacacttaattgatattttactagatagagatacatagagataggttgaaataatttctctcaaatttttaaaagcactgcttttttttttttttttttttgaaacagagtctcgcctcgctccgtcgcccaggctggagtgcggcggcgggatctcggctcactgcaacctccacctgccgggttcaagcgattctcctgcctcagcctccccagtagctgggattacaggcacccgccaccacgcccggctaattttttaatttttagtagagatggggtttcgccatgttagccaagctggttttgagaggagagcactcctcatattgtcttatacttaatttcttgtttgctgaaaaagtggaggttgaaagaatgggcagaagtgaaaatcgtggtcagacaaccgggcgccacatttcgggccttgttgttaaaattcaacccctgacctcaccacttgcgctgtctataaattccagacattgtataaaaacgcattatgaaactcccttttctgttctgtttcgttctgattaccggtgcatgcagcccccagtcacgtacccctcgcttgctcaatcgatcatgacctctccctccacccacagcccctttagagttgtgagcctttaaaagggacaggaattacttattcggggagctccgtttctaggacgtgagtcggccgacgctcccaactgaataaagctcttaccttccacaatccggtgtctgagggattttgtctacgacctctcctgctacagtttcaaactcctgacctcaagtgatccgcctccctcggctttgcaaagtgctgggattacaggcgtgaaccaccgcgcccggcccttgttgtttactgtttccctatagtctttttttttttttttttttttttttgagacggagtctcgctctgttgcccaggctggagtgcagtggcacaatctcggttcactgcaacctctgcctcctaggttcaagcgattcttctgccttagcctcccaagtagctgggactacaggcatacaccactatggccagctaatttttgtatttttagtagagacggggtttcaccatattggccaggctggtctcgaactcctgacctcgtgatccgcccgcctcgggctccgaaagtgcagggattacaggagtgagccactgcgcccggcctactgttttccatagtcgtttctgagaaagaaaaagtaacccttttctgctctcagctagagctggtctgataaacacctaggccatgatgttctccggttcaaactaaaaatttcacaacaccaatatcagacaaagctaccctctcaccaagatgaaagaaagactatttcacaatcatatttgagcacaaacagaacactgttcaaaccataatatgatcaaacattcccctttcccagctactaatagtgactgttaattcttttattttttatttttttgagacggagtcttgctctgtcgccaggctggagtgcagtggcgtgatctcggctcactgcagcctctgcctcccgggttcaagcgattctcctgtctcaacctccggagtagctgggactacaggcgcccaccaccacactcagctaatttttgtatttttagtagagacggggtttcaccatattggccaggctggtctcgaactcctgaccttgtgatctgcccgccttggcctctcaaagtgttgggattacaggcgtgagccactgcacctggccttattttttattttattttatttttttgagacagtctctgtcacccaggctggagtgcagggacgtcatctcagctcactgcaacctctgcctcctgggttcaagcgattctcctccctcagcctcttaagtagctgggattacaggcatgcccaaccatgctcggctaacttttgtattgactgttgattctttaccaattatgtgtttagttctgcaaccattcctcccactttctagataaaaatatcgagattcccaggggaagaattgtcccacaatttccccatagtgtttgctgtctcctctgttgcaatgagccaatatactcagatttgactataggtttgttcctgatggttatagactggagcgcctcaacaccgtagagaagatggatgccgttctgattctttgttatttgccttaaactgttctcccagctcccctcccaaaagcttatagaatcttctacctgttcctactattctgaaacttcatgatctattttcatccaccatgctgggtacacagtgtgctctttcaatataggaatgtatattttggaggtatcattccaaagatgtttatgcatatacagttaaaggtatatatttatttcctgcaactaccatcacccttttgatatacttttgctgcataataaaccatcccaagcttattgacttagaataacaataagttattattttgtgaaggcaccaacatttgcccaaagcaagtcacatagccaatcccagattcaaacagaggagaaatagactctcttgatgagagaagctggaaaatataaccaacatttttttctttttctttttttttgagacggagtttcgctcttattgcccaggctggagtgcaatggtgcaatctcagctcaccgcaacctccgcctcccaggttcaagctattctcctgcctgagcttccctagtagctaggattacaggcatgtgccaccacgcctggctaattttgtatttttagtagagacagggtttctccatgttggtcaggctggtctcgaactcctgacctcagtgatccgcctgcctcggcctcacaaagtgctgggattacaggcgtgagccaccgcgcccggccatgacacaaagtttaaaagaaaaatttttaaaaattttttttggtcaggcgtgatggctcacacctataatcccaggactttgggaggccaaagtgggtggatcacgagtttgagaacagcctggccaatatggtaaaaccccatctctactaaaaatacaaaaaaattagtcgggggtggtggtgcgcacatgtggtcccaactactggagagactgaggtgggagaatcacttgaatctgggaggcgaaggttgtagggagccaagattgtgccactgcactccagcctgggcgacagagattcagtctccaagaaaaaaagtttttttacttttatagatattgtcataaggcaccctgtagaacttgtaccaacttatcctccattcacaaggtatattaaccttcccgccgggcgcggtggctgaagcctgtaatcccagcactttgggaggccaaggcgagcggatcacaaggtcagaagatcgagactatcctgactaacacactgaaaccccgtctctactgacaatacaaaaattagcagggcgtggtggcgggcgcctgtagtcccagctactcgggaggctgaggaaggaaaatggcgtgaaccctggaggcggagcttgcagtgagccgagatctgccactacactccagcctgggcgaaaatgcgagactctgtctcaaaaaaaaaaaaaaaaaaaaaaaaaccctctccaacataaactttaggaaaatttaccattagtttgggcacagtggctcaggcctgtaatcccaacactttgggaggctgaggtgggcatatcgcttgagtccaggagtttgggaccaccctaggcaatacagtgagccctcatctctacaaaaagttaaaaaatcagccaagcatgatggcaagcgcctgtagacccagctacttgggaggctaaggtaggaggatcagctgagcctgagggaggtggaggttgcagtgagccaagatcatgatactgccctccatcttgggtgacagagcgagatactgtctctaaaaaaaaaaagaaagaattccttggatatttctccttggtattttccttttgaactttataatcatattgtctagtttgaataaaaaagaaaaaattctttggacagttttatgaaaatcatgttaaattcagacaccaagtaaaggagaggtgctgtctttatgatgttgagtctcctatccaagaatatgatacaccctcggttaatagggaaggaggctgccctaatgcagtggttcccaaacttgaacattccaaactccctagagagcttgttaagtaacagattgttggggccaccctcggggtttctgattccataggtctaaggtggcactcaatagtttgcgtttatctcaagtttccaggtgatactgaagatgattgtcctgggaccacactttgagaataactggtcattttggagatggttggtggactatatgtaagtgagactaaagcatatttacactcttaaaaaataaaaagtactggtaaatgatccttagggaaaggaggtggaagatctgtaggaggagttgaaaaggaatgttcaggccgggagcggtggctcatgcctgtaatcccagcactttaggaggccaaggcgggcagatcacctgagttcaggggttcgagaccagcctggccaacatggtgaaaccctgtctctactaaaaatacaaaaattagctgggcttgatggcggtcgcctgtaatccccagctactcgggaggctgaggagggagaatcgcttgaacccgggaggcggaggttgcagtgagccgagatcggggcactgcactccagcctgggtgacagagcgagactctgtctcaaaaaaaaaaaaaaaaaaaaaaagaatgtctcttgaatggtgccaatcttggcttccacccacctggcaaaccaacttaacctacgccagcaaaagcaacagttaaagctaatttagcaggaacaaatgtaaggcaaacaactccaggctttcgggaacagaaaaaagttctccggtggatcaataactaattcaaagtagtggacccagcactctggagtggcagcctatattcatcaaataagactgcaactgttaactccctactcgctgccctacccgttcgtctttgctcctccttttctttgctcttccgcttctctcctccgcctcctcaacttcttttctagagccctctcctctttttcctgaccttcctaaaatggttgtattttacagccctttgcggctgatgaaggcttcaaaacctaaaaagcaaacagatgctccctaacacctagctgagaatattttaactcactacaaaggcctttcaaaaccccattcaaaatttcccaccaacaagaagagaaccagtatttccctctggagccgtcctaaggctgttctccctggagcagtgtcggagcgattttggactcttctcagagctgctcagcttgtctgccttcgcccagttgagaagcccatcgtggattcgaagtatgtggtcactacagacactagaatccccagattcctcttttcttttttttttcttttttttgagaccgagtgcaatggcgtgatctcggctcaccgcaacctccgtcttccaggttcaagcaattctcctgcctcagcctcccgagtagctgagattacaggcatgcacctccacgcccggctaattttgtatttttagtagagaaggggtttctccgtgttgaggctggtctcgaactcctgacctcaggtgatccgcccacctcggcctcccaaagtactgggattacaggcgtgagccaccgcgcccggcccagattcctcttttcttgatgaatttggggtgaatggagatgatttctggaatcagttaccataaaaggacagtagccgctgtggcgatttagaagttcatgtttccatggtagctaagcgagagggttaaataaaaacacagcgcccaacgtggggctcgaacccacgaccctgagattaagagtctcatgctctaccgactgagctagccgggcactgattactggcgtcttcttatgtggaatcattttccactgacggagcggttgtatgatctaattgcatattattgcgtgtgaaagaagtttcaggacctaggactggtggacacggcagtagccttttcataatagctttttgccatgaaggaattcggggtttagagagcgatgggggctgcagagagccaggaagtctcgcggaggactcgggaatcacgagtcctgcctgaaaccttagtgttttccgcacattccttccactgagggaacctcctcacccacttcagaggagggtgcgaaagagcccaaggaaactcagatgagaggcgcaaagacctctctgcaaagcattttaattctccatcctggaagaggcactgagttccagagtcacaagggaagggttctctcctctgctcaagtgaaggccaaaagaacaaccgtggtcccagctccgtgggcctccatatcgctctaaagcttcccgcctgggctgcttagcaccttggtgggcgagccgcagtgtgagccaactggaactattgttgtttgagacagggtcccgctctgtcgcccaggctggagtgcagtggcgcgatcatagttcattgcagcctctacttcccgggctcaagcgatgctcccacttcaccctccctaagtagctgggaccaaaagcgcccgccaccatcttaaaaattctttttctggccgggggcgatggctcaagcctgtaatcccagcactttgggaggccgaggcgggtggatcacgaggtcaggggttcgagaccagcctgaccaacatagtgaaacctcgtctctactaaagatacaaaaattagctgggcgtggtggcgggcgcctgtaatcccagctactcaggaggctgaggcaggagaattgcttgaacccgggaggcgggggttgcagtgagccgagatcgcgccactgcactccagcctgggcgacagagcaagactctgtctcaaaaaaaaaaaaaaaaaaaaaaattctgacattgtggggaggcgtctcaagctggtcgcgaactcctgggctccagggattctcccgcctccgagacttcccaaagctgctgggattacgtaatggcgcgagccaccacgtcggcctggagctattgttattcaccgaatctgtggactgcacttccgcggggatgccttaagcgaaggcagaattacaagcatgtgtcactcttttaaaagtgttaattaaaaaaaaaaaaaaccgccaccccagcaagttagaaccacctgccgtgactcggattcgaaccgaggttgctgcggccacaacgcagagtactaaccactatacgatcacggcgagccactaaccaggcggcgcgctacagctggatttaatgcctcttgaaataggaatggctatttcgtgctacttttatttggccagtccctgacgtccgcatcaatcaattccaaactttttcactctgcaaccttgaagctccgacacctgaatcagtttcttagactctaaatccctcgatgccagcgatagcaccacccgctccgctgggcggcggcgggccaaggtcctgactagagggcagaaagcgtcagctgcaacccgggaccacgccgcctctcgcctctctcctctcacctctctgcctccatttccctcttccccctccaaggaatcaagctgcttcgcccagggatgagaggggcagcctcgaaggatttttcaaattacatctgcagcctgtaccacggaattgaggtttctcttcccagaatggtggaaccggaagaaaaacggagctagtgagctggggaggggatgagagccccgtcttaatttcttgcttccctcacaggtacaagaagcgctgtgtactctctggcattgtgggagcttgtgctgacttcctcatcttgactcataaatatatcagagccacctctgccgattcagaaaaacaaatccaaccagcctctatttcagacacttccttagacccctaggagagttattgttaacttccctagacccctaggagagttattgtttggacgccagcggccgaacccatcagacgggctaggcgcgcacgtgcagttaccaaaatacagatgtttactgtgggagggacagaccatactggtgcagacctaggacacaaaagtggtcaaaactcttttcctgtgttccctactttgctcggtttccaggcctactcagtctaaaaagctgaagagaaaaactgacactgcgttggccgggaatcgaacccgggtcaactgcttggaaggcagctatgctcaccactataccaccaacgcatctgaaatacacttgattcctttagagtatcagaactaaataatcaggtttgtcttcccgtttatttctaggctaagcaatttagactgcaggaaaaacctacaagaggaaaattaaaaggaagctctctggaatttctcctattaaaaattctgtagtagtatcttgtttcacagctttaagaaaagtcaattctagtttcctggacatttattccacacatgcgcaaaattacatatgtacaagaccgtatatgacagcatttttttttccaaagagcaaagggctagaaataacctaagtgtctataataggaagctggctaaactaattatggaaaatccatacaacggaatgctatgtgccagaagaaagaatgaggaagttcttcatgtctaatctgtaagtacttccaaaatatactgttaaatggaaaaggcaaagtgcagaaagtgtgtatagattacttccatttgtacaagggggagagaatgtttaaatatatatacgtatgtatatatgcatgtacttgcatttgcataaaacatctctaacatcatgaagaaacttaacagcggttacttcattagagagaaaataaatggtagaggtgaaaggtttatcagttctgcccttttgtatatttgaatcctaaaccatgtaaatatattaccttttcgaaaatccagtaattaaattgaaagaaaatacgttactgaaggatatttatttccactgcaaagtgttagaaatacattgttaaccttaaaaatagctggtgttggccgagcatggtagctcacgcctataatcccgtcactttggtaaggcagaggcgggtggatcacctgaggtcaggagttcgagaccggcctcaccaatatggtgaaccccgtctctactacaaatacaaaattagccgggcgtggtagcgcaggcctgtaatcccagctacttgggaggctgaggcaggagaatcgcttgaacccgggaggcggaggttgcagtgagccgagatcgcgccactgcactccagcctggggcaacgacagcgaaactccgtctcaacaacaacaaaaacagctggtgataaaatagtattatagcatacttccactttgtttcaaaacctagatattgagtggtcttcgggtgatagaatggtgagcgatttctttatttgtgtttttctacattttctgtatttcagttttcagtgggatggggaagattgactagcagataacgtttatttaaaagatcctgagagaaagcagtaaaagaagatgttactctttccctgaccgggaatcgaacccgggccgcggcggtgagagcgccgaatcctaaccactagaccaccagggaagctgctaacccttcccggttgcagctatatgattctactaagtgctgcggttcgtgcctgtaactgctaaacactgaagccaaagtggccagattgctggagctcctagttcgagaccagcctgggcaaagtggcaaacccgggctctatcaaaagcacaaaaaaattagccgggcgtggtggcgcttgcctgtagtcccatctacccgagaggccggatcgcttgagcctggtaggcggaggttgcagcgagccgtgatcgtgccactgcactccaacttgatgacagggccagagccttcctcaaaaaaaaaaaaaaattacattattctaactaaaagtttatttccacttattctttttcatattatttttcactgcctagattctgagattcttgcatactgggcctttcctatgttggggcttcttcccggtacttctttcctgcagtagaaaacattgtgaaagaattctccagcccggctctcagagcctagggagcatcgtgtacacgtgattacagtccccaagaccagagaccaatgtccggagagaagagggtgagacagagaggaagctcacctccttgtagttgcagtgatttccgaaattgtgaacattagaaaagtagagacccagctacgtctttgccaaaaacaaccaggaacttttccttaaggaacataaaagacgtcatgcgagtaacactaggagatcctgggcccactgtaccttttttcatgtcgtgtgaattgtaggccaaactgttaaaacaaatattacagacgagtgaaaatcactcagcctagaggtacttggtgctcagcaggatctgagctcaactcactagtgggagactaagagaaactcagggcctttaacctttaaaaattacgaggtcccgggcgcggtggctaatgcctgtaatcccagcactttgcgaggccgaggcgggtggatcacgaggtcaagagatcgagatcattctggccaacatagtgaaaccccgtctctactaaaaatacaaaaagtagccggcgtggtggcgggcgcctgtagtcccagctactcgggaggctgaggcaggagaatcgtttgaacccgggaggcggaggttgcagtgagcggagattgcgccattgcactccagcctgggcatcaagagtgaaactttgtctcaaaaaaaaaaaaaaaaaaaaaaaataaattatgaggaagccgggcgcagtggctcagacgcctgtaatcccaggactttgggaggctgaggcgggtggattacctgaggtcagaagttcgagaccaacctggccaacatggtgaaatcctgtctctactaaaaatacaaaattagccaggcgtggtggcgcttgcctgtaatcccaggactttgggaggctgaggcgggtggattacctgaggtcagaagttcgagaccaacctggccaacatggtgaaatcctgtctctactaaaaatacaaaattagccaggcgtggtggcgcttgcctgtaatcccagctactcgggaggctaaggcaggagactcgctttaacccaggagacggaggttgcagtgagccgagatcacgccattgcaccccagcctgggcaacaagagcaacacaaaataaaaattgcgaggaaggaaaagagggagtgaagagaaagaaaactggggtgcatgcattaatgtgttgcaagctaactttatgagcgagaaaagaaagcaaatgcgggctggatacagtggctcaagcttgtaatcccagcactttgggaggctgaggcaggtggattgctttgagcttaggagtttgaaaccagtccaggcagcagggtgaaatcctgtctgtaccaaaaattacaaaaaaaaaaaaagaaaaagaaagaaagaaatcttagtgaattgtgtttgccatattgtactttcagcttttctgtaagcttgaagttttaaaaaataaaaggttaagaaaaaaatgaaacaatcaaaagcctccccttctggtcttttttggtcagatgaccccaagtgatgaattctgtgcccatgagttcaagcagaaatttttaaaagcaaccccactccccaaacacactcttacatcagaaaatatttttgataatgaatttaaaaactgaaagattgaatcatcaatggtgtctgtatatcagcaaggcctgacagaaaaaaaaaatggatggtgagatacagagtttggggggattatcatagttgttgttttgagacacggtcccactttgttgcccagactgtagtgcagtgctgagctcctacctcagcctcctgagtagctgggactacaggttccggccaccacactcagctaattttgtgtctgtggtagcagagatactaggcctcaccatattgcccaggttggtcttaaactcttgggctcaagccatcctcccacctcggcctcccaaagtgctgggattacaggcataagccacgaagcctggtcttgtttggcttccaaagtatcaatgttaaaacgttgttcaagaaacgttgtttaaatcttccactcatccagtctccacttttctatgggtttaaatgccataaaataggaagacgagtaactaaatgttagacatttattttcacaaagacaacaagaatcctgttgtcatgtcaccaaggagcctaacagagcccacttccttttactccagctgttttcactggaccaaggctgaaaaacaaaaagcatctaaccttcagaacaacatctcaggatcttacccagagtggggacaaggcagcagaatttatttttctatgttgcagaggaaatcagcctcctgttttggtcaacagtactttttcatcaattattctgccacctgctggtaattttttgttaaggacagaccgaggaaggacagacagtatgagctatgggagctagccacttgtctcaacatcaaagtaccagaaggaatctggtcaaagcaccaagacaggattaagcctcctcttcttgccggtaatgcatacctaaagtggatgagggaggagtgtggctcatttgcttcactctgagttctattttccttttttttttttttttttttgagacagagtcttgctctgtcgcccaggctggactgcagtggcatgatctcagctcactgcaacctccacccctgggttaaagcgattctcctgcctcagccccctgagtagctgggactacagatgcccatcaccatgcccagctaatttttgtatttttagtagagacgggatttcaccatattggccaggctggtcttgcactcctgacctcaggtgatctgccagcctcagcctcccaaagtgctgggattacaggcatgagccaccgcacctggcctattttcctttttaaaaacatttacagatcatgtgccagacgaggtattgaaaatctaaaaatacacctaagctgggtgttgtggctcatgcctgtaatcccagctacttgagaggctgaggcacaagaattgcttgaaccccggaggtggaggatagggtgagctgagatcatgccactgcactctaggctggtgatagtgcgagactctgtctccaaacaacagcaaaacacttaaagagctgaaaatctagtgtaaaaccaaataaacaagtgaataaaagagaatggatcagggaggattgagtagatgtgatcttccctcgtcctcctccctggacattatatataagacaaccctaagaagactgaaatgtggagagaaggaggtagaccagctaggagccccagaaacaaaggcaggacacaatgctgatttctgtggactttctttttgcctcatatatgccatacttggagctaaagaaaccagcaacctggaaatcccaataggagcagcctaaaaattccctaacaaaagcctgttctctctagccaaaggatcaggaatgaggcagtctagcaaaacagaaaacttttagacaataattgcactattccagccaaatgccacagaaacaaactgtggcttgtcctctcctattctggcaaagactgaatggggtgcctagacttccaccaccagcaagtctattaggaatcatccctctctttcctgttggggtggtagcagaagaaacttaatagagagtcaggactttcacccaaactcagtgagtggtaatgaggctaccccctaaggaaagaatcagtgaactgaaagaacagtagaaattactcaatctgggtcaggcgcaatggctcacgcctgtaatcccagcactttgggacaccaaagcaggcagatcacttgaggccaggagttcaagaccaggctaaccaacatggcaaaaccctatctctactaaaaatgcaaaaacaattagctgggtgtagtggcacacacctataatcccagctacttgggaggctgaggcttgaacctgggaggcagaggttgtagagagcgaagatcgtgccagtgcactccagcctgtgcaacacagtgagaccctgtttcaaaaaaaaaaaaaaaaacaactcaatctgaaaaacaaacaaaatagactgggggaaaaatgagcagagagcctcagggacttgtgagattataacaaaagatttaggccaggcacggtagctcacgcctgtaatcctagcactttgggaggccaaggcgggcagatcaccaggtcaagagatcaagacaatcctggccaacacggtgaaaccccatctctactaaaaatacaaaaaattagctgggcgtgtgcctgtagtcccagtttctggggaggctgaggcaggagaatcgctttgaacccgggaggcggatgttgcagtgagccaagatcgtgccactgcactccagcctggcaacagagcgagactctctctcaaaaaaaaaaaaaaaaaaaaaagatttaacatttgcgacagcaaatttcctggaaggagaagaggaagagaacacgacaaaaaaagtaccaaaggatttggtacagggataaacctacagattcaagaagctgaatgaactcctaacaggataaacccagactacttcaggccaagacacattgcaatagtttggatgtttgtcccctccaaaacttatgttgaaatgtgatccccaatattggaggtggggccaaatgggaggtgtttgggtcatcagggtggatccctcatgaatagattaatgtcctccctcaccagcaaatatgttctcactcttagttcctgcaagggctggttgttaaaaagagcatgtcacctaacctcttttctttcctcttctcttgccattgatctctgcccaaaccaacttctcttcaccttccactatggttgggagcaatctgaggcccttgccaaatatagatgcccaattttgaactttccagccatcagaatcgtgacccaaataaaccatttttctttataattacccagccctcaggtattcctttatagcaacactaaatgaactaagacacacatcatagtcaaactgctgaaggctaaagacaaacaaaaaatattgaatgcagtgaggggaaagcaatttgaataaaagcagatttctctctctttttctttttacttattttgttttgttgggttttctcccatgttcaaccaagttagaaagccattttctcatcagaagccatggaggccagagggaagtggcacaaaattgttcaagtgctgcggaaaaagactgtcaactcagattgctatatccagtgaaaacatcctttaaaaatgaagggggtatgattcaacaacaaaaagacaaataacccactgaaaaaataaatatgtgaaaaaatgctcaatgtcaactgggtgcggtggctcacgcctgtaatcccagcactttgggaggccaaggtgggcagatcacctgaggtcaggagttcaagaccagcctagccaacgtggtgaaactatactaaaaatacaaaaattagccgggtgtagtggcacacacctgtagtcccagctactcaggacgctgaggtaggagaattgtttgaacccgggaggcggaggctgcaatgagccaagattgtgccactgcactccagcttgggggacagagtgagactcagtctcaaaaaaaaaaaaaaatgttcaatgtcattagtcattagggaaatgcaaataaaatcacaataagataacacttcaccaccagaatggctataattttttaaaatggaaaataacaagtgttaggatagggagaaatttgaatcctcttgtattgctggtgggaatgtaaaatggcacacctgctgtgaaaaacagtttggcagttcctcaataagctaaacatacaactaaatatagaatatgattcagtaatttcactcctaggtatataccccaaagaactgaaaacaagcacttaaaaaaatacttgtacatgcatgtggatagcagcactatttataacagtcaaaaagtggaaacaatccaaattccattaatagatgaatggctaaataaactgtggtatataaatacaatggcatattattcaggcataagaaggaatgaagtattgatacatactacaacttgtataagcctcaaaacattatgctcaagaagccagacacgccgggcatggtggctcacacctgtaatcccagcactttgggaggctgatacaggtggatcacgaggtcaggagatcaagcccatcctggccaacatggtgaaaccccatctctactaaaaatacaaaaaaaaaaaaattagctgggcatggtggtgtgtgcctgtagtcccagctactcgagaggctgaggcaggagaatcgcttgaacctgggaagtggaggttgcagtgagcagagattgcgccactgcactccagcctggccacagagcaagactctgtctcaaaaaaaaaaaaaaaagccggacacaaaaggtcacatagtgtattattccatttatatgaaagtcaagaacaggtattaataaatctagagagacagaaagcagactggtgatggccagaggctgaggactgactggctaataggtacaggatttcctttcagggtgatgaaaatgttatggaactagatagtggtgatgttttgatggttgcacaacattttcttttcttttttctttttctttttttttttttttttgagatggagtctcgctcttgtcacccagcctggagtgcagtggcacgatctcagctcactgcaacctccgcctcctgggttcaagtgattctcctgcctcagcctcccgaatagctgggattacaggcacatgccaccacacccgactaatttttcttatttttagtagagatgaggttttgtcatgttggccaggctggtcttgaactcctgacctcaggtgatccgcctgcctcagcctcccaatatgctgggattacagtcatgagccaccgcgcccggccgacaaaattttcaatgtactaagcgccactgcattgtatacattaaaatagttaaaattgtgaactttatgttgtgtgtattttactacaacaaaaaaataatgaagggggccaggtgcagtggctcatatctgtaatcttagcactttgggaggccgaggcaggcggccgggaggtggaggttgcagtgagctgagatcatgctactgcactctagcctgggcaacattgagcattgagtgagtgagactccatctaaaaaaaaaagaagaagaaaggaaaatcctagcaggattttctacagatacagacaagattattactattactattattattattatttccttcgagatgaggtttcactctgtcacccaggtggagtgcagtggcgggatctcagctcaccacaatctccacctcccaggctcaagcgatcctcccacctcagtctccagagtagctgggaccacaggcgcatgccaccacatccagctaatttttttgtatttttggtagagacaaggtttcaccatgttggccaggctggtcttgaactccggagctcaggcgatccacccacctcggcctcccaaagtgctggaattacagcatgagccaccaccttgttttaaaaatctgtaactttaagacaagagaccgggcgcggtggctcacgcctgtaatcccagcactttgggaggccgaggcgggcggatcacgaggtcaggagatcgagaccatcctggctaacacagtgaaaccctgtctctactaaaaatacaaaaaatcagccgggcgtggtggcgggcgcctgtagtcccaggtactcggaaggctgaggcaggagaatggcgtgaacccgggaggcggagattgcagtgagccgagatcacgccactgcactccagcctgggcgacagagcgagactgcgtctcaaaaaaaaaagacaagattattctaaaagttatatcaaaggcaaagaagcggacatagctaaaacaatttttaaaaataattaaatgaggttgggcgcggtggctgacacctgtaatcccagcactttgggaggccgaggcgggcagatcacttgaggtcaggagttggagaccagcctggccaaaatggcgaaaccccgtctctactaaaaatacaaaaattagccaggcgtggtggtgtgtgcctgtaatcccagctattcggcaggctgaggcaggagaatcacttgagcccaaggcagggaggttgcagtgagctgagatcatgccactacactccagcctgggcaacagagggagactgtctcaaaaaaaaagaaagaaagaaagaaagaaggaaagaaagaaagaaggaaggaaagaaggaaggaagggagggagggaggaaggaaggaaagaaagaaagaaagaaagagaaaaagaaagaaagaaaagaaaaaagaagagaaaaagaattacatgaattaaagactgtgtggtattggcagagggataaatatacagatcagtgaaacaatatagaaaacccagtagtagacccacacaaatatacccaactgatttttttttcttttttttccaatgagaaaatgctaaaacaagcaaaacttcatgaagggacatctcatcaaagacgatatacagatggcaaataagctcataaaaatattttctacatcattagccataagggaaatacaaattaaaacccaaattagatatcattacacacctatcagaatggctaaaaaattgttgacgacatcagccaagtgcagtggctcacacctataatcccaacactttggaagtctgagggggcagatcacttgaggtcaggagtttgagaccagcctggccaacatggtaaaaccccaccactactaaaaatacaaacaatagcctggcatggtggtgcacacctgtggtcccaactacttgggaggctgaggtgggaggatcccttgagcccaggaggtggaggttgcagtgagctgagatcacaccactgcactccagcctgggtgacagagtaagattctgtctcaaaaaaaaaagaatctttgttggtaaattccttcaggttttggtgtgtttgaaaatgttttacttatttttaattctggaataatattttagctgagtatggaagtctaggttggcagttactatctcttggcttatcagagccacaccacaactgtattctcaacaaaagagagatgacacaccactctgctaccacaaaaatgaccagataatcccctcttcagactaacatgagtaactaatgcttttttctctttaccaatttgggttataatcctcttgcttcctaggtaagaattatttagacacccaatcactgaaacgcccccacttcttaacagtattcaatcccaaattagtcctcattcagagttttagagactaggaaaaaacaaacaaacaacaaaatcagccctcactattctaaactgtagttcagaaatatccaacagaagctgaaactctataagaggttccttttaacctctccttagggaaatggtcccataattcctttggggcattctctcccttgctacagcaagccagtagatttaacttttttgactacagatttgtttccagtggtgtttagttaatgagctttgacaaagataatggtcaaatttctccaatatcaattgactatgtgaagaatatatatatatatacacacacacacacacacacacacatatttgtgtgtgtgtatgtaatatatacatatttatataagaacatattggcagggcgcagtggcttatgcctgtaatcccagcactttggaaggccaaggtgggcggatcacttgagcccaggagttcgagaccagcctggccaacatggcaaaaccccatctctactaaaaatacaaaattagctgagtgtgatgacacatgcctgtaatcctagctactcaggtggctgaggcatgagaatcacttgaacccaggtggcagaggctgcagtgagccgagatctctgggtgacagagggagaccctgtctcaaaagaaaaagaaaagaaagaacgaacccaggtcatttgtcctgtagagtattcacaaagtctgaatttgcacctttgagttaccacttaatgtctcctgtatttcctgtaaattagtagttagctctaatcagattcagactggtttgtttgtttgtttgtttgtttgtttgtttttggtatggctacttcatgcaaggtggagttatgtactctatgatcaggaaaacatgtttatctctgttttcatgatgaataacagccactgtttttttgtttacgtagagatgggctcttactatgttgtccaggctggttttgaactcctgggcttaagcaatcctcccacctcagcctcccaaaatgctgggattacaggtgtgagccactgtgccctgccacagtcattgttgaccattgcctagatatattaattcatttggatttacaaaatgttgatattctaattatattatcccttcttcaattatttactggaatgcttctataaagagaaatttccccctcatcttgagatacagttcccaaaagaaaaccaggataaatacttgattctttccaattaccagcagtttttaaaataatgagttgatctgccagcattctccaacaatgaccaatgggtttgtatttttaagtatcattgtgaattcatggatttaaacatattttatgaatttcaatccattgcagatagtatccattttgatacttaaattgccccatctttggccaatgggaactattctagttggctcctaagttcttttattacaatcctaacactctttgaaagcttccttgcctatcttggacaatacctgccccaaacctgaaatcagccacttatccaaggagttgtttgttggtcccttttaacagaaaatggtatttacatagcacaatttgagtactagaggtgtttatttttactggatcattgtttccaggcctttttagggtaaagctaggaaaattttaaggataaaataaaccatgagttcagagttatatttgcaatttaaattcagaattacggagttttctcttaacttcatcaatcgtaaatatgtatctctttattccaccccaaaaattctggttctcagagacactaacattattaatcatttgttttatctcataactaaaataatctcagaataacaataccaacactaacaccataatatggctatttaaaaatatttttgcatttattttctggcattatagtatatcccacttaggctgtcatagtcaaattattatgttttaaagtcacttgaatagtttggttagaagcattttacatttctataatgaaactgcttgtgatatggcctctaatggttgagaaatatttgtcatatatatatacctgagaagtatatatttgacaaaaatatttgtcatatatatacctgagaagagtgctatgagggcctctagactctgtattaaaatagagccaactggtaaagatggcttagtgattgtgttggttattactgagtgtcaatttgattggattgaaggatacaaagtattgatcctgggtgtgtctgtgagggtgttgccaaaagaaattaacatttgagtcagtgggctgggaaaggcagatccacccttaatctgggtgagcacaatctaattcactgccagcacagctagaataaaaagcaggcagaaaaatatgaaaggagagactggcctagcctcccagcctacatatttctcccatgctggatgcttcctgcccttgaacatcagactccaagttcttcaattttgagactgagactggctctccttgcccctcaagcttgcagacagcctactgtgggaccctgtgatcgtgtaagttaatacttaataaattcccctttatttatatatctacctatatagatatccatatctatatagatattaataaatctagagagacagaaagcagactggtgatggccagtctagatggctagatagatagacatggatatagatatagatctctatatagatagaggtagatacagatatagatatatgccctattagttctgttcctctagagaaccctaatacagtgaccgtatttggaatcggtccttctgttaatttcacttggcaagtactaaaagatgatgatctcagatatacctatggctgcaaaaacatgacatggctaaatcccttggttgcagtatctcttttcttttttaaggggggtgggggggcgggtctcactgttgcccaggctggagtgcaatggcgttatcatagctcactgcagcctcaaactcctgcgctcaagtgaccctcctgcctcagctcccaaagtgctgagattttgcaatatttatggtcacaagattatgttattccataaaagtatctttctgaggctaggcatgttggttcacacttgtaatcccagcactctgagaggctgagatggaaggattcattgaggcaaggagttcaagaccagcctggtcaacatagtgagacctcatctcggaaggaaggaaggaaggagggagggaggaagggagggagtgaaggaaggaaggaaggaaggaaggaaggaaggaaggaaggaaggaaggaaggaaaagtatatttttgaatctttttctatttctccaactctttctttagaagaattctatttccattctttcttcacctctttgcctttgttagccttctctccaagcaaatcgggagcctttattttttgtgtattcatgagggagaggaagatgaattgctgtacaaactaaagtaatgaaaatggagtaggtaggaggatagacagctgcaaggatctgagctggatagactgaacaaaccctcatcctaagcaactcacagctcagatttcttctctggacagctggcttttttcgtccttctgaaatactctgcaaagataggagaggggctatgaactacctctgctatggatcttattcaaagtcagctacctcctagatactatctgtagaacctaaatgtaatattcagcatagcagggatgaacatggtaaatgaaaggtatccaattgcccactgtaatttttaaaggccaggagctcaacattattgaaaatgctggagggctgcctggagtaggcagtgaccacagagtcacacaagctggaattggatatccaacttgtctgtcatatttctctcctccctccctgacttggcactcaatactccatattctttctaatcctctaaccctccccactcccccaactcccacaccctacccccaccaacgttcctggaattttggacttagctatttttaaaaccgtcaactcagtagccacctccctccctgctcagctgtccagtactctggccagccatatactcccccttccccccataccaaaccttctctggttccctgacctcagtgagacagcagccggcctggggacctgggggagacacggaggaccccctggctggagctgacccacagagtagggaatcatggctggagaattggatagcagagtaatgtttgacctctggaaacagtaagtcaaaatgaaattgcaattcctttaataagcttttatattgaagttagacttttataaaattacaaacacctacttggatgtctctcgtccaaatgctgggatctctccctaccaaggtgccccaatctccatttctctttctgtcttatttctttctggcctctggcctctagctttttgaagtttaattctctgtctctcctctggcagtcttagccctctctttaccttattacctcaagactcctgatgaagttttagaaggagttccctacgtcctctattctgtagttttcttaccaaggccaaatatgacctcagatgatgagtcactgatacccttctatcctgcccccacttagcaatgcccttcacattgagattccaagcatgggggctgctccctgtaaatgatttctccccacaactctagtccctccattctattctccctcttgcaggactcttcccccaatcatatccttacccataagataggggagttaggcaggagggatttagcccctctccaactcctgtcatcataaaagactgagaacttcagaatttgaaaagaagagattaatggaaggagtgatatttgggaaaatacaagaactgttgacttagaaaaaacaaatattgatttgcatgtttggtttgcatcccattattccatgagagagggagattaaaattgcagctctctagagctgatgaaaagagattggtttccttttcatttgaatactgatattctagacgggatgggtatgccacccttaatccttcttgtgttctgacacaaaggaggaaaagaaatgtatgactcctagagggcatctcctcctaatggagagggacaaataagaagtatgtttctgaaatattttcaggtcctaattttactagggtacccactaggattactggtatctgatctagccccatgattcctccatctttgacatacctgctgtttggtagctcagaatggagcaatacagtggactctgcccccttgagttcactcaaccttccctccacccccacctaggggtattgcacaagggccctaaaagtggccacaggaacagggcaaagaggcttaactgccacacttatagtttgaggaactccaatctccccaaattccagtctgttcatccttttcttgatctccccagattcactccacattatccttaccaatcttcaattcttctctctctccatgtccagccaaatttcttttttcagtcacttacagggcttccggtcaaaattcactaggtaggagggtcatcagctgggaagaaccggcgcctgggaaacctggctggataggtatgggggagccaggccagtcccctagtcccaggtcctcccatggcagtcccccaactctaagcactctcactctcctgctgctcctctgtggacatggtaaggaagggccagggaagggtttggggaaatctagagggtaggctgctatgtaggggtgggcatgtgagcctgaatgagtgaggagagataggcgctgagagtcccgatcactcgccctgctctcaaatactaatattttatttcccgttcagtctggggaaggccactggggaagcccttggtcgacaggcagaagagatgtggcaggcttacacacttttagtaagacagccgagagaactagggactagggggttgggggctggggaaggcccttagttaggttttaggaaggctggaaacccctgatgagatttggaagagttatgagcaaactacactccgatagagcagaggtctgaggaccgtctcacaatcctctcccttctgtctttagctcattctcaatgcaagatcctccgctgcaatgctgagtacgtatcgtccactctgagccttagaggtgggggttcatcaggagcacttcgaggaggaggaggaggaggccggggtggaggggtgggctctggcggcctctgtcgagccctccgctcctatgcgctctgcactcggcgcaccgcccgcacctgccgcggggacctcgccttccattcggcggtacatggcatcgaagacctgatgatccagcacaactgctcccgccagggccctacagcccctcccccgccccggggccccgcccttccaggcgcgggctccggcctccctgccccggacccttgtgactatgaaggccggttttcccggctgcatggtcgtcccccggggttcttgcattgcgcttccttcggggacccccatgtgcgcagcttccaccatcactttcacacatgccgtgtccaaggagcttggcctctactggataatgacttcctctttgtccaagccaccagctcccccatggcgttgggggccaacgctaccgccacccggaaggtcaggcactcaatcttccttccgatccacctcatgagattcttccacgggcaccattcctccccatccccactattcaacagcaatgctccctaattcccttttcttcctcaacctctcccccatctcgaatcactcccttctaccaaacacctggagctgtaaatcacttccccttgatgggaatttgactcaaatgcagaaaaccttgaagagacagtcggagagggcggacctgaggagtttcagaagggaaacttttccctctcctaggaagttgccacgattaagtagagagggggttaagtagggatgaggtaatactggaacataaataggagaagggatcaaggattgagggccatagtagtcctgcatctctacttggatcagatctctaactatgtatgaggtctgattggggggaagatgcactgaacccaaaatgaactgttttccctcttgtcctcacagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatcctctgttgcctatgttgaatctctttacagatgcttgaaatggagtaaatgcaatgtgttcactccactgaaagagggctcggaagtatcagatactgttgctatctcagggagtttacaggctattggagagacaaaaccaattcacatgaaagagtgatgagtgtgtaattattcactaaatcctacagtatggtacattcagatgggaagatggtagatttgaactaaagtaataagaataataaaaggtaacagagaagatgggatttgaagtgagctttgaagactgggtaagattcaaattgttaacgatcttccaggcaatgaaaaccatctggagttatgcatggattcatgattcagcaaggaaatgagcaaaactcaaatgcagtagacaaggagtaatgggacagaaggttagatgggcagaggccagattatgaagcaccttaaaaagggggtaaggggtttaaatttgattaatatctaacacttattgaaacttaaaatctgccaggcaatgttttaaacacttttaaaacattgacttaattctcatagctctctaaggaaggtggtattcttatctctatttttatataaggaaacttgcctccagtcacacagctaacaaattatggaacttgcctccagtcacacagttaacaaatggcagagccagaaactgaacctatgccgtttggatcccgaaacttaatttttaatcactatactatattgtcaaggaagcagagagccattaaagattctggttgtggagctggtaaagattctaaaaggggagttgtggtggtcaatgtcaccacaaaagctactctgaggctgggcgcggtggctgacacctgtaatccagcactttggtaggccaatgtgggtggatcacttgaggccaggagttcgagaccagcctgggcaacatggtaaaaccccatctctactaaaaatacaagaaatttgccaggcatgatagtccatgcctgtaatcctgtaatccaagctactcaggaggcagaggcatgagaatcgagaattgcttgaacccgggccaggaggcagaggttgcagtgagctgagaccacgccactgcactccagcctgggcaacagagtgagactatcaaacaaaaaacaactactctcttctcatattctcatataaagccaaaaagagagagttggaaaaggagggaaagcccaaagttgaaggaatctagtttgtagaagaaagactgagaagaaatgctgttctagatgagggtgctctaaagtaacaatgctgctctgaacaaaattatgaaggaggtaacttttacatttaatatcttccctgtttctggtctcatcctcccctctcaggtactccataaccgaggacctgtcctccctgccctaatcaagtactcaccattatcttccacctctcctctcagtccctgacacccgacaatactcccctgaacaaatattacagtagggccctttgtatctactaattctgcatccacagattcaaccaaccacgcactgaaaatatttgggaagtagccgagcgcagtggctcacacctgtaatcccagcactttgggaggctgaggcgggtggatcacaaggtcaggagtttgagaccagcctgaccaacatggtgaaaccccatctctactaaaaatacaaaaaattagccaggtgtgctggtgggagcctgtagtcccagctattcgggaagctgaggcaggagaatggcgtgaaccccggaggcggagcttgccgtgagcggagatcgcgccactgcactccagcctgggcgacagagcgagactccgtctcaaaaaaaaaaaaaaaaaaaagtaataaggctagctctaagcccgcgcgaaggaagagtattacatgacaggtgtcatcaaagaatttcacttaccacttggctgtgaaattcttttttttttttttttttttttgagacggagtctcgctctgtcgcccaggctggagtgcagtggcgcaatctcggctcactgcaagctccgcctcccgggttcaggccattctcctgcctgagcgtcccgagtagctgggactacaggcgcccgccaccacgcccagctaatttttttgtatttttagtagagacggggtttcaccgtgttggccaggatggtctcgatctcctgacctcgtgattcgcccgcctcggcctcccaaagtgctgggattacaggcgtgcgccaccgcgcccagccgaaattcttctcaattcacttgaaattcccacacctgagggataaagttactcttttaagagaaccaatacaaagagtatttcttcaaaaggatgttttgagttaaaatacctatattttctgtgaagtgaagagacagccctggatatgtctcttcccccaatttttttttcttcattacaacacattattttctccattagctaaaggttactttggaaagcatagagacagtgctttgagggaatggcagaatggctgtggtccttaaaagaggtggagaggagggaatagaggataaagaattgcaggagaaatttgaaatggcagaccagatacgtctcgaactcctggcctcaagtgatctgctcgcctcagcctcccaaaatgctgggattataggcatgagccaccatgcccagcccaactagccctattattaatggagcatttttaaataggtagctcaaaataagcatatgaaaagatgctcaacatcattagtcactggggaaatacaaatcaaatgaaaacaacaatgaaaaaatactacatacccactagaatggttaaaatggaaaagactgttaaataaaatacaaaatgttaggaaaatgtggagctttcatgtgctgttggtgggaatgtaaaatggtacaactactttgtaaaacagtttggcagttcgttaaaaggtaagtgtacacttaccatacaaaccagacattccaaacttaggtactgacccaagagaaatgataacatgtgctgcacaaaaacttatatacaaatgcttataacagttttatctgtaataaccaaaaactggaaacaactcaatgttgaaatggtgaatggatacaccaattgcagtaaattcacataattgaatacacagcaataaaatgaaattaattcctgatatacacaacatggataaatctcaaagtaattatgcaagtgaaaaaagctgttgccccgcaaaaaaaaaaaaaaagagtatataccatctgcttccattcatatcaaattattaaaaatcttcagcagatcatggactgtaaaaatatataaaatgttagcaaacatatagtgagaaaaggtgatcaatggttgcttaaggaatgggcagagtgaaggagggatggcttacaaaggggcatgaagtaggccggatgcggtggctcacaccagcaatcccagcattttgggaggcttaggagggtggataacttgaagccaggggtttgagaccagcctggccaacatggcagaaccctgtctctaataaaaagccctgtctctactaaaaaccctgtctccactaaaaaccctgtctccactaaaatgccctgtctctactgggtgtggtagcatgagcctgaaatcccagttactcaggaggctgaggcacaagaatcgcttgaacccaggaggtggaggttgcacaaagccgacatcacgtgactgcactccagcctacgcgatacagcaagactctgtctcaaaacaacccaaaggggcatgacgaaactcatgggggtgatagatatgttcatcattttgattgtgacagtggtttcatggatatatatatatatttgtatatgtcaaaacccatgaaatgacacaccttaaatatgtacaatttatcatacaccaagtatatgtcaataaagctgtagtttttttttttttttaatgagtagcacatctttctctcttttcttggtagatcagacaaaaggcttagaatgaccatagcatgacaaggaagattacaacagagacttttcttcttctaggaaacatacaaaagaagaggataacagaacaaaggaaagaccttatttagtgattttatattctccgctactcctatgacaaggaccacattccttcctccagaatgtcattctcaaagtcagagaccacagaaaggagattttccgatttaagaacatcaaccctgtgaatcataattctgtctttccacttcaccaagagtcagcaggtggtgctagtgactaaaaagtgacttggcagacaatgaggcaagtttccaggaaaagaaaaattatcgtctaagattatctgatatgttgaccatttgaaagaaaatattaataggcatttgccagaattgacatttaggaaataaactgaagataggtacatagtaaacaaagtaaaattttaaataaattataatttaacaataaagggttgttcaagacatgaaacaatcaatatatactacttggctcctcaatggatatcatttacacagtaatactaatgtaaacactgactattgattcagccagaactatgctataactttctattgggaggatgaggtaaggggaaaggaaaggtgggaatatagcatgatgtaagagttaaaatttcaattactataaccataagagagtagatatgtctaatatttattttgtttccttttttttttttttttgagacaagagtctctcactgttgcccaggctggagtgcagtggcgcaatctcagctcactgcaacctctgcatcccgggttcaagcgattctcctgcctcagcctcccaagtagctgcgactacaggcatgcaccaccaggcccgtctactttttgtatttttagtagagatgggtttcaccatgttggtcaggctggtctcaaactcctgacctcaagagatccatccacctcagcctctcaaaatatatatgtaatgttagcacatatatagtgagaaaaggagctcaatggttgcttaagggatgggcagagaggaggagggatggcttacaaaggggtatgaagcaggctctgtcgctctcgctgtatcgccagactggagtgcagtggcccaatctcagctcactctatcctccatctcccgggttcaaacaattctcatgcctcagcctcccaagtagctgggattacaggcgtgagccaccacacccagcctagttgtatttttatattttcaacacctagtctggcacatgatctgtaaatgtttttaataaggaaaatagtccaggcacggtggtttacgcctgtaatcccagcactttgggaggccaaggctggcggatcacctgaggccaggagttcaagaccagcctggccaacatgggaaccccatctccactaaaaatacaaaaattagcccagcgtggtggcgtgggcctgtagtcccagctatttggaaggctgaggcaggagaatcacttgaacccaggaggtggaggttgcagtgagctgagattgcgccactgcactccagtttgggtaacagggcaagactctctctcaaaaaaaaaaaaaaaaaaaaaagaaagaaagaaaaagaaatatgaagtgcataccagatgaaaaagctgaaagaggcagggtgcagtggctcatgcctgtaatcctaggcatggatttaagaggcctaggtagatggatcccttgagcccaggagttcaagaccagcctgggcaacacagcaaaaccctgtctctacaaaatatataaaaattagctgggcatggtggtatgtgcctgtagtcccagatacttgggaggctaaggcaggaggtacacctgagcccagaaagtcaaggctgcagtgagccatgatcatgccactgcactctggcctgggtgatagagtgagatcctgtctcaaaaacaagggggcgggggccgggtgtggtggttcatgcttataatcccagccctttgagaggccaagtggggggaagatcacttgggccaggagttcaagaccagctggcctacatggtgaaacctcatctctactaaaaatacaaaaattagccagacgtggtggtgtgggcctgtaatcccagctatttgggtagctgaggcaggagaattgcttgaagctaggaggtggaggttgcagtgagccgagatcgcaccactgcactccagcctggggctgagattgccccactgcactccagcctgggtgacggagtgagatcctgtctcaacaaaaaaaaaaaaaaaaaaaaaaaaagaaagaaagaaaaagaaaaaggggcttgggcttgaggactgctgttttttgtaaaatcatttaatatcatgtgatttttaactacatgttacattacattgattaaaaagaggagcatttggctgggcgcagtggctcatgcctgtaatcctagcactttgggaggctgaggtgggaggatcacctgaggtcacgagttcaagatcagcccggtaaacatggtgaaaccccgtccctactaaaaatacaaaaattagctgggcatggtggtgcatgcctgtaatcccagctacttgggaggctgaggcaggagaatcgcttgaacccaggagtccgaggttgcagtgagctgagattgtgccactgcagtccagcctggagacacagtgagactccctctcaaaagaaaacccaaaaaacaaaaagaggagcatttctgggcaggtgcagtggctcacgcctataatcccagcattttgggaggccaaggcgggtggatcacttgaagtctgaagtttgagagcagccgcggacatggcaaaaccctgactctactgaaaatacaaaaattagccgggtgtggtggctggcacctataatcccagcggcttgagagacttaagcaggagaatcacttgaaccggggaggcggagattgcagtgagccaacatcatgccactgcactccagcctgggcaacagagtgagacttcattccccaccctcaaaaaaaaaaaagggagcatttccaccttggcctgagctttttccccttaactttgtggccatctcaaccacttctcagatcaaacaaacacctccctccctactatactccaccctatgtacttcatggcaagttccttcccacatttcttctcaaggaaacagatagtagccatggcccagtaattatagttttcaaaatcagtgccaggaaaccataccagcactaaggaagggaaagaagacataaaactaggaaataaaaggccttcctcaatttttctgtgtactcccaaaccaaattactaatcatttttccaacaattaacagaagaaataagttacatatgtttcctcagataaaagttatataagtggagggtgggctttgagaaactgaaaaagaaaaaccaggaagaataactagattctacctccaatacagggcgattttggaatcattctttgctattggttcaaagaactaatttttttttttttttttgagacaggttctcacttcatcacccaggctggagtgcagtggctcaatattagctcactgcagccttgacctcctagattcaagcaatcctcctgtctcagccccctaagtagctgagactactgtgctagccaccactcccatctaattttttgttttttgtattttttgtatagatgggttttcgccatgttgcccaagctggtctcgaactcctgggttcaagcaacccacctaccttggcctcccaaaatgcaatgattacagccttgagccaccacacctggcacagaaccaacatttttaatattaagcgtttcacatagtcagtctttgatacaacacttctacctttgagaaactaagtcatattttcaaaaaagtaggctggctgggagcggtgtctcatgcctgtaatcccagcactttgggaggccaaggtaggaggactgcttgagcccgggagtttgataccagcctgggcaacatggtgagacccccgtctctacaaaaaaaataaaaaattagctggctgttgtggcatgtgcctatagttccagctacctgggaggccgaggtgggaggatcagttgagcccaggaggttggggctgcagtgagctatgatcgcactactgcactccaacctgggtgacagagcaagaccctgtctcaataaaagaattaaaaataaattaaaggccaggcgcagtggcccatacgtgtaatcccagcactttgggaggctgaggtgggcgaattgcttcagctcaagagttcaagaccagcctgggcaatatggcaaaaccccttctctacgaaaaatacaaaaaattagccgggagtggtggtgtgtgcctgtggtcccagctactcgggaggctaagttggaaggattgcttgagcccaggaggtcaggaggtcgaggctgcagtgagctgagattgcaccactgcactccagcctgggtaacagagtgaaatactgtctcaaaaaataaataggtaaaaatttaaaaattaattaattaaaaatgaaaaataaatgtagaaatcagagaaagctttacaaaggagatgactttttttttttttttttttttttgagacagagtcttgctctatcacccaggctggagtgcagtagcacaatcttggctcactgcaacctctgcctcccgggttcaagtgattctcctgcctcagcctcccgagtagctgggattacaggcacccacaatcatgcccggctaatttctgtattttcagttgagacgaggtttcaccatgttggccaggttggtcttgaactcctgacctcaggtgatctgcccgcctcagcctcccaaagtgctggaattacaggtgtgagccaccacacttggacaatcttggacttaaaaaaaatctttttttttaaggctcagggactcactaggaattttgtcctagctgtgtgatcataggcaagtcatttgagttctctgaatcacaatattctcttctgcaaaatgtcttcctgcttacctggtgagaatcaaatgtttgtgcaactgcgttataatgcatatatatagatatatagatgacaaaatataattaacaaagaaagtactggccgggcatggtggctcacacctgtaatcccagcactttgggaggccaaggtgggcagatcacccgaggtcaggagttcaagaccagcctgaccaacatggagaaaccctgtctctactaaaaatacaaaataagccaggcgtggcggcgcatgcctgtaatcccagctacttgggaggctgaggcaggagaatcgcttgaacctgggaggtggaggttgcggtgagccgagatcgccccattgcactccagcctggacgacaagagcaaaactccatctcaaaaaaaagaaagtactgatctggcacagtggctcatgcctgtcatcccaacactttggaaggtcgaggtaggaggatcactagagcccaagagttagagaccagactgggcaacatagcaagacccccatatctacaaaaaacttaaaattaactaggcatggtggtagtcccagttcctcaggaggctgaggccgagggttgcttgagcccaagagtcagagactgcagtgaactgatcgcacgacagcactccagcctgggcaagagagaggcccatctcttaaaaaaattaattcattttttcaaaaggcattgatggatctagaaaaataaataaatgttttaaaattttttcttagaaaagaaagtattattaattgtcagtctggataaaaaaatagaaacttgttttaatgtagaatttctttccctcagtcatgaacaccacatttccttcatttgttccttctcataatcaaaaatcatctttgccactcaggggagtgatctgggctgttttggctctcagaaaagcttttatttgtttgagacaattcttggactaagaattttgacagtatattaaactgcccactaggtggcagagctgagtcaactgtatttctgaattgtgtaagaaataatttctcagaaaaggggaagttgggttgagcacacaatgtcccatctccctcatacttataaacaccaacgcagtccaattttcttctcacagaaaaacaaaccaccacctctcgcctccttaccgtccctgctctgatacatatttgggccacaggctttgaggagggacaaatatgatacagtttagcataagaaactgaggttgaggtgtcaagtctaatagtaataagaaataatactaggatctgaattactggtatattctatccagagacataacccaatctatcaattcaatcaatctatctctatatgtatgtgtgtgtctgtgtgtgtgtgtgtgtgtgtgtgtgtgtgtgtgtgtgtgtatatatatatatattttttttttttttttttttttttgacatggcaattcaagccatcctcccacctcagccttccgaggagctgggactacaggcgtgcaccatcacacacagctaattttttttatttttagtagagacagggtttccccatgttgcccaggctggtctcgaagttgtgagctcaagtgatccgcctgcctcagcctcccaaaatgctgggattacaggcgtgagccactgcacctggcctcaatttatatttaataatacatttattctgtgaagtgtactctaacagatgctaggaagaatacaaagataaaaaagggcatagtttctattctctaggaatttaggagagaaaaggcactttacgtgttagtgctatgtaagaaatataaatgtgctatggagtattccaaagagaatgaaaaaatatttgattgtaaggtaaaagatgaggggattggctgggcatggtggctcatacctataatcccagcactttgagaagctgaggcgggtggatcgcttgagctcaggagttcaagaccagcctaggctacatggtgaaaccctgtctctacaagttttttttttcttttctttcttttttttaagttagccgggtgtggttgcatgcccctgtagtcccagctactcgggaggctgaggtgggaggattgtttgaacctgggagatcgaggctacagtgagccatgatagcaccactgtactccagcctgggtaacagagtgagactctatctaaaaaaaaaaaaaaaagttgaggggattgggaagcaagaaatgtttttggttttgctttgttgctttgagatagagtctcaccctgtcacccaggctggagtgcagcagcatgatctcagctcactgcaacctccacctccggggttcaagcaattctcctgcttcagcctcccgagtagctgggattacaggcacctgccaaccatgtcctgctaatttttgtatttttagtagagatggggtttcaccgtgttggccaggctggtctcaaactcctgacctcaggtgatccacccacctcggcctctcaaagtgctgggattacaggcgtgagccactgcgcccagccaagaaaggtttaatagaggaaaaattatttggctgtctacagaagagtgggtaaaatttcaaaaagcagagatggggaaggacaggcacactaggtacaaggaaaaatgtaagcagggacataaagacagagaaggatatattaagggaacactgagtgctcagttttggctgaagcatagggtacatgtatgaggaaatagtgggaaatgaatgagaaaatttggttgaggacatttcgtgaaggcttaaatgccaggttgaagcatttaaacgtgattcagtaagcaatacattttgcattattataggaacacacaggaactcaattctgtgagattaatctagtgatgttctatagattacagcaggaaaatcagttaaaatctattaaagtaatctaggcaaaagtaacaaaaacatgaaccagaatggtggcagtagaataagaaacaggagacaggtgctagaaacactagaaagatggctctatagaattcagcagttgactggatgtggggcatgacagagaggaaggaattaaaggcaatccctggattttaagcctttataacttggggaatatataatggttctattaaaacaaacaagggggctggaggcagtggctcatatctatgatactagcactttgggaggccaaggtggaatgatcccttgagcccaggagtttgagaccagcctaggcaacaaaatgagatcccatctgtaccaaaaattaaagaattagctgggcatggtggcatatgcctgtggtcctagctacttgggaggctgaggcaggaggatcccttgagagcgggagttcaagattgcagtatgctatgatccctgatcccaccagtgcaatccaacctgtgtgacagagcgagaccttgtctcaaaaagaaagaaagaaaaagaggggaaaaaaaaaggccgggcgcggtggctcacgcctgtaatcccagcactttgggaggccgaggcgggcggatcacctaggtcaggagtttgaaaccagcctcaacatggagaaacccagtctctactaaaaatacaaaattagccgggcgtggtgctgcatgcctgtaatcccagctacttgggaggctgaggcaggagaattgcttgaacctgggaggtggaggttgcggtgagctgagatcacgccattgcactccaacctgggcaacaagagcgaaactccgtctcaaaaaaaaaaacaaggcaaagaaatgggtttgaccaccagggaaagattatgaattcattactagacaagctgaatttgagataacagctggaactttggagacaggctaaaggtatagcatagatttaaagtcatttacacagagtgatgtacagacagtcaaactgaaaagtgaaacttcaagaaagaaaaggagagggcccaggacaagcccttaagaagaattttcagggagtagaaaaaaaaagaattgttagcaaaggagaaaaggatgaagtccaaaagtcaagatttaagtgtttaaaattttaaaacatggcagtttccaaatcatatagaagtcaaaaggaataaagcctataaaaagtactctgactggccgggcgcagtggctaatgcctgtaattccagcactctgggaggccaaggcaggtggatcgcctgaggtcaggagttccagaccagcctggccagcatggtgaaaccccatctctactgaaaatacaaaaattagccgggcgtggtggcacgtgcctgtaatcccagctactcaggaagctgaggcaggagaattgcttgaagccaggaggcggaagttgcagtgagccaagatcgcgccattgcgctccagcctgggcaacagagtgagaccctgtctcaaaaaaaaaaaaaaaacaccctacgttgattttgccaggtatggtggctcatgcctgtaatcccagcacttcgggaggtcgaggtgggcggatcacttgaggtaaggagcttaagacgagcctgaccaacatgacgaaacccggtatctattaaaaatcaaaaattagctgggcgtggtagcacatgtctgtaatcccagctacttgggaggctgaggcaggagaattgcatgaacccaggaggcagaggttgcagtgagccaagatcgcaccaatgcactccagcctgggtgacagagcaagactccatttcaaaaaaaaaggaaaagaaaagaaaaactactccaatttccgctggagaccttgaagaaaatagtttcagagagaccagaaggcagactacaaagggacaagttcagtccacagaaaaagctgatacagattattctcttaagaaatttgacagtaaaagaagaataccgcctgggcacagtggctcacgactgtaatctcaacactttgggaggccaaagtgggtggatcatttaaggctaggagttcgagaccggcttggccaacatggtgaaaccccatctctactaaaaatacaaaaattagtcgggcttggtgatgggcacctgtaaacccagctactcgggaggctgaggcagaagaatcgcttaaacccaggaggcggaggctgcagtgagccgagatcgagccactgcactccagcctgggtgacagactgagactgtctcaaaaaaaaaaatactgtaataacatgagaagggaaataagatatttttatcacatataaaggcaactttaagaactatggcccagcacagtggctcacgcctgtaatcccagcactttgggaggccaaggtgggtggatcacttgaggtcaggcgttcaagaccagcctggccaatgcctgtaatcccaactactctggaggcagaggagaatcgtttgaacctgggaggcagaggttgcagtgagccaagatcgtgccattgcactccagcctgagtgacagagtgagactctatataaaaaataaatagataaagctgggcatggtggctcaaacctgtaatcccagcattttgggaggccaaggcaggtggatcacctgaggtcagaagttcaagaccagcctggccaaaaaggtgaaaccccacctctactaaaaatacaaaaaattagctgggcatggtggtgggtgcctataatcccagctactagggaggctgagacaggtgaatcacttgaacctgggaggtggaggttgcagcgagccgagatcacgccaccgcactccagcctgggtgacagagtaagaccttgtctcaaaagtaaatagataagtaaataaagctaattacaaaaaaaagaaaagaaaaagaactacctttaggaagttattgtaagggccttcagaaaagaaaaaaaaacttttttggtttttttttttgagacggagttttgctcttgttgcccaggctggagtgcaatcttgactcactgcaacctccacctcccaggttcaagctattctcttgcctcagcctcctgagtaactgggattacaggcatgcgccaccacacctggctaattttgtattattagtagagacggggttactccttgttggtcaggctggtctcaaactcctgacctcagttgatctgcctgcctcgacctcccaaaatgctgggattacaggcgtgagccaccacgcccagccaaaaagaactatcttaaatgagcctacaatacctccaaacaagttaattcagcccctctccccatcttgccatgacattggacaatactgagatctctatcctttgcttatcatggtagaaaaattgatctcagtaaacacgaaatgtgggcctccagatgagatatttttaaaagttaaaactaaattaacaaacaagattggacatggtggctcatatctataattccagcactttgggaggccaaggtgggtggatagcttgagcccaggtgttccagaccagcccaggcaacatggcaagactccatctctaccaaaatatatgaaaattagcccggcatgtgcctgtagtcccagctgactcaagaggccaaggtggaaggatcacctcagccctggaggttgaggttacagtgagacatggtcatgtcactgcactccagcctggtgatgaagtaagaccctttctcaaaaaaaaaaaattagctgggtatggtgtgtgttcctagtagttcccgctactgagctatgcttgtgccactgtactccagtctgggcaacaacaaaataaacaaatagataataaagagaatcctgggtttggagagtggctccaccagatactagcttatgtcccaggtcaagtcacttaaccaaaataagaactggttttaaaaaaataaaagactgctacagtcccatttaactctaaaattctctgagtcttgccctgaatcctttattagactattgtgagaatcaaacaagatactgtgtatcaaagcactgagagccaagacaacacatttttatagtacatacttttagacagacatgggcgggttcaagatcttgctctacttacaaaatctgtgacctcaggcaaattacttcacttctgagcctgactgaaccaacaccgagtcacaaggttattgagagaattaaatgaaacaatctaacctcaaatactttctttttttttttttttgagacggagtctcgctctgtcgcccaggcgggagtgcagtggcgcaatctcggctcactgcaaactccgcctcccgggttcacgccattctcctgcctcagcctcccgagtagctgggactacaggcgcccaccatcacgcccggctaattttttttgtatttttagtagagacggggtttcaccgtgttagccaggatggtctcgatctcctgacctcgtgatccgcccgcctcggcctcccaaagtgctgggattacaagcgtgagccaccgcgcccggccaacctcaaatactttctagaacaacatgacagatgacagataattatcactgacataattatataaaagacttggttcattataggtgctcaataaatggcaattacttaaaaagtcacttggaactctaacatgctatacaatttcttttttttttttttgagatggagtctcactttgtcgcccaggctggagtgcagtggcgagatctcggctcactgcaagctccacctcccaggttcacgccattctcctgcctcagcctcccgagtagctgggactataggcgcctgccaccacacccggctaattttttgtatttttagtagagacggggtttcactgtgttagccaggatggtctcaatctcctgacctcgtgatttgcctgcctcagcctcccaaagtgctgggattacaggcgtgagccaccgcgcccagcctttttttttttttttttttaaagagagatggggtctcactacaatgcccagggtgatcttcttgaattcctggcctcaagtgatcttcccatttcagcctcccaaagtgctgggattacaggcatgagccaccacacctggcttacaattgttaatttattcttattgatctatgacttggggcagtcttcaaactcttaatttgcctctaaattccttagggaaaaaattgaaagggaaaagggtgcctataatcccagcactttgggaggccgaggtaggcggactgcttgagcaggagtttgagaccagcctggccaacatggtgaaaccccatctctaccaaaaatacaaaaattacctaggcgtggtggagcacatctgtagtcccagctactcgggaggctgaggtgggagaatcacttgagcctgggatgcggaggtttcagtgagccaagtgacactgcattccaacctggttgagagtgagaccctatgtggaaaaaaaaaaagagagagagaaaggaaaatgggtaagggtaaaagggaagtttacagagtagaggtgagagaagtgattaaaaggaccaagaaagggctttgttctgcattaagaactatgagtcttcatgttctaaatgtttgtcaggccagaggttaaagaaaagagaaatgcaatcagtgtcttgtctctgactggcaacaaagtgctgagggcacttccctccctgaaactgctggctttattctgtcacctgcagtaaagcaaacaaacaacaatcaccacttggtttcctgttggcactgggactgaagagggtagagaaggggcagataaagatgatccaacttgcaaaactctttgactgtgccctactttgctgttcctccttggcccaccccttttcccaaacctcacaagtgtttttataccctgattttaggacaagagtttacaaaatttctttcttcttagacccaagaactgggaaaggagaatcggggcaggtttttatcagaataccaggttacaaggtgaaaggtcgtaaacaaccgtgtccaggaggactccacttcagaacatgccttggctacaggcctggtaggcagcagctgctgccaaagctaaataattttttggcatttaaaggaacccaggcataacacagagcaacgtagtctgtagtgagctctgcaaatgggaagatacaaggaaaccagagcccagaagagaaacttagaacgagagaattgtcataggattttttaaaactcagcaattcagtacttcagagatgtgcccacataaatatcaaataaattgaaagggaaaagggtgcctataatcccagcactttgggaggccaggtaggcggactgcttgagcaggagtttgagaccagcctggccaacatggtgaaaccccatctctaccaaaaatacaaaaattacctaggcgtggtggagcacatctgtagtcccggctactcgggaggctgaggtgggagaatcacttgagcctgggatgtggaggtttcagtgagccaagtgacactgcattccaacctggttgagagttggatgtcttaagatgtcccatattaccaccaccctgatccatcactagccaccatctttcctattccctcaaaatgtatgtagttaagatttaacaatatttaacaatattgactatgtagttaacaatattgattcatatatttgtcagcattttgatgtttgatagttacactttcatacccatcaaactaaacgttctcccagaagccacaattttgaacttttaaaattacttcagtcaggccaggcacggtggctcacgcctgtaatcccagcactttgggaggccaaggcgggtggatcacctgaggtcaggaggagttcaagaccatcttgggcaacatggtgaaaccccatctctactaaaaatacaaaaattagctgggcgtggtgatgcatgcctgtaatgccaggtactcaggaggctgaggcggagaatcgctctaacccaggaggcagaggttgcagtgagctggggtcaggccactgcactccagcctaggcaacagagcaagattccaccttaaaaaaaaaaattacttcagtcagagttccacctcctctgctcccagtaactcaatcaatattgttaaccaactgaaaacacctcaagcctagctggttaagtttctagaacagggtgccgcctcaaacacaccctaaggatcaacatgttcctggggtttaatgcatgtgtgtgttttcgaagagactcatgatgcctattcttgagcttgcttaatattggggttgagttgtaactctcgttagccttagagtgtcaatccagctaggctgtctgaggaaggaagaaggctctttaacagcaatgaataggtttttttttttttttttgctgattgggtagggtttcaatatacttgaatgcttcttaattacctccccatctcaatcttgggacattatcttcctctttccagcacaaggaattaaataataatcttctgataccccagcacagatataggaagggtctatgaatcaaataaaaggaggaagaatccctgcacttttgcatacaggtttttcctattacatttaagagtaagttctcagtactcagctcctaaagcatctcacagccagcaggggaaaatccatctgacagctggccaaacgaaaccaacaaagaatgaagagagagggtagggtctcttctggcttgaatttatagtgctctgttgaccgatctttcttctcttttccttcttactgttttctaaaccgtttagggaaaaacctttgaaaatagtttttaaaattgttccttcaaacaggtgtgtggccatctctccactgaaaatttggatataaacaagaggactttctcacttttaaccagatttatggatgtacatttgatttagtgagttggaagaggggatggagacaagaaagagtgaacataactggaaaaaagtgaaaagagtgaagcatcctttttttcccgcttttccttttcctccagaagcaggtaggaagtgggagataatgagcgcctggacacacctcactaaagaggtaatgaggtaaatggggaacacagacaaagtgttccccaactttgcaggtagaaattgaagagatgacaggataagcaacaggatgtaaacacgcccctcctatttccgttccacagaacagagagaacagaagagagggtacaagctgggggtgggtgacgaacagcacaggcacgcagcccccagccctagccccaagggattggaacgggaaggagaagacatcggtcctacacacacaatgaggcctgaaagttctcctttccctcagagacggtggtgttttttatacttaatagggatgcggggcaagagaaggacaaagggctgttcctgaacagtaacaccaagcattctgcgctccacagccccaaacctgaaagtattcttggagctatgggattttcacacacttgctatttatgagccaggaataacgacaggctctaaagtaactgcactggctaagactaggcatgaaattccctcataagcacattttccttttacctcaaaacaccgctctcagaccagaaacgtccacacccgccctccgatggcctgtcgccctggctaggttttagggtcagtgggatcctccttccactggacccgggagaagacgctcaacagccccctccttcccctccttcctctccttcctctccttcccccctccctgcgccgctccagagcgcaacaaccattttcccagccaggagcacaccgtgtccacgcgccacagcgatctcactgattggtcgggctcctggtaaacaaggaccgggcagccaatgggagggatgtgcacgagggcagcacgagcctccgggccagcgctcgcgtggctcttctggcccgggctactatatagagacgtttccgcctcctgcttgaaactaacccctctttttctccaaaggagtgcttgtggagatcggatcttttctccagcaattgggggaaagaaggctttttctctgacttcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggtaaatatcagctaaatgcatctttgaacttttctgtctaaaatatcttgccctcctttgatcacttactgttcttggagagcgttttaaaattttcattttcttgacacaggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtaaaatcctagtgcttatggcagttaaaacaggaactgggtttaggggcaagggcatgggactggggtagaggaagtgtcattaactatactgagtatcagtaagttttcatctttctcattgctaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactggtgggtagatgcagggtggcttcagcagagaaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaaggtgagccagacctaatgtcttttctttgtttctggtctacctgggtttgtaaaattgtgatggtccagcatttcttgggcaggattcttatgtggccatattttcttttctagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtgaggattgtcatctttactgttaaatttgtcctaagctttctataagaagttgacttagacggattgctaaactggtttgttctttttgttcttacctgaactgaaatagtctgtttctttctttaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttaagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgccgaaccctgtgttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaaaatgtctgtgagatggctttggaaaagtttttggaaagaaggtgtgtctaaaggagttttcctctacttaacaatccacactaatgaaaaccttgtggagaaaacactccctatggaccctaaggaatgtcggcagagtgggggctagaaggtgaagagggaaaccgtttgaggcatgtttcagattcactgaacaactatactgggattttccggttgtctaaactagttttccaaatccataggtaatcattactaaattccttcagttttggagttcatgggttcttgaaatacagggagatgatgtttatgagggcatttgaaagaaaagagtggcggttcctttttttgagacagtctcactcacccaggctggagtgtagtatgatcttagctcactgcagccttgatttcctgggctcaagtgatcttcccatctccgcctcccacatagctgggctacaggcatacacaactacgttcagttaattgtgtgtgcgtgtgtgtgtgtgtatgtgtttgttttttctacgctcagctaattttttgattatttgtagagttcgggttttgccatgttgtccaggttggcctcaaacttctgggctcaagtgatctgctggccctggcctcccaaagagttgggaatacaggcgtgagacaccacactcagctgaagatcccctttttacaatatggttttatcatagggtttcttcccaatgtaaacttgatttatatactaacaaggataacttcaggacttaagaggttatagagttatgagtattaaattctttggaggcagctaaccattttttattttcacagttcctaaccaagcacataactcagtaaatgtttgctaactattcaacttcaccctcatcccttagatgatttgatggttcctattccttgtagggtaatagtagtagagtaataccacaatcccatgtttaattggtgtgattttctttctttctttctttctttttttttttttgagatagagtcttgctctgtctcccaggctggagtgcagtggcccaatcttggcttaatacaatgtccgcctcccaggttcaagcgattctgctacctcagactcttgagtagttgggattacaggcatgagccaccacactcagctaatttttgtatttttagtagagacggggtttcaccatgttggccaggctggtctcgaactcctgacttcccgtgattcacccgcctcagcctcctaaagtgctgggattacaggtgtgagccatggcgcccagcagtgattttcattcctaaagaaccgacaggtggagaaaccctgggatggccaatttaaatatttgcacagatctggtcctggtccttatttgggaattgatttttctgaggacttccacaaactaattccaaataacaggctcctggaaattctacatgaaatcagtgtggggtgttgtagctctagctactcacaaggctgaggcaagaggatcattcaagcccagaagttctaggttacagtgagctatgattgcaccacttgcactccagcctgggggacagattttgtctcaaaaataaataaataataagcaaactaaaatcaatgtgaatttaacagaaagtgagatttaaaagatccttttccatttcaatcctcatttttcgtttatctttcattttccatagcactctcctccctctctttgtctctctttcattaccaaagtgtcagtctctatttctccctattgccagggtgactttcacctgaactctccgcccctttctcacctgtgcaagaatttagtggctcctctccttcaaatctgtgaccaggaaattaggtcaaagttgatggaaaagttttttctgtagcttgttttccagggcctagaggggtgaagcaatgataagagcaggccagagagcaggacaaaggaatggagagaccatggagtacatgagcctggttgtgtgcacagttgggctaccagtacccaatatgagaagagggatggcttcgaaaggatagataactttatacccaaggcctcttagagatctgatcctagggccaggcgcggtggcttacgcctgtaattgcagctactcgggaggctgaggaaggagaatcacttgaacccaggaggtggaggttgcagtgagcccagactgcaccactgcactccagcctgggcgacagagcaagactgtctccaaaaaaaaaaaaagagctctgatcctggaagggccagaacatgggcatctcctccggatacccttaatatcctttatccagctgtccaaatagaactttctatgatgatggaaattttcaatacagtagccactagccctgaaatgtggctactatgactgataaactgattttttttcttatctttttttttttttttttagatagggtctcattctgtctcccaggctggagtgcagtggcacaatcttggctcactgcagttttgacctcccaagctcaggtgattctcccacctcagcctcccaagtagctagaactacaggcacatgccaccatgcccagctaattttttctattttttgtagagacagggtttcaccatgttgcccaggctggtcttgaactcctaggctcaagcaatctgcccacttcagcctcccaaagtgctgtgcacacattttttttttttttttaaacagggtcttgctctgtctcccaggctggagtgcagtggcatgatctctgctcactgcagcctccacctctcagggtcaagtgatttcccatctcagccccctagtagctggaactacaggtgcatggcaccaagcccgactaatttttgtatttttcatagagatgaagttttgccatgttgcccaggctggtctcaaaactcctgggctcaagtgatcctcccacctcagcctcccaaagtgctaggattacaggtgtgagccactgtgcccagcctgtaactgaatttttaattttgtttaattatttatttattattattattattttttgagatggagtttctctcttgttgcccaggctggagtgcaatggcgtgatctcggctcactgcaacctccacctcctgggttcagcgattctcctgcctcagcctcccaagtagctgggattacaggcatgcgttaccacacctggctaattttgtatttttagtagagatggggtttctccatgttggtcaggctggtcttgaactcccgacctcaggtgatctgcccatctcagcctcccaaagtgctgggattactgtgcccggcccaattttgttcaattcaattaaactttagctttctgtgactagtgactgtcacatatgtgactagtgactagtgactagtgactgccatattgaataccacatcaaaatctaagggagtaagcagctagagctgttcccccagaggaaacctatccttctcttacagcacaaaaactccactctacttctttttgccttgtgtatacaacttctacctcacccgaggacattttccgcgtacaggcttgcttcagtacacttccttggggagtggcttagctatttccccacttaagtgggggaatattctgggtcttctttgcctatcctcttctcatgtgccttttaatttttaagtagctatgacctacatgtacaatgattagaggagatgtggttctgagtatcatttattcagtaggtttaatctggtatagggagatctgagagaactaaaaaagaaaactacctaaagagagaaaagggcaagaaaataaaattaacaagaaaaaggggccgggtgctgtggctcatgcctgtaatctcagcattttgggaggccaaggtgggtggatcatttgaggtcaggagtttgagaccagcctggccaacatggtgaaaccccgcctctactaaaaatataaaaaattagccaggcgtggcaggcacctgtagtcccagctacttgggaggctgaggcaggagaatcacttgaacctgggaggcagacattgcagtgagccaagatcacgccactgcactccagcctgggagacagagagagactccttctcaaaacaaaacaaaacgaaaaacaggtacttcaacaaccagagtcattggctgccttgattgatacctctgaacagactggaaacacaaggatctaacttgggttgaggcactgggaaggaaaaatgtggaggggaggatctgacaaagcacatgttcagcaaaaaacaatcacacaagagctgaagggcatgaagtggagtcaaggagtgacctttgcacaattcttttttctctttttgagagagggtctcactatgttgcccaggttggagtggagtggctattcacaggcacaatcatagcaaactctgaccttgaactcatagcctcaagggattccccctactcaacctcccatgtagctgggactacaggcacacgcaaccttggcccaattctttcaacagactacagatccctcttagaattattttcttgggctacctctaggtgataaaatgcataaggtgaataaggaaaatattttactgaccttccaatgatcacaagtccctgcccccaggcatcctggcctcaatagtttggggatgggggaatgggaagtttttttgtcctttctctgttgtgacctcacatcgacctccatttcataagctgaaacactccttttcagagagctaaagatccagggctgcaggtcctggcacaataggtaagtctagaacccagaaaaagtccaaagattagtcttcctatactattaagaaaaaataggccgggcacggtggctcacgcctgtaatcccagcactttgggagccgaggtgggcggatcacctgaggtcaggagttcgagaccagcctggccaacatggtgaaaccccatctctactaaaaatacaaaaaattagccaagtgaggtggtgcgcacctgcagtcccaactacttgggaggctgaggcaggagaattgcttgaaccccagagagggaggttgcagtgagcagagatcatgccactgcactccagcacctgggtgacagagcgagactctgtcccaaaaaaaaaaaaaaaaaaaagaaagaaaagaaaaggaaaaggaagaaaaaatagcatagtatagtagttaagcacgtggacactgaagccaaactatctaaattaagatcttacttctaccatttaaccagctatgtgaccttgggcaacttgtttaaacctctctatgtaacagtttgtttatttataaaatgagagataataataatgcctacctcagaagattgtgagaaatttaaaaatatatgtaaaatttagaacaatgccacataagtgattgttatctaaaataaaagaagagacatatccctcattacccccctgattaatttactttctttctttctttttcttttttttttttttttgagacagagtctcactccatcacccaggctagagtggagtggggcgatctcagcaacctcctcctcctgggttcaagcaattatctcgccccagccacccaagtagctgggattacaggcatgcaccaccatgtctggctgatttttttatttttagctgaggtgaggtttcaccatgttatccaggctggtctcgaactccagacagctcgactcaagctatccgcctgcctcggcctcccaaagtgcttggattacaggagtgagccacagcacccacttagcctcagggtgttctttttcacacttccagtgtgcttcacaagcctgtggattaaaccctgtaaccttctaaaaattatttgaactttcttaacttttcagtacacaactccaaagaaaagcttcccaccatttggagtgataaactgaggaacagagagtgctggatatacaatgtgatgccacaggtcttccagactttttctttcaaggtattgcattccatttgatttttctgtggggtggactagactgaggagcacaaaggtcaatggaggtgagtccacggatgaggcccagtttagcctatttaggctattcttgttctgtcccgacctttccctttgcttgacccttccctactctctgctgggcctgttatgtaaggagaaaagaatgaacagactttgactatcaattgattggtcatctccaggcaacagagtgatgggagaaagaagacagggaaaacaaaggtacaggattgtgaattccatgtgccctgagtcctgagatgttaggcaacgtccattctcagtccttgttgggctatgaagttgctgacaatcaaagttaatcaaatggtcagtaaacaggttcttggaaatgtctggctaggttcccagcttggatatttttaacctcctggacagatggatagaacaaggatttcagctgctgagaggggaggaggtattcaggggcataagaactgtgcttcctttttttttttttttttttttttttttttttttaagagatgagtcgcactctgtcaccaggctggagtgcaatggcgcaatctcggctcactgcacctctgcctcccgggttcaagtgattctcctgtttcagcctcctgagtagctgggattatagatgctcacgaccacgcctgtctaatttttgtatttctagtagatacggggtttcactatagatccgcctgccttggccacccaaagtgctgggatcacaggcgtgagccaccgcgcctggccaacatttgtgcttcccttatatggttctgtggctaaagatccctccctctccacttcagattctgacttcctccttcatctagccagactcagggttaatcctttgtttcctgctctcccatttctctttattccctgtctttcatgcttgcttcaccttccaactctgaggaaactctggtttctgttttacctctggattcctgtagatcaggaagagggtggttgggcaggggccaatggctcctttgtttcccctggagataggtgtagctctgccagtagtactcagaggcttctctgcagttctatctcctcaagctgtcccgcaggacagcttcaaactctcctgcaaactcatgcatcccactgcccccaactcttgggaacagaatttgacaccctgcaagcccaggcctgtgcttcacatacttttggaaagtagaagaaatgatcgtgaaggtcagagaggttggaaatggtgaccaagtctgacaaggcaagatctgctatctctggtttgggaaaattaggtcacctggaaggtggaagggctgggagagaggtcgatcattagcaagttcagaatatctttttgactgtgagggaggcctggaggttaggaatgaaagtgaggaaggagagacaaaaattatgataattccctatttggggtttcatcttcccctggtgaataccctttaaactgaatacccttctatatccaaagactgctttcttctttcctcttgttctttcctgtatctcaacaccatttctgatagtgcccaccctgctttgtggttggaggagaaaatccctgacacaagtgctccaagattgacgggaagctggtggggagatggacttaggtagggaagggagatcacactgtgattcatgtttctcttcttttgtcttgattttagctgatgatgaacctaagcaaagctggaggaaacactaagccagaggcagcaaatcaggggcccataggccaaaccagcttgcagacatttagaaacccatatttccggctgggtgcggtggctcacacctgtaatctcagcactttgagagtctgaggcaggcaaatcacctgaggtcaggagttagagatcagcctgaccaacacggcgaaaccccatctctactaaaaatacaaattagttgggcatggtggtgcaggcctgtaatcccagctagtcaggaggcggaggcaggggaattgcttgaacttgggaggcggaggttgcagttagccgagatcgcaccattgcactccagcctgtgcaacaagagtgaaactctgtctcaaaaaaaattaaaaataaataaataaataaataaacctgtatttcctttcctaaacatttgaatcggttgtaaacatttaaaaatcagatttcactaacatctaccgttctggtgtctcttaaaaagcaatcatatttggtaacactgagtcacattctttcatggcattaatcagctggagctgaaggggctagacaggctctggtttgccagttctcaccactccctattgcattacactcacatgcttcgatcttttatatctgcctgactcctgtttagtgtttaggtttgtcttagtttgttacctctgctctaagtagagcttctcaaatatttcttctgcaggacccctaagatacaagagagtgaaccattttcccccaggactcccaaagcagtctaaagtagcctgtcataagccagaaatgtctttgaagtacctattttctttaaaaaatgcaaattttgatttacactgcataatatatttgtgttggttttagcataaaaatgatttatcttcccccaccaaatcttaaaagtaaaattaacactctggaagatgtgccatgtgtattctgtggctccaaatagtcttcaccatatcaccctaggaataatccaatttaaacagcactgtataaaggcatgaggtaaagagagacatggagaaaagacacagagaaagagtcaaaaagaggaaaagaatttgaaaaacaacaagaatgagtctgagtgacaagctttctgtctggtcctcagccaaccctccaggcctggcccagtccagccactgagaagtgtataaacatccctgatatctctggacaggtgttagtgtggcggctcagggtagaaagcaagacccaaaacaggagccaagccaagtaagggagaggtgagggatccagagcagccaagtatggtcagatgagaaagattgtctaggtgtgccaggaaagaggcttggaaaggaaatggaagacttagaaaagggctgatcagcatttgccctttctcccactgagcccattttgtgtcacttcctcttatcactctgcctaagaaaaatgaggtacaagcattaaattgtcctcctttgaagagggaatttcttctccaaaatggctacatctctggtcataccagagcctaaggaggatgagtaccagggcttctttccctgtccaaatgggactctacctattctctccaagacaggaaatacctcaaatccacatccctaacttaggtgagtttcttccacctaccccttttggtaagacaaaaataggtctaactccctccctcctaatctaatattatcagcactgccctgagtgtaccaaagaatatcagagacaggatttggatattttccccctttctctactgtaaaccaggatcaatgtggaatcacaaggatgggaactattcaggaaagggctgggagcacagcccaaagctgaggatcctgggaggaggagaggtttgagaatggagaataatcccagactctgaggtcgtggggacctagccccttcctgcattggttgggatcaggcctaaggaatctctggattccttccccagcatcttgacatcttggattcccaaggtgagagcacctagccattacggtcccgcagttaagctggatcattgtcttcccactgacccccattaaggttatgagggggacctcccttctttcctagatacaaagaggcaaattaaagtctattggagatgagccaaaggcctttctgaggtgatagcaggaaactggaacttatttccagttttgtggtcccaaatgaccttgaggaaatgtgagccccagaaggggaaaggtcagtggagaagaggtcactactggtttggccagattagttagtggagctattctcgttgagctcatttctcttctccatcctctggctggacatgacatacgaggggagatgaagaggacatgcccaccagccccttcttcagtcagaaatctactggtggcctgtttgatttgagtcctggcttgcagattgtgaccttgaactctgctgtaggtggtgtccctttcttgctagttgatggaattgttgatcttcttgctacccaagctgaagcaggttcttggaaacgactggccagatgcctgaggtatctttagtctgcctaggctgaaaataaagtggggaaatccagcgaatggaatgtgttcagccaaagctaggcacatcctgcctttgttctcaggcccatttgaattcttacagatggatcagcataagccctactatgtgagagctagaagggctcccagtggacacatctagtccaaatttatatttcacacatgaggaatactgaggagtggagacatacatgactttctgaagggcacgaagctatggagtggtgaaactaggaccacaaaatagtgtgaaacactgtctcttaaaaaaagtgaattgaggaaaagaactgtctgttccttaccaaattataggtgcccaattaccttattcatctgaccctccaattttctttggtctccactcccaatctaaactacatgttgcttccaggtctgccatttagcctccctcaaaccacttgagtcactgaggctgtctgcagacccctcttaaactgcccacctgagatgggagaaaaatcatgaggctagggatggaacatagcatagagaaaaataggactctttcccttttttttttttgtagaggcagacttagggaagactatgttgccccaagctggtcttgaactactcgcctcaagcaacctcccacctcagcctccaaaagctgtgggattacaggtgggagccaccatgcccaggataggattcttgacagagaacctaccctgcctggggccagtgcagcccaggctgtggacatggcagcaatctgttcaacataagccctatcaggcgagtagtactgggctgagcagcactgtgtaagtcctctgtaaatgtttgcaagcaggcgctgggcacggtggctcacgcctgtaatcccagcactttgggaggccaaggcaggcagatcacaaggtcaggagttcgaaccagcctgaccaacatggtgaaaccccgtctctgctaaaaatataaaaattagctgggcatggtggcgtgcgcctgtaatctcagctactcaggaggctggggcagcagaatcacttgaatccaggaggcagaggttgcagtgagctgagatcgtgccactgcactccagcctgggcaacagagtgagactccatttcaaaaaacaaaacaagacaaaacaaaaaaagtttgcaagtatggcctcaagccctaacctctcaggggttcttccaaagtgaataggagccgtgaccctgtttactaggtcttgggcttcaggcctgcctgatagtacctatggaaagtaggggaaaggttgatggaaacaagtctagctcatgcctggaaccacttcagaatctgggaaagctgctgggtcctgtgtccctggctttgtccagcaaggtcacctgcagacagggcagagtccaagaatagtctgatcttcctgacactttgaagtaatacaactgatctcaagtggtcactccaacctttgtcctcatttccccagtttcatgggaaaaggatgtgtgtgcataggatgtgtgctgcttttccagaatcttctttgttcccactcttttaagttcccaggctgacattgtgggctttatggggtggctatgctcccaacacagacacatatagttgaccaggttaggacttggtgtgtgtatgtagggaacaatgcaaaaggaaaattttcaatagcttttacttttgtttttgctgatctctccctagctataatcacaggctgaagtacagctatgggaaacccgttacaggtcccctatttccttcctgccactcaacacaacacctcaggaggactaaaaaaaaaaacacatcaatcatcataaattgctcaatgactctagaatgttctgtttctattcctgtttccttcactgcttctactcttttcttcttttcttagaggcgggttcttgctttgttgcccaggctggtggtgcaatcatatagctcaccgcagcctcaaactccagggctctagggatcctcctgccttagcctccctagtagctgggactactagggagtgccaccacgctcagctatttgaaatattttaaaatatttttgttgtagagacagggactcgctttgttgcctagactggtctcaaactcctggcttcaagcaatcctcttgcctcagtcttccaaacttctgggattacaggcttgagccatggcacctgccattgcttctatgtaaacactaactaacacacccaaactaggcttttaaggtgctttccctcaatggagtcacagtctttcttcattctttacaatggggtcagacatattcaaccttagattgacagtctctatcacttgatgctgtagggaattcagtcggcctgcctgaatgcagttggggaattttttgaaggttcttctataccccatcttacggctttcaaatgctcagcagggttgctatgatagcatgccttcttattcagttcctattctggacacgcagcttgcccgtgactgttgcatgtcaagtggctggaaccaatcagcttatctaaggcttcctcagaagccaatcagagcctcggaaagtgacctcacccaagggagagctctgtgggcgagaaagcatctctcagatctgtgagtgtccctaagtcactcccttcctccccaccctccttacttcctgtaaaacaacaccacaccgcctacctcccttcccccaaagaaagggagtgagaaaggctaactaaattccacaaagggaagaaccaaaagagaaactgcaactcagccacacactggtttctgtaactggagaacaggatatttagggggacttgctctgcacagacatacctttcaaagtggcatctccagagtctggaagaggagggagtatggtgaataagtcagctcctcctccctcctcatacctggttttcttgcctttccccacaaaaatagctgtaatcattttttgtaaataaggacaagatcaaggtcaagtgtgggaaagacaggacctatgtccttgtgaacatgtgtgaacagacacaatcatgtccttgtggcctgaggaccagaggctcagaagtcagctgtactgcagggggcgtaggctgttctctacaatttactttgcattgccctacagatgaggccttgaatattccttggctgggctcgattgtgaatatgtgtcccaccatgggggtagaagggaagggacaaaggacaagcgggctgtagggctgtaaccctccagtgtgtcacaccagacccggcttagttaagcatttccttcattcctccagccctctgtcaccaggcctcacccacaacagagagacagataaaaacactttatttaaaagtataaaaccaggcttactccttcaaactgctcccacccctaattatctccacaaagagctatataaattgggcaggggtatgtgtacagtcatctcagctctaacaaccccagttcttctttcaattctcctttctcccttcatacaattgagatgtttgtcctttgcactttccccaagatagcaaaggtgatacaaatgtggaaggaggggaagtgtagaaaataaactgtcatcatcctctattcccatctccagggaacagacagattatatgaactctgaccaaatgatttgcttgtctgaagaaacaaataataggtacagttactctctgtatcctaaagaaagacacgagggtccagagtccttcttcagtatatagcctcgtccatattgtcatcactgtcaccaccaaagtcctctccattgtcaaaatatgacatgatgtaatcagtttcctgaaatggaaaaaaaaaaaaaagtaaaagtcaatttggcattcaccttccttcctgtgtaccagacccctttcctctcagtcacaccattccaggcctgagacatctcttccagctgtagtttgtagaaggggggcagatgaagtagagagaagcccctaccctggggggcactatctctgttggcatgccaaccctctgaggagagcaaccctagtataaagagggtaaagggagggggactaaggtggaaggagtccccttcacctcttcatgttcttcttcatcatactcttcttcttcctcctcttccttctcttcttcttcttctttctcctcatcctcctctgaagttacttcttcttccttcttctccagggtctcatgtggggatgaataggaatagaaactcaggttcagttcacagaagggaaaaattgaggcacacatgggccaagagagagggaatggatccagggctcaggaggtctctatgcacacttcctcctcacctctagtttctgtattgtttcctccttatcttctgtggtcttagggggcctcttggggagcagaattgtaatccctggtggagggatcaaaaggtaaaccttcagagagcaaattttgccagctttatagcccatcctcatgcaaagaacatgtcactctgctgccctcatgtggccactatgacatctagcaacaacacttggtagattgggtataggaactgggatggaaggtgagaccagcagcagcctcggccctcaggctgatgaaggaaacctctcttctccctccttttttccagatacactcacgttccttctgtagcttccgcactcggatctttagctcccggggtagacgccgccaatctgggaatagtgggaacgtaaatgtcaataggaccctgcctggggtctccagtgaatactgactggttttaaaggggggtgagggttttaaaggagaggaaggaaggggctgggccaaagttgttcagtggcttggatatctcctgagtagtgggaactatttaatagctttttcaggtagaatctgagaatgtgttggaccataactaaggctctagcttgcagatgctggatcggggaatggggtggggtcatgggcgtggtgggaatagcttgaagcatcccatgcatttgaaagaagggcagtcaatgaaagggcccatcacctaccagggttccaatcgatggcattgtcaatcggacctgacatctgatatttgtctgaataacgctccacatctgaggggtggaagggtcaaagttttatcccttcagagacccagaacaggactgttcctgagagtccagccctctcaatactgaggaattatctgtttccttaccccaaacccagagcccagggggtcagcttcagtgaggaccttatcacttttttttttttttttttttgagacagagtctcgctctgtccctcaggctggagtgcagtggtacaatctcagcttactgcaacctccacctcccaggttcaagcgattctcctgcctcagtctcctgagtagctgggactacaggcacacaccaccacgcctagctaatttttgtatttttagtagagacggggtttcaccatgttggccaggatggtctcaatctcctgacctcgtgatccacccacctcggcctcccaaagtgctgggattacaggcgtgaattactgcgcccggccccttatcactcttctaacctgttccttttccacccaaaattacgattttttttttttcagacagaatctcgcactgtcgcctgggctggagtgcagtggcgtgatctcagcccactgcaacctccgcctcccaagttcaagcaattcttgcctcagcctcccaagcagctgggattagaggcatctgccaccaggcctggctaatttttttgtattttttgtagagacggggtttcactatgttggccaagctggtcttgaactcctgacctcgtgatctgcccacctcagcctcccaaagtgctgggattctaggtgtgagccaccacacctggccttttttttttgagacagaggtttgctgtgtcacccaggctagagtgcagtggcaagatctcagctcactgcaacctccacctcccaggttcaagcgattctcatgcctcagcctcagcctcagcctcccgagtagctgagaccacaggcacacaccactgtgcctggctaatttttatatttttagtagagacagggtttcaccgtattggctaggctggcctcaaactcctggcctcaagtgatccacccatgtcagcctcccaaagtgctggccattacaggcgtaagccaccgcacccggccatgatgattttttttttttctgtcccttagttcaaaggcatggctgtattaagaaatagcgtggtgcagtggaaagtatgctagggaataagaaaccaggatttcagtattctcttgttggttggtgcttataatatccagattgttaaaaattttgctgggcgcagtggctcatgcctgtaatcccagcactttgggaggccaaggcaggagaatctcttgagcccagaagttcaagaccagcctggacaacataaggacaccctatctctattttacaaaaaaataaaaaatatataattttttagaaaatacatccccctacttatacacgtgaaatgggattttaatatttaacctcctgctgtcccaagactatcatgagactcaaaacaaaccatgaatactataatgcatttcagatacaggggtaactattatgatctccccagttagatagtatgcttcctgtgcccctctggcccccagtggtgctgagcacagggcactccccatggaaggcactcagaatatgatgctagcattccaactgacctctcttggggacagctggccggatgaagtaggggagctgcctcatggctcctcgtagctcttgcttcagtgccaggacatattccccttcctcgcctgagggcaaaggtactgggcggaactccaagggctaaagaggcaggggcagtggtcagttcagggagaaaatgctagtacaaatttaggaagacccctcctcccaatttagtctaacactcccactgagcagagggccaaatgacaatcgagggagtaacatattattttgaaagctggggagaagtaaaggtggacacttctttgcctgcaaaacatccctgtgcattgggagtatagagagagggccaaagcgaggatggttttatgatggtccaggaggaattcagaatcatgtacagtcagccaggggcacatgagagtctgggaagggagtggagagactcacagggaagagtggagaaggctgcagggtgggtgggggcaaagcatcccctttcccaatgcccacggcctccacgttgaaggtcaactggccccggccacgaccccggcccccaccccggctggccatggtggagggggcctgggtattcagagatccagtgaataaacctaataaagacaaaaacaaagagaaaaagaaatgtagtagaatggacaggaagccaaggaggtacaagacattcaatcttttatctctgggacatgaaaagttaatgtcattcaacaaattttgactgagaaggcacagtgtcagagagagaatttctggaaatataaacatgaatgagacatggtcccccaaacaggtcagataattacaatatagtttagcacaaaggagaaagtgctgacacctttggacaaaactctacatccctaagacaatttgatgtttatctctatctgcatttctttatttttatttttagagatgctctgtcacccaggcttgagtgcaatggtgcaatcacagttcactctagcctcgaacccctgggctcaagatcctcctgcctcagcctcccaaagtgctgggattacaggcatgaaccactatgcccagccacaaactgcatttctacatataacctttgaattctttctatctctggccttccaaacctgaccaggccccaattcaatccaatgcaatgcattcggcgaaacatttattaatcgtctaccatgaaaaagatagtgtgtcaggcactgtgggagcacagggatgagtcatcaatttcattgtaaaccaggggaaaagacacattacaatcaaattgatctttttattttattttatttgagatagggtctctttctgtcatccaggctggagtgccgtggtgtgatcatggctcactgcagcctcaacctcctgggctcaggtgatcctcctgccttagcctcccaagtagctggagctacaggtgtgtgccaccatgcctggctcttttttttttttttttttttttaagagactggatttcattatgtcaagtgatccaactgtctcagcctcccaaagtgctgggattacaggcatgagccaccgcgagaggccaaattgatctttttaaacaccacttggaagcatagaatcttagaattgggaggacccttatagaggtcatctagtctaaacccctcccagtgcaggacttcactctgtaaattgttttgttgttgtttggtgtatgtgtgtgtcttctttttttttttcttgagacagagtctcactttgttgcccaggctggagtgcagcagtgcaatcttggctcactgcaacctctgcctcccaggctcaagtgatcctcctgcctcagcttcctgagtagctgggactacaggcatgtgccaccaagcctggctaatttttgtattttttgtagagacaggatttcgccatgtcacccaggctggtctcgaactcctggactcaaatgatccacctgcttgggcttcccaaagtgctgggattacaggtgtgagtcaccacccctgaccctactttgtgaattgttattcagcttttggtggcatttccctaaagagatggtatccattctccccccaagacagtatattccactgtgatcaacactgatgaatctaaagtttctccttctaccgaattttcactctgtctcttatcatcaatcctgaggaaccagtcagaggcagctaggatgggggaataaaatcaccagatgaaaagaaaacttgagagaaatgatatcccagtagcaatgagcacacctagcacccagatcttggtttctcatacaattttccaataaaaggaaccagggctctctggactactagctgattctaggacagggtaggaaatatacaacatgagtctagagcatcttgaggtgccaaaaagtaaggaggtgctcaaaacaacaaccacactcacatattgatgggttagctgggtgcagcggctcattgctataatcccagcactttgagaggctggagcgggcagatcactcgagccctaggagtttgagaccagtctggacaacagggcaaaacctcgtctttacaaaaaatacaaaaattagccaggcatggtggcatgcacccgtggtcactgggtgatccttccctactgggaaggattgcttgagccggggaggttgatgctgcaatgttatgattgcaccacttgcactccaacctgggtggcagagtaaagactctgtctcaaacaaacgaaaaacaaacaaaaaggagaaaaaacgaaaaaaataaacatattgatgaggctatgtcaaagggacataagagccaactgaaaaagttcccaatggccaaagctgaaacaatttgaggaacaaaataaataaagcagtattagattataaccccaaagtataagataaatatctgtgagtccatagtgatataaataaatgactgaatttatttatatgggggaaaaaagacaaatctctcatgtagaattccaaataaaatatgtagacactccatcctaaaagggagcaggggagcataactccccactttttttttttttttttgagatggagtttcgctcttattgcccaggctggagtacaacggcacgatctcggctcgctgcaacctccacctcccgggttcaagagattctcctgcctcagcctcccaagtagctgggattacaggcatgtgccaccacgcccggctaattttgtatttttagtagagacggggtttctccatgttggtcaggctggtctcaaactcccaacctcaggtgacccacccacctcggcctcccaaagtgctgggattcaggcgtgagccaccgcactggctataacttcccacttcttatgtgtggactgtgtatagggaatttctctctctctctctctctatatatatacacacacacacacacacgtatatatatatatatatattttttttttttttttttttttttttttttgagacagagtctcactctgtcacccaggctggagtgcagtggcgcaatctcagctcactgcaacctctgcctcccgggtgcaagcgactctcctgcctcagcctcctgaatagctgggattacgggcgcacgccactacgcccggctaatttttgtatttttagtagagacggggtttcaccatgttggtcagtctggtcttgaactcctgatctcatgatccgcctgcctcggcctcccaaagtgctgggattacaggcgtgagccactgcacccggccctcattcaataatttaggaaatcaggaggaatatctttacagtggagagaccagaaaaacactacttcaaccagatgaccaaggtcagcatcagtactcataaatcatgttttcggtatgtgcccttaaaattacatgataaaatggtacttcacctctgtgatcatcctcctaaaaacccataaccccacactaataaagagaaaaatatcaaattccagcagaaaggcatcctacaatatacccaactcctcaaaactgtcagtcatcaaaaacagtaaagtctgagaaacccgtcacacttaagaggagcctaaggagacgtgacaactaaatataatgtggaatcctaaatgggattcatgtacagaaaaagagcaataggtaaaaaccaaagaaatgtcaatcaagtatcaaccttagttaataataatgtatcagtattcattcattaattgtaacaaatatacgaatcaattttttttttttttttttttttttgagatggagtttcgctcttgttgcccggctggagtgcaatggcgcgatctcggctcactgcaacttccgcctcccaggttcaagcgattctcctgcctcagcctgctgagtacctgggattacaggcatgcgccaccacgcctggctaattttatactttttttagtacagagggggtttctccatgttggtcaggctggtctccacctcccgaccaggtgatccatccgcctcggcctcccaaagtgctagattacaggcatgagccactgcgcccggcatttttttttttttttttttttttttttttgagatggagtttcgctcttgttgcccggctggagtgcaatggcgcgatctcggctcactgcaacctccgcctcccgggttcaagcgattctcctgcctcagcctcccgagtagttgggattacaggagcccgccaccgtgcccggctaatttgtttttgtatttttagtagagacggggtttcaccatcttggccaggttggtctcgaactcctgacctcgtgatccacccgcctcagcctcccaaagtgctgggattacaggcgtgagtcaccgcggccggccaatctacaatgttaataggggaaactgtgcactgggacaaatgggaactcttggcactatctgctaaatttttccgtaagtcttaaattgttctaaaatatataatctattaattaaaacaaaaacaaaaaacaaaaaaaactcgaggctgggcgtggtggttcacacctgtaatcccagcactctgggaggctggggtgggatgactacttaagtccaggagtttgagaccagccggggcaacatagtgagattccatctctacaaaaaataaaaaaattagccaggcatggtggcacatgccagtagtcccagctacgtgggagactgaggtggaaggatcgcttcagcccgggagataagaggattcagtgagccatgatcatgtcactgcactcaccctgggtgacagagaccttgtctcaaaacaaaaagctaaaacaaaaatcaagtagcaattcaaaattcccaagagattagttggtgaaaaaaatatttaaaaataatatgtagaaggtaatcttctgtcagaaatacatacacacatatgaattaaaaatctgttatagaaggatatgtaccaaaaattaacaacggttaatttgaaggatgagggttttttgaattttttctggtggggagagttgtgtatctttttttttttttttttgagacagagtcttgctctgtcacccaggctggagtggtgcagtggtgcaatctcggctcaccgcagcctccaccttacgggttcaagcaattctcctgcctcagcctcctgagtggctgggattacaggcacccaccaccatgcttagctaatttttgtatttttagtagagagggggttttcccatgttggccaggctggtctcaaactcctgacctcgtgatctgcctgcctcagcctcccaaagtgctgggattacaggcatgagccaccatgcccagccaggttatgtatgctttgtttttttctatactgaatagaatactataacaacattaaaatattaatttaaaaatttttggctgggcatggtggctcatgcctgtaatcccaacactttgggaggccgaggcaggtggatcacaaggtcaagggatcgagaacatcctggtcaacatggcaaaaccccgtctctactaaaatacaaaaattagctgggcatggtggtgtgcgcctgtagtcccagctactcaggaagctgaggcaggagaatcgcttgaacccgggaggtggaggttgcagtgagccgagatggcgccactgcactccagactggcaaaagagcgagactgtgtctcaaaaaaatttttttttaatgggccagttgtggtggttcatggaggtaatttcagcactttgggaggccagggcagaaggatcacttgggcccaggcagtcgaggctgcagtgagctatgatcacaccactgtgcaccagtctgggcaacagagtgagaccgtgtctcaataaatagataaataaaatttaaatgtcgtaacagaatactaaatgagattaataatctgtagctaggagagggtagaaaaatgtatatctgaggaatctgggaagtttcaagcccaactgccataaaaaaaattgaggaaacaatggctgttggttaagatatcaaattgcaatctgtttgaaaagagcatattaagggagagaagatgtctcatggagactagagaaataataagaatttgttggctgggcgtggtggctcatgcttgtaatcccagcactttaggaggctgaggtgggcggatcacgaggtcaggagttcaagaccagcctgaccaacaaagtgaaaccccgtctctactaaaaatacaaaaaattagccaggcgtggtggtgcacgcctgtaatcccagctactcaggaggccgaggcaggagaataacttgaaatcaggaggcagaggttgcagtgagccaagattgtgccactgcactccagcctgggcaacagagcgagactctgtctcaaaaaaaaaaaaaaaagaatttgtcaccgtgtcttcagccccttttaagcgagagaacattctaaccagctggttaagtatctttccacttgacagatatagttctggcagtggagataggagctgctgtgactgcaaagcaatgaagagtcaataaatggccatgagtttgaggttagacaaattccacaccatttctacacattaaatgagtgatcctctaagaatgcaggggaaaaagaagacaaaattttatttaatacaggttgggaaataaaccatccatctgccccattcatcttaggaatctatagggagtctctgctattaaagattgtgatggagttaaaattcttgaggatacttaaggtctcccataatctagtcacaatctgctcctccttaacatcaacctttccagagagtttacccctgtactctgttttactccaaacaacactcatatacactatgctcattcccaattattcatacatatatattgtggtggaagttactgagaggcaggtttcaactaaacatacagaaaaacactaacaattacatcaaatttaaggaaggcagtacatgtagaggttaagaatatggttttgaatcccagttcaatttcctagctacaaaactctggtaatttatttattgtctctaaacctgtttcctcatctgtaaaatgggaataaaaataacaataatagaatcatttcactcaacaaatatttactgagtgcttactaggtgtgccaggcactgttctagattctatggatatagcagtgtgcaaaacagacaaaaacatgctgcacccacggggtttaaatggagctttcattccagtggaggcatcagcaaacaaacaatacttcaagccatgagactaggtgagacccctaaaggagtggatgtggacagagaaaataagaaatccaggcactgaggcctggggcacgctgatgtgtagaatttgctatacatgtaataaataaagcaagaaattaacacccttaaaatcttggaaatccaaattttaaaaaatcatctcaatagaaaaaatgggcaaaggacatgaacaggcaactggcaaagagaatggccatgtctggacatggtggctcactcctgtaatccagggttttgggaggccgaggtggacagatcacttgaggccaggagttcatgaccagcctgggcaacatagagaaaccctgtctctactaaaaatacaaaaaattagccaggcacagtggtacacacctttaattccagctactcaggaggctgaggcatgagactcacttgaacacaggaggtggaggttgcagtgagctgagatctcaccactgcactccagcttgggcaacagagcaagactgtctcaaaaaaaaaaaaaaggagagagaatggccaataaaaccactcttcacctatgaaagtgacaaagatttaaataataagcaggctgtcatgagttttttttcaaatggacactctcatacctcactggaaagactataaacataatatttcaaggggagcaatttgtccagttaaatcaacagcctttgaaatgtttatatccctaatccagcaatcccactttaaaaatatattccaaagacatcaacagatatacagtcacagatataagtaaaaggatattcatcaaagagctatttatggtagcaaaaattctgaaataactgaaacaatctaacaataaatgaatggttaaaaaatacccattttatttatttatgttctttttattttattattttttttttgagacagtttcactcttgtcgtccaggctggagtgcaatggcgcaatctcagctcaccgcaacctccacctcctgggttcaagtgattctcctgcctcagccccccgagtagctgggattacaggcatgcgccaccatgcctggctaattttttttgtagttttagtagagatggggtttctccatgttggtcaggctggtcttgtactcctgacttcgtgatccacccgccttggcctcacaaagtgctgggattacaggcatgagccatcacgcccggcctcttttttttttttttttttttgagacaggttcttgctctgtcgcttaggctgaagtgcagtgcagtggcaattttggctcactgcagcctcgacttctccagctcaagcaaccctccacctcagcctcctgagcagctggaactacaggcctgagacaccatgcttggctattttttttgtagtttttgtagagacagggttttgtcatgttgcctagactggtcttgaactcctgggctaaagtgatctgcctacctcagcctcccaaagtgctggaattacaggcatgagccaccacgcccagccagaaatggcttgcttttaagaatgctaccaattccactgtaaaaggacagatttcctttttttttttttttttttttttttgagagggagttttgctcttgttgcccaggctggagtgcaatggtgcgatctgagctcactgcaacctccgcctcctgggttctaatgattctcctgcctcagcctccccagtagctgggattacaggcatgcgccaacacgcccagctaatttttgtatttttagtagagacagagtttctccacgttggtcaggctggtctccaactcccgacctcaggcgatctgcccgcctcggcctcccaaagtgctgggattacaggcatgagccaccgtgcccagccatatttccctcttttacagtggaagtgtggaatgcatttcctttagctatatatttcttatttagaatatttgtaggatattgactaaagaacaggtatcaaaaaattgaatgatctacaagagagataagagagttcccttactaaagatgtttacatagaagctgggtaaaaatttactacatagggtttgtaagaaggatgcatggctctagtagaggattccctatgatcagcatgatttagcattgtgtctggcatatagtaggtgctcaataaatatttattgaatgaataaatacatcatttctatgggcctttccaaacttgagaaattgtgatccataaagcctcccctcaccattccagttctccttgctttcttccttctctagattgtagaaacaattatgaaacactaatattatgaaccactaatttaatggctcttaattacatactgtattgtcttttattgttccctagttatgttaggagtttaaattctgcctccccaaaaagagtgctagttaccagaaatcaattctatttaactaacgtttattgggcactatatattaactactagcacctgtcctacaaaaccttctattctaaaaggcatagaaacgttaaagagagacagtgcactaagtgtcctaataaaggtatatacaaaacgctatcgtagacgggggaacaattcattttgcaagaaaggcggcccaggaaaactacaggtagcatttcagctagtcttcatagataacaggagtttgtcaggctcttgggataatattaatagattagggggaagttgatgctatagcaaagacagatacaagaggctgtctcgttttctgctttaatgtctctccccatgcgcgatagaaaactgccattctctagtatacaatcaatacagaaatggaagcccaggggagaaacggtagggagccagaagggggctgatccaacaacctgacggaaagcgttgtctatttcgcagcctggccggggtgaacaagtttggcaagtgtcggaccgaaccaggtcaagccttacctgctgcccctccccaaagcggagcccaagccgcgaccaacttgaaatgtactgggcttcctcaagtcggtggcgttctaagcccgcctcccggagctccctattggtgagttttctcggccaatgcaggagaagccgaggagggaagtccgccctcttgaagcctaggaagagaaggagggagggagcgagtacgcccggaaccgaagcttgcgaagcgggtcgcagagagagatgggcgttgcagaatcagctggggtcacttatttccggtctcactccagatgaaggagccactagccggcgagagttcaccgagggaacgtgacactcatatctcatcgagggaccgtgttgagggagcccctacagagaggccaaaggaggagagggcctacggagaaatgaacctctgtaaaagctgctctttagggatcagtctttttgtgactctagcttcatagcttggtctctccattactccagccttcctttcaatcatacactgcctctctccagcaccaccaatggatacttcttttctaaaaatgtttttctgtgggttgctgccgtgtctgtgagaaggtgggcagagggttcaagaaaggaaggatttgggatcagcgtaccagggttggggagacagggcaggagcccagctttttctgcattttccactactttccacttcctgcgagctccttgggaaagccagcagagtggaaggaggagtcctattttcacagaaagcagaaacaagggagaaaggttcagaatggagatgaaatctaggagttagtcaagaagaacatcccagatgtcagagaaaatggcctgtagactgggaggctgtaggtgtagtggcaagcgcccagtctttgccataggacagaaacatagctgtgaagctttggagagcttgcttaaccttattaagtctgtttcctcatctgtaacaagaagatgatagttcctatcttataaagttgtgaggattgaaaatagtgtatgtaaagcacatggcacatagttgacacgtgtccaagaaataactagtaaaaatgggtagcttcctgcaaatatttctctctctctcccatccccgggaacattattttcagtatcttgcatctggggggcctccagcctctgaattagctcaggaccctgagtgaactttttaaatccttaggatttttctttttctcccacttcccttggtgccttacagctggacacaaactcattcctaaaatatgtggatggaagctatggtaaccatggagacagggcaggtggcaaggagaggcagagacagtgtgagagaccaatagacagataggaagagagaagatataaggaatgtttcagacagagatcgtcaagcaagatggaaaaaataagacgtctaagcaagactgagattaaagagatgcaatgtgagagagtgtattacaaggttcgctcttcttcctgcccctgtcctatctccctgcccacaataatacggggtggaggcacctggaatgtcccttgccttatctaaaagtgctcccatatccaccttcctcatacttatctaagaggtctacataagggagctgaggtccaagtttctctgcgatgggtgttccgtttttgagagatggggcgggggtgtatctgtgtctgactccaggctggaccgtgatctccttcacaattaaactacaggaagaaagccacatctcttgcctctctttgcacagtatggacaccggctgtggatccaaaaagcctttctacacctttcttacacagtgtgccatgtgccgtgtatggcaggtcaggtctggcgcacaggagcgcacaaacacaccaagtgcggagaatggggatctgctgaatctcagcgaagaatctggatgatggtccctgtctgggtcgcggaggagtcccctaaggaacacttaggtttgttggggctgaggggaggtcggctgagaaaaggaagtcaggattggagcctctaggtttttgagggtttatgtgtgcatgagtgggggagcagtttggtgcctgacgcccccacccgcagtgactaggctataaatagcacagcagagctccgccccccccccccccccccccgccaagcttctctcctcccgagccggcgctgtgcccggggcgctccgggaggagggaccaggatccggcgccggggcgcagatactgacaccaagggaatccgggtgccccccccccccacgccatgcgggcccccaggaaactggctccgccacctcggctgccccgtggccacggccccaatcctggccaggcggagattctgcggacattcaggtatctatctgggcacacagcctgggaggggaaagagcaaggagtgatggggaacatcgcaggggcaatagaaccccccaattctccctccacccgttttaggtctcaaatgcaggctgcttccctccccccactcaatttttggggttgtggcaagctaaaacaggttaggaatgagaatacatgtgtgactgtagggtgcatgtatgtgggtgggtggcgttcagcatcctagaaagggggatcccaagtgtggataagacaagggggacagaggaaaggtctgataagccatggggtgagggtgggggtgcggacatccctgcgcgtgcacgaacgcatttgcacgcgcgctagtccttcagtgcgggtgcacccttcccacctcctcaggcatgcgctgcgggggaagggccggctcaaaggcatgagttagaggaaggactgtatgccgtgaaggtctcctccaccccacgctgggtccctgcatctgtgcctcagttttcctgccgaatctatcaatgagatgtctctcttgcagggatcggcttcgtcactgagacctcaggcctctgccagccactccccctccccatacccctagtcatcctcggcaggtctcagtcccggctccatctgtgccctcgccccagccgcagctatgttgcacaccgagggccacgctcttcttcgggcggtgggtcagggtaagctacgcttggcccgtttgcttctggagggaggcgcctacgtgaatgagggtgatgcgcagggggagactgcgctaatggcagcctgtcgggcccgctacgacgacccccagaacaaggcacgcatggtacgctacctcctggagcaaggcgcggaccccaatatcgcagaccgattagggcgcacggcgctcatgcacgcttgcgccgggggtgggggcgccgcggtggcctcgctgctccttgcccacggcgcagacccctcagtccgagatcacgcgggcgcctcggctcttgtccacgccctggaccgcggggaccgcgagacccttgccacactgctggacgcctgcaaggccaagggtacggaggtcatcatcatcaccaccgatacctcgccctcaggcaccaagaagacccggcagtatctcaattctccaccatccccaggggtggaggaccctgctcccgcctctcctagcccggggttctgcacgtcgccttcggaaatccaactgcagaccgctggaggaggagggcgtgggatgttatcccctcgcgcccaggaagaagaggagaagcgggacgtatttgaattccctcttcctaagccccccgatgacccatccccttccgagccgctccccaaaccaccacgccatcccccaaaaccactcaaaaggctcaactccgagccctggggcctagtggcccctcctcaaccagtcccacccactgaagggagaccggggatcgagcgcttgactgccgaattcaatggcctgaccctgaccggtcgaccccgtctttcccgacgtcacagcaccgaaggccctgaggacccgcccccatgggcggagaaagtgactagcgggggtcctctctctcgccgaaacacagcaccagaagctcaggagtctggtcccccttcagggctgaggcagaaactgagccgcatggagccagtggagctggacacccctggacacctttgccctgactcgcctgagtccagccgcctgtccctggagcgccgccgatacagcgcctccccgttgaccctccctccagccggctcggctccctctccgcgccagtcccaggagagtctgccaggggcagtatctccgctaagcggaaggaggcggagtccggggctgctggagcggaggggctcggggacgttgctcctggaccacatctcgcaaacgcggccgggtttcctaccccctctcaacgtcagtccccaccctcccatccctgacattcgcccacaacccggaggtcgggcgccttcgttgcctgcccctccttatgccggggcgccaggctctcccaggaccaagcgcaaattggtgagacgccactccatgcagactgagcagatccgcctgctggggggcttccagagtctaggtgggcctggggagccagggcgctgagaggagtgagaggagccaaggagggtggggattaggaccttaatgggataggtgggagaaccagctcacacacacaccacgaacaaagggatctcttgcatgtgctcatgggtgcacagtgcacccacacatggttaaacatgtgtccataagcacagtactcttattagcaagaaagaataagtactctatttactgggtatatacacacatgtattcatgccctggtcatttcacatgcatatgggattacttgtgtacctacaggcacagcatatcaataaacacacagggctagggtcccaaactctcttgcatttgttcagaagcagtagggaacccttacttatgggcagtctccgatgtctttgccctcctgcagaagcaatcccttgctttccatgtatgccctgaaacacagcctatcatgattttgcacactctctccgtggacatcccagcccattctgcaggtcttgcttctttctccaggcctggctccttattcacaccctgcttctaaccccaaccacttttcaggatatctttttcactcttcttgggggttcctgcagcaacccccagcctcagttctgctgctgtctttactgctctcaacttcacttctcaacttcctgctttttattcccaccctgttcctccaacaactacaacagattgtctcattttcccagggggtgggtcatgggctctaagctgctcttctgtctgtctgagcttatgaacacccccacaggtagaagtggggagaaaccctaaatcactcctctctccacttgacatatcaaataaatgtgttcagaagtctctgttttgtcacttctgcctggaggtgtgggtatggggaatgaggaatggggagggagggtaacactaacttatagctataattatccaagggatacttagctgttccagccaccttctttccaagaaaccaacttttctatagagaaaaggcaagtgtcctgtgtcctgaagattttaaggcatttgacaggatttcatttcctccagtttcctctatgtccaaccttgaattctttaaggttcctacaaagagttcctccctccatcatcagcagatatatcccagtagattaactgtctccttttgaaacttcctatttcttgactactcacagtttttattcagggtctaattttcatttcaccaagtgtgtttcttctattttcttctacttctggcctctatttccccatctttgatttctgagccactgtaggagagatggggggaagcagttaatataatctcacctaagcaaaaatggcctggtgaccacatgataaagggtatgtagagtgtgtgtgtgtgcatgtgtgcaagtgtgtgtgtgtgcaaagtaatcagaggaacccagtctgacatattataccaacaagggtaattttcttaattcccccaactggacttctcagtttgctaattttctgcatgtatcctaactctttctcactctaatgggaggcaaagagacttgcccatcccactctctcttattcccttcctctacttagaataagtgaactcagaaatttacccaacaatgtggcatagtaaaaagataaaaatattgggaatcagaacacctatgcttaaactctgaattccactttgccatctcttagctatttaattttggccatttttctagcttccctcagcatctgtttccttatccctaaaataacaaaatctagttagtgattgtgattgtaaataagacatgcactacagtacattgcatagtttatgttcattaaatgtcagtatctttcttgccttagctccaccaccaattgcatatgatgttggacaagtcgaattacttctctgagccacaatatcctcacctgcaatctgtgaaatgaaatggtaggacaaaatgatctctactctgtctgcaatcctccccaatcttgcatctaggcccatttttttcttcaagcccagccccaagattctgtcctgctttctagtgcttgccacaggactcccaaagacgcgccgaagctctgcgtctgcctttcagaggatacgctttttctctttgcaattggttctgagaatccccaccctcctcaataatttgcctatggcggagcaggagccctccagctcccgccccatcactggtgattggcatgggacctagctcgtccccgcccccacttgactgaaggttcggccctggcaccgccctgagtccccaggcgctagctgactggggtggttgggaccgttagctcggcaggctggcaggctccggggcgctactccattggcggccgggatggagactatgcgagcgcagcggctgcagcctggtgtgggcaccagcgggaggggcactctccgagcgctgcggcccggagtgactggggccgcggctgccaccgccacaccccctgcgggccccccgcctgccccgccgcctcccgcaccgcccccgccgccgctgctcctgtctggggccccaggactacccctgccccccggcgccgccggcagcccggcagtgctgcgagaggccgtggaggccgtggtgaggagcttcgccaagcacacgcagggctatggccgaggtgagtctgcgggtctggcctcctgcgcgacaccctctgtaagggagccttgctcccacagtcctccggatcgcttttcctggcgtggagccctcacatgcatttccttttggggagtttccttctgggctacgcacacgcacagacgcacacactcatacacacgtttaagcctcctacctcctcccctttactgagttattaatatattctccagggactctttttcagatacaatcctcttttcttcctaagcttttctcctttagaaatggaattcctcctccagcttaataccttaacatctctctgcctttgagaaccagtcctcattgtgtgggatcctgtcttttatttcagatccaatttctcatccataccctctcagtctttcctctgtgatctctgcaattcctggactcacctgttaatttgctccagccccttaaccttgactgttaaattctttacttacttaccttcactctgaaatttcagtgcaacttcagatttactggggaactaggtagtgccttcacaagtcactcatagtaattgtgtatttaaatccggacctgtaccactgaactcacagcagcttcctgtggctcagtaccttactttggtatcttttttagtatggagactcacaactccagcctttctgtctggctgtgttttcctggcccttgcccaggaactgaggataaatcccaggccttggctctttcaatgttaaattctgtggaaatgtgccaggttagaaactctatttcagttagaaaacttcgttaatttctggaaagagggatgtgagggttttctttgttgttttcgtttaactagggtagtttcctgtctgagtttgagttccagatttatagtgtaagtaataaggaatatatagtgaagggtgtggaatacagaatttaagcctggaatttacaagacatcccttctgtctgcttggccaggtcctgcctgacctggaagtgactatatctttaactttctgtttaacaataatacagagaaaagttacagggcttttctgtagattttctttttttaagaaagtttagtgaaaagagcacacacaggctttggagatctttgtcacttaccagccaaatctttggggaagggacttaatttcactgagcttcagtttcttcaagggttacaatatggattgactgagacattgcaaatgacatataacctaaaaatgattattatctcaaatttgttggttcatagttccttaagtagaacatgcttcactttttcccactcttaaatcctaataatgtaaacccaaaaattcctatgaaaacagatttttagagccattttgctatatgtgcctaatgattcattcatcatcaatttccctttgttcttcatacaatttgaactcctattataagacaggaactctgctaggtgctggggatacaaatggatgaatctgaaactcatgaggaaatactatttttccaatgtaatcccaagatttaacaaggctatgtgatggaactgctattagctactatcctgctgcttcaagtctctaagtcaagatcaagggaaggtctttgcctctgggcacaggagtagcctagagtggtcacactaaatctgaagccttcctcttggcaacttacaggcatttattaaaattatagaagagtacaccctttttcttgtctgtgttacctggagagcctctgctttggctcccaaactggacatcctgtaaaaacttccatttccttagcaaggatgagggaacaaggggattgtactgacaaagggcaattaatcaggcttcacacttcgtggtgattttctttcctatctccccacctcccatcgcagtctttctcattattcttgagtttctcatttccagtctgagtgtccagccagtactttaggaaagtctggcagatagttcagcttcaggcaagcagaatctctgcccatttggctcagaagtcctttaccacatggaatcacttattctgcttcaattcttaggcaaagctgccactggcatatattcacatacccttgtgactgatggcatgttatttgggggaatggctgtattcccctgaatacaatttactttagcctctgcctagacaattcattccctcatccagcaatgctttaccacatcatcttcaattaacatccttcatcttcttcctgaatgctccaaatccaccttttccaatcagtctttagatctaccttcactcatgtgggctatcagtatgtatgtatatatgtatgtatgtatgtatttacttatttattttaaaaagctttcctgtcctttatctgcctccctcacccacttacccaagatacacacacagctcagtattctgtaggatcttgataagtttgtagtgcatgggatttgtaatcagaggacctagccctgtcaaatagttggctgtgtgatcttggagaagttgcttaatctctctatgcttcatctgttctcttcattcatttaccaaatatttattgatcaccagatgcagtggtggacaaggcagatatttagtccctatcttgatggagctcacagtttacattacagagcatgtataaagattaatggtgtagtaaagcaggccagcccaatacaaagagggttgactttggagccaaacaaacattgtttctaaatcctggttctgccacttctggcctgttccttaacttgcttactttttgtaaaatgggtattataatacttatcctgatagttttgtgtggattaaataagacaacgaatataaagcatgcagcacctggtactcagtatggttgctactattgtgcatttggaaatgctttggaaactgcaaatgataggtactgttctgcattgccatttcctttgcaccctttttttctatggcatatagtctctttctcatgtttgacatctggcaatctctaaactggcaggatcgagtaactcactttccttgctctgtaattgctacatttccctcttcaaacctgttgttttggaagtattgctatccttttatgttacaatatggctgcatgattggagattttgccctgttatttcactaagttgaacaaatgaatcttgtgtagtattttctatttagttgttccttttcctcagaatcacagatagcttcttttctgtaagactgaagttaaatgggttgggctgaatatttccaatttttggaaatgctggattagttcctatattagtttcctgtggctgctgtaacaaattatcacaactttagtggcttaaaccaacagaaatttgttctctcatagttctggaggccagaagtccaaaatcagtattactgggccaaaatcaaggtgttggcagggccgtgctccctccagaagctctaggggagaattcattccttgcctcttccagcttctggtggctgctgacattggtttattacgtggtttattgctgtatcactataatctctgcctccgtgactcctcctcttcatcaaatatgcctcctttttttttttttaagaaatggaatctcgctgtgttgcctaggctggactgcagtggtgcaatcatagctcaccgcagcctggaactgctgggctccagtgatcctcccacccgcctcagcctcccaagtagctagactacaggtgcatgtcaccacacctggctgattttaaaaaatttttttgtagagatgagatcccacagtgttgcccaggctgatcttgaactcctggcctcaagtgatcatcctgctttggcctcccaaagtgctggaattataggcatgagtcagtgtgcccatcctgcctccctcttataaggacacttgtgaatgcacttagggcccacctatataatctaggtcatctccccatctcagatcatttaaactcatctgcaaagtctttgccagataatgtcacattcacaggttccaaggattaagacatggacattttggcaggtggcattattcagtctaccagagtcccctcccaaagtcactgttactttgcagtctctccttccaaagagactgtggatcgtgggctatttaggggcagatgtaccttctaaacattgaaataggaaatagatgaactattgttaactagcttccctatcttccataataatgtgaatagagtcagtctattctcgccatcctctatgatcaaggagaatctttttactcacctcttaacttcattatctctttattcctgcttccccaccacaaagttgtatttattacttttttcttttatttttgttaattaccttcctggcaaggttgtatttatccttatgatataaaatttttactgtagtttcatatattgttttaatatttttatcctggccaggcacaatggctcatgcctgtaatcccagcattttggaggccagcgcaggaggattgcttgaaccttagggtttgagaccagcctgggcaacatagtgagaccccatctctacaaaaaaatttttttgaattatccaggcatggtggcatgcatcttgtagtcccagccactcagggagctgaggtgggaggatcacttgaacccaggaagtcaaggctgcagtgaggtgtgattgtgccactgaattctagcttcagcgatagagcgagaccttgcctcaaaaaaaaaaaatgttttaggttaggtgcggtgactcacacctgtaatcccagcactttgggaggctgaggtgggaggatcatctgaagtcaggagttcaagaccagcctggccaacatggcgaaaccccgtctctactaaaaatacaaaaattagctgggtgtggtggcgtgcgcctgtaatcccagctactcgggaggctgagcaggagaattgcttgaaccttggaggtggaggttgccgtgagccaagatcatgctactgcactccagcctgggcgacagagcaagactttgtctcaaaaaaaaaaaaaagtttttattttggctgaaaatgatcactacctctcattcccatcctgtccacttagacattcgtatattttatctcctaaaggcaaaaactaaattattctcttttttgttattcaacagcagggtataagcactgaaatattcctatcttggtctttcttgtgagagactttgagaaaacaattatcagatgtgtatatctcagttcttcctaccctcccacctcactgttctttagccatccttatgtaaaccattatatccatggttcctcattgaaaatatgatacaaaatttgggtgctccacatatacccatgcacaaatactcatatgcatacagacacacacataattttacttaacagttttaggaagcttgtgaacctccatgaagctcagctgtggactggaccttggagcctgtgttaagattcccaaattggaaagaatattggcccccggaaatctagattcatgccccaactctgccatagctatgtgacctcaaacaagtcttctgttctttcttagccagcattggactagatgatctctaaagttccttccagccctaaaaatgaataagtctagaagcattttcaaatgcggatcacaattagttgcttttttcttgaccactttgcccaattatcatttcatactcacatttctaaaatcaagactccccatgtcccttggccttgagtaatcattaaaaaatgattctctagtctgtgcaaaggaatgtttaactggatagagactgaacatatgctttttaataggaccttcccaattatggtggtctcctcctcttcctctttattccagtattctccctgttgtgtgcatgtcaagagagctgtcacccagtgcattgtgctaaactgtctcaaagagggaactggagctgaaaagatctcacggaaagaacaaagatggctgagctttctggtcagtattgacctttgaagagccctgccaaaaccaatagaaggaaagagagttttcttttcatgctggatctttttttaaattttaattttaattttttttgcccatgacagagcctcaggaggtcctaatgacatgtgccctcatgctgtcttttaatagaagaatgagcattcttaaaagtcagttaaatgtaggttattaaaaagagtttatgctgcttctccaactcaggctagtacatgggtgtttgtttcagtcacagagcaggcgagataatttattattggccactgatttcaaattccttgcttgctgggcgcggtggctcacgcctgtaatcccggcagtttgggaggccgaggcaggtggatcacctaaggtcaggagtttgagaccagcctgaccaatatggtgaaaccgtgtctctactaaaaatacaaaaattagccaggcgtggcggcatgtgcctataatcccagctactcaagaggctgagacagaagaattgcttgaacctgggaggtagaggttgcagtgagccaagattgcgccactgcactccagcctgggaaacagagggagactccaactcaaaaataaaataaattccttgcttgcaggaactgtgagttattcttttcatgctcaatgcttagaatgatgccatgtacctattaagtgctcaaagttttgctaacgtgtatatgacagccatgaaaatgtgcagttctcattgcctgctgcagggagcataactaacagcctcagccactgcccactctgggtcatccataaccacatttgcaccacaaagtcgcacattcgcatccataaccacatttgaaggaaccacgcttcctgtaggctgctcccagccaatgacctagcacatcaggggtattaacacaggcagatcctggtgagatatgggattcctttggcatgaggacttctcactgacttagccaaatctttcttaaaactgtactacagccgggcgtggtggcttgcgcctgtaatcccagcactttgggaggccgaggcgggcggatcatgaggtcaggagatcaagatcatcctggctaacacggtgaaaccctgtctctactaaaaatacaaaaaattagccgggcgtggtggtagtcccagctactcaggaggctgaggcaggagaatgacatgaacccgggaggtggagcttgcagtgagctgagatcacgccactgcactccggtctgggcgacagagtgagaatctgtttagaaaaacaacaacaacaacaacaacaacaacaaaaactgtactacagtctgagattgtcatatctagacctccttctttccctctcttccacaggcatgagatctttgctgtgctcagaaggctctccctgttgtctcctacttcctccctgataaatctcttgcaattgtctatcccatcttggtgtcttcttggcagatctgaactaaggaaatatgaaagaacgaatgagactttgttgcgattaagagtagaagaggagaggccagacgtggtggctcacgcctgtaatcccagcactttggggggccaaggtggaggaggagcactttgggaggccgcttgagctcaggagtttgagaccagcctgggcaatgtagtgaaactctgtctctacaaaaattacaaaaattagacgggcgtggtggcatgcacctgtggtcccagctactcagaggctaaggttggaggatcgcctgggcctgggaggtggaggttgcagtgagctgagatcgctccactgcactccagcctgggcaacagagtgagattctgtctcaaaaaaaaaaaaaaaaggagagtggtcagtatgttgcaagatatttcagagcacctgggataatttattattatgaggctttagctaaaactatttgaaatgtttggaaccctagagccaatgtgatcctttctaaaagcaaactgatctcatccctccttttttttttaattagttatttttccttggagctgagttagaaagactcccttctttttaaagtcctccaattgcttcctattgctctaggataaagccaatactctaacatggcctaaaaggccctacttggtctggtccctgcctcctcttgcaacctcatcttgcattacacttcccctccctcactctttcatagccatatggtcttaattccctttattcatcatgttccctgccgtcatgagcctttgaacatgctgttccttacgcacagaacactgtcctctcacctcttgcctagtgaattcctagtcatacctaaacttagatattgcctcctcagggtagctttctttgaccttcttaactaggtcagatacgccgacatctatcactcctttatagaacttgatcacagctgcaattttacatttgtttgagatttggttaatatctctttccctctttacactgtaggctacataaggaaaacgtagggatgagaggaagttttctagaatacaatgtcaggtctggagtttgattttagcctacctacaactaataaattagccatttactgtttcatgggtgctggcagaagtcaagagactttgagatttagagacaaaggaatttattattcatagcacagcaagtagcatgagcatcatgtttatattagttctccttgcctcctcccaagtccaatgcagaggactcaggtggatacttgcataggccatgggttgcttcacaacagaggaacacttatagaacccacagcttggggaacttgccattttacaacaagctgaagcaagcaagttctttatctgagtgaaggtagtacctcatccctcaatatttcttgctgcaagcacagtcctgaaaaatagcccaagtaaagagcagtcagggatttgcaatcttggtgtacctagcaagatgtgaaggagcatgagagaccgacccatggaggagtgcttctttttaaagtcctccaattgcttcccattgcattgcttcgcatctcaccatatggctcctccaaaaacatttatacccaggtaaagcctcaaaagagttttctctcccacccccatgccctggcttctctcactcgtagtatgtacatagtattctgggttggaaaaggaatctggcaatggatgtgctcactagaagcacaggctcgagaatggttattagggctatatttccttgagccagcagtattgcataaaagaatattcattggaaccaagactacttgagtttgaatactcaaactgctactttctcctggcataaccttgggcaagttatttaacttctctgtacctcatttccctcatctgtaaaatatggatagtaaaaatatctgcttcataaagttgctgtgattaaacacgtaaagcagttacagaaatgggtgacatacagttcaatacatgttagcacttattgtggtggttattatcatcctgggccagctaaccaactgtggaataatctgcttgtatttcatcaggcagtgataatggtctgctgacattgggaactctgccttcaatatttaagttattctaggactaagttaaaatgtgaactattcagattggaggtgggagtgaaaaaaaaatttaaataaaataaaatgtgaaccagaaaagtggtggaggagggcaggcctactctggtctttctaggcaaattaacttaatcacagtctaggtttattaacttaaatgcttttcaatggcgataggtagggagctaaggggcagactcttaatgtaggtacaggttacaggtactgtattgaagtatagcaccacgtggaggtgttctcattcattgctgaacttaagtacttctcttttgtagtgaatgtggtggaggcacttcaggaattctggcagatgaagcagtcccgtggtgctgacttaaagaatggggctctagtggtttatgagatggttccctccaacagccctccttatgtctgctatgtcaccctgcctgggggaagctgctttgggagtttccaggtaagagttgtgaggtggcagtagcaaaggtaaatgcttagatgttagtaacggctttctccaccactttggccattaaactgcctgaaatcatatatttgaggacctaaagcaattctggggaaattattctggcaagcatctgaggccaatttgaccatagtagaacctcagtagcatgctttcctttcaaaaactcaaacccattttgaatttgagcagttatgaatatccccttgctcagtatatccgactaccagcatccaacccatgttccaatctggcttcagttattgcattccaactttcttccatctcttattgaggatatagaacaatattccttgcctccagtactttttcgtaggcaattactaaagaaagcaatgttggagttctctaagaggtcaaatcggagggactatgtatgctggaaacagtactcatctaagagttaggagatccaaatttacattcttctgaatatcaatggggcaaatctctgggcctcacttttcccatctataacatgaaggagataggttagattatttctaaagtcttttctactactaacattctacaattatgtgaaatacctatgatgatgaaaagaatggttgccattatgaggtagtagtgaaaaattatggactagtacgaatattctcatcaaagatggattttttacattgcagacagggaggcagccttctgaaatgtcaacttaaaagtctcaaatggaatttagagaaaataataaacacctttgttctgttttccatatggtttgtgaaacccttagacaaggttaaaggccctactgtgtgtctgcatagcaccttgaacttcccctatcatatcacttattacaacatatcataattgtttgtctctcctagtggactatgttccatagaggcaaagattgtgtttgtcttctttctcgttaaatccctaccacccatcttagtgcctagcagatagtaggcaaataatacgtctgttgcatgaatgagtgccattgcagcttagtttctgcctcaaacagaagcagtcctaaggaagcttcatttcaaatcaggtgatgaaattttttcccttagaacttcagtcatttcaggccgggcacagtgactcacacctgtaatcccagcactctgggaggccgaggcgggtggatcacaaggtcaggagtttgagaccagcctgaccaacatggtgaaaccccgtctctactaaaaatacaaaaattagctgggcatggtggtgcacgcctgtaatcccagctacttaggaggctgaggcaggagaattgcttgaactctggaggcggagattgcagtgatctgagattgcaccacggcactctagcctgggcaacagagtgagactctggctcaaaaaaaaaaaaaaaaagaacttcagtcatttcagagaaataactatatacccaagatgacaaatgtttatgctttcacttgtttttttttgtttttttgtttttttgttttttgagatggagtcttgctctgtcacccaggctggagtgcagtggtatgatcttggctcactgcaacctccgcctcctgggctcaagtgattctcctgcctcaccttccccagtagctaggactagaggcgcatgccaccacgcctagctaattttttttttttttttttttttggtatttttagtagagacagggtttcaccatgttagccaggatggtctcaatctcctgaccttgtaatccacccgccttggcctcccaaagtgctgggattacaggtgtgagccactgcgcccagcctgtgctttcacttctaagagaataagatctttccttcttctttttttttttttttttgagatagagtctcgctctgttgcccaggctggagtgcaacagcccgatctcagctcactgcaacctctgcctcccgggttgaagcgattctccctgcctcagcctcccaagtagctgggagtacaggcacctgccaccacgctcagctaattttttgtatttttagtagagatggggtttcgccatgttggccaggctggtctcgaactcctgacctcaagcaatccgcccacctcggcctcccaaggtgctggaattacaggcgtgagccaccgtgcctggctgatctttccttcttcttcccacctcattacattgttgaatgacttgaaaattttatgacaatgcccataactgaaacattatagtaatttgatttctgttatttttggaaagaggagaattgtctttcttggccttttagcctaaacttttttttttttttttttgagacagagtcttgctctgtcgcccaggctggagtgcagtggtgtgatcttgactcactgtaacctccacctcccaggttcaagcagttctccctgcctctgcctccggccaccacacccagctaatttttgtatttttgtattatttcaccatgttggccaggctggtcttgaactcctgacctcaggtgatctgcctgcctcagcttcccaaagtgctgggattacaggtatgagccacttcacccagcttttttttttttttctttcttgagacagggcctcactcttgtcacccagactgaagtacagtggcacaataatggctcactgcagccttaacttcatgggctcaagtgatcctcccacctcagcctcctgaatagctggggccgcaggcatatgccaccatgcctggctaatttttgtatttttggtagatatggagttttgccatgtttcctaggctggtcacaaactcctgagctcaagcaatcctttcacctcagccttccaaagtgctgggattacaggtgtgagccacctcgcccagccaggggcagggtgcaataactgaagctagattagaacatgggctgggtgttgatagtccgatatactgagcaagggcatatccataactgctcaaattcaagatgggtttgagtttatacctctttatccactttggcaggtgaaatttctccctctggttttcttcacagatgactttttaagcaacagcactatagagcaggccagcaagctagtaacagacaaatagaaacagacaaattgaagcactgggaagacttaggacttacttaccaagcctcatatgctgtctcagagagcctgtcagttaatagaaattaggaattattgatattagggatgcttaagtactaaacacatcctggtctacttatttattgtttttttaagacagagttgtgctctgttgcccaggctggagtgcagtggcacaatcatagctcactgcacccttgactcctaggctcaagtgatccttccacctcaacctcctgactagctgggaccacaggtgtgcaccacaaccatgcccagctaatttttaaattttttgtagagttggcatctcactatgttgcccaggctggtctcaaactcctggcctcaagtgatcctcctgccttagcctcccaaagtgctgggattacaggcatgagccaccatgcccaacccctggtctactttttattttaagttttcttttagagacagagtctcactctgtcacccaggctgcagtgtagtggtgtgatcataactcactgcagcctggaactcctggctcaagtgatccttctgcctcagcctcctgagtagctgggactacaggcacgtgtcaccatgcctggctaattttttcttttttttttttggtagagacaggggtcttgctatgttgcccaggttattcttgaattcctgggctcaaatgatcctcctgccttggcctcccaaagtgctgggattacaggtgtgagccaccaagcccggccttggtctacttttaaaaactgcaacatcactttcttcctttcctctaattactcataaatgacatagggcaaagaggcctttgagacagccaataaagatgaattataaaggaatactatggtggctagagatctgaagttgaataattttgagacttctgcagatcagacttgttctatgatacctatgttggatacaatataaaaacatgaattaatttttatttttttccttcttaagtcagctttccttcccttagttactcctctcctctttgtttccactgtggggaaaaaagaagtctataaattccttcttcagacttaaacccttctcagggatagctcctttggctcactacgttatttgagaaaatgcctgctcacagctaaaaatgaagtccgagattccaagatgggtgcttctgatagagaccagtggcctctgtagaagcagcctagacacagctttggttctaatcttgggttatctagaggaatccaaaaaaccttacctgtccgcagaacaagatacagatttctattaagccggccagaatctgacttttgagtaactaattctgtcgacagtttaaacgggtatttttcatgaccagtgattatatgctgacttaagcagccttcctcgttctgcattcagtttggtatgagctacagccctctcccagttccttaatgacttcaggatgttgaatcaaaattatgtttccaaacatcccaaccactttaccataaaaaccttggaaagtgtgttgaacacaactgatttatccaaagagcgtccaagtgttttctatctgaagtgtttccctcccactgttccttcctctctctcatatgcacaaatacacatattctcactctttctcccctgcctagttttgccccacaaaagctgaggcccggaggagtgctgcaaagattgcgctaatgaattctgtgtttaatgaacatccttcccgaagaatcactgatgagttcatcgagaagagtgtctctgaggccctggcatcttttaatgtaagttgtatggagctggaaggaaggagagtgggagatgggagaactggctgcttgggaagtcgtaaattactgtgaaacagagcatgaattcttgttttctttctggtccacctctctgttcttttgatttattctctgtcagtctattgtgtcatgtgctccacctgtcgcagtctctagttctgtatctgtgtttatgtgttttttgttgttttgtctctttcattgtgtctctttggtatctagaaacctttaattgcagatttatggaattgtagagctattccaaaatgaaaattgagcttcaattttgcttttgctaatttgggttaagaccttagtttctgcagttctttttttatgactgttttttattgtcacttgtctcctgcctccattacttcatcttattgataaagaagacttttataacaaaacgtctttttaggaacaaggaggataatttatttactctctttatttacaactgttctttcaaatgatgatgataagaataaccataattagccagacgcggtgtctcacgcctgtaatcccagcactttgggaggccgaggcgggcagatcacgaggttaggagatcgagaccatcctggctaacacggtgaaaccccgtctctacaaaaaataaaaaaaaaatagccgggcatggtggggggcgtctgtagtcccagctgcttgggaggctgaggcaggagaatggcttgaacccgggagacggagtttgtagtgagccgagattgcgccactgtactccagcctgggcgacagagtgagactccatctcaaaaaagaagaataaccataattaatcctaattgagtatttaccttgtggcagggactgttctaggggatttatatgcattttacctcatttgatcatcacaacaatcttatgaggtgtaagtactattattacccctattttacagatgaggagactaaaaacacagaagtggaatgttgcttaacatgatatagctagtaattggtcacgccaagattagaacccaagttgacttaatttaattacatcttagaaattaacaccgccatcttccttcctctccacaaattcattaatagtcagaccaagtatctgttctatttgcatttaattaagatgtaattacaggccaggtgcagtggctcatgcctgtaatcccagcactttgggaggctgaggcaggcggatcatctgaggccaggagtttgaaaccagcctggctaacatggcaaaaccccatctctactaaaaatacaaaagttagctgggcgcagtggtgggcgcctgtaatcccagctactcgggaggccgaggcaggagaattgcttgaacctgggaggcagaggttgcaatgagctgagattgtgccattgtactccagcctgggtaacagagcaagaatccgcctcaaaaaaaaaaaaaaaaagatgtaattacatatactaaattacttcagttatctgctttgtggattagttgttgaatactttattgaaagttggtttccctctgttatttaggacccagctgtttttctcccattattctttgccccagtcaacagcatctgcagggaatgaaaacatttttatattaatccaaaccaaataaaaaaagaaaaagccagctaaaattttttggaaagtacatttgctacttttaggtcgcctaatggtattataaaatgaaacagggcgaggcgcgatggctcacgcttgtaatctcagcacattgtggggtggatgccagcagatcacttgaggtcaggagttcgagaccagcctggccaacatggcaaaaccccatttctactaaaaatagaaaaattggccaggcacggtggctcatgcctgtaatcccagcactttcggaggccgaggtgggcagatcacgaggtcaagagatcaagaccatctggctgacatggtgaaactccgtctctactaaaaaaaaaaaaaaaattagccaggtgtggtggtgcgcgcctgtagtcccagctacttgggaggctgaggcaggagaatcacttgaacctggaaggcagaggttgcagtgagccgagatcacgccattgcactccagcctggtgacagagcgagactgtgtctcacaaaaaaaaaaaaaaaaagaaagaaaaggaaaaaaaaaaagaaataaaaaatacaaaaattagctgggcattgtggcacatgcctgtaatgccagctactcaggaggctgaagaatgagactcgcttgaacctgggagatggaggtgcagtgagctgagatcattccattgcacgccatcctgggcaacaaagtgacaccctgtctcaaaaaaaaaaaaaaatagaaaaggaaaggaaaaaaaaagaaactgtggattatggaaagtaggatgtgcagtatttatctgatcatgggctctaaattcattgttggcgcggtggctcacgcctgtaatcccagcactttaggaggcggagttgggcggattgcctaaggtcaggagttcaagaccagcctggccaacatggtgaaaccctgcctctactaaaaatataaaaattagctgggtgtggtggcgggcgcctgtaattccagctatttgggaggctgaggcaggagactcacttgaaccaggaggcggaggttgcagtgagccgagattgtgctattgcattccagcttgggtgacaagagcaaaattctgtctcaaaaaataaataactaaattcattgttattgaaattatggttctaggccaggtgtggtggctcacgcctgtaatcctagcactttgcggggctgaggcgggcagatcacttgagctcaggagttggagaccagcctgggcagcatggcgaaactccatctctacaaaaaacacaaacagttatctgggtatgggggcatgcatctgtagtcccagctacttgggggtctgagacaggagtatcacttgagtgaggaggtcaaggctgcagtgagccaagattgcactactgcactccagactcagtgacaaagtgagaccctgtctcaaaaaaaaaaaaaaaaaagaaaaagaaaaaagaaagcaattatggttcctggctgggcgctgaggttcatgcctgtaatcccagcactttggaaggctgaggtgagcagatcacctgaggtcaggagttcgagaccagactggccaatgtgttaaaaccccatctctactaaaaaatacaaaaattagccaggcatggtagtgcacacctgtagtcccagctacgtgggaggctgaggtaggaaaatcgcttgaacccaggaggtggaggttgcggtgaactgagatcgcaccactgcactccagcctgggcgacagagtaagacttcatctcaaaaaaaaaaaaaaaaaaattatggttccatagtcttcctttgggatctgtgtgggattggttctaggatctctcgaggacacctaaacccaaggatgctcaagtccttcatataaaatagcacagtacagcctgggcaacataaagagacttcatctctacaaaaaaataataaaataattagccgggtatggaggcacttgactgtgatcccagctacttgggaggctgaggcaagaggatcacttgatcctggggagattgaggctgcagtgaccatccactgtactctagccagggtgacagacagaatgagacacagtctcaaaaaaaaaaaaaaaagtacagtatttgcatataacctatgcacatcctcctgaataaatgctttaaatcatctctagagtacttataatacctaatacatgtaaatgctgggccaggcacagtggcttacgcctgtaatcccagcactttgggaggccaagacaggcagatcacctgaggtcaggggttcaggaccagcctggccaacatggtgaaaccccgtctccactaaaaataaaaaaattagccgggcgtgatggcgcatgcctatagtcctagctactctgcaggctgaggcaggagaatcacttgaacccaggaggcggaggttgcagtgagccgagatcgcaccactgcactccatcctgggcgacagagcaacagaatgagactccgtctcaaaaaaaaaaaaaggaaatttttatttttaatttaaaattttatttaattctcaaaacaatcatttaaggtagctctatgattattcccatcttacagaagaggaaactgaagaacagagaggttaagtgactttaccaaggccacgctatttgtaggagctccagtccatgctcttaacttctatgctgtattggtttttttacatgctaggcttgaatgcaggacagtgtgtcttaattctaaccctgcagggttacataaccaatagaagacacaataggccaatgtccaggagaccacactgctacccagaatttccacacttataccacatttcagaaagtcagtacaaaaatgtaaaatatttcattaataatgtttatactgactacagttgaaaaataatattttgaacatattgggttaaataagatatattattaaaattaattttacttgtttttttttttttctgagacagagtctcactctgttgtccgggctggagtgcagtagcccgatctctgcaatctccgcctcccaggttgaagtgattctcctgcctcagcctcctgagtagctgggatttacaggcacccactaccatgcccggctaatttttgtatttttagtagagacacggtttcaccatgttggccaggctggtctcaaactcctgacctcaagtgatctgcccaccttggcctcccacagtgctgggattacaggcatgagccactgcacctggacttacctctttatttttactttaatgtggcagagaggaaattttgaattaaatatgtggcttgcattatatttctactggacagtgctgcttgagatgataatcctggttgaaaatctatttgtcttttctgttcctctactaccagggcaacagggaggaagctgacaacccaaatacagggattggtgccttccgattcatgctggaatccaacaagggcaaatcaatgttggagttccaggtactttcccatgtacttccctggttctaataacatgggtcagcctgctactgtaatatataatggctcctactaattcctaactcattgatactggaaaagaaagaaggttgttacactatttttcaaaaataaataccttcctggctgggcatggtggctcaggcctgtaatcccagcactttgggaggctgaggcgggtggatcacttgaggccaggagtttgagacatggcaaagccccgtttctactaaaaatacaaaaattagctatgatggcacatgcctgtaatcccagctacttgggaggctgaagcacgagaattgcttgaacccaggaagcagaggttgcagtgagctgagattgcgccactacactccagcctgggtgacagagcaagactctgtctcaaataagtaagtaagtaagtaaataaataaataaataaataaataaataaataaataaatatttttcttccccaaaggcctatcagagttagtgatgagagatgcttctacaaatccattttgtaaaaggtttcccatgtaattctgatgcaacctcccaatataaaaatcactgtcctggtacttcctatcctcttcccccaggagctaatgacagtttttcaactgctacactggaatggcagccttaaggccatgagggaacgacaatgctctcggcaggtaagagattttatgagtgggggcgaatgaggggagcacaatctgtcagtggactcttttgaggtggttactatgttagaaataaggtctattgtgacctatggttgtgaatattgaaagccttacctaagtaccctcttcattcctataatctttcctgtgtaaatattagctgtgattcttttgtctatcttgcttcccgtagcaggaagtgcctttaagaatctccttgaagaacttaggtgctgacctcagttaggtctctaaagctgagttcttagtcccagttgggtcagtgtggtatgatatgaacctttaccttctcaatgatgttcacattcccctcccctactaggaggtgttggctcattattcgcaccgggccctggatgatgatattcgccaccaaatggccttggactgggtgagccgggagcagagtgtgccgggggcactgtctagagagctggcctctactgagcgggagctggatgaagcccgactggcaggcaaggagctgcgcttccacaaggagaagaaagatattcttgtgctggctgctgggcagttgggcaatatgcattcttccaactgctaggcatccacccacataactccccaggctttccacagcctttttttatgtctcctttctaagatttaggatgattttttgtacatactttctcatttttatactttaaaaaatatatatgtgtataaattctacacctagattcctatttgctaagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactctagtgttcatgtgtccttcttttcaaatatcaggtaacttgaataaggattatgtgccccacccttactctcattcctgcttcctcttggactcaaacagggtatgagtatgaagattttgcctttagttcctgaactgaacctgcttgctatccctttcctccccaccactaccttattccttctctgcctccaaattgccactttgttttgaggcttccttccctaccttattattctgaaggaagtagagatcttgcttctgaaacccctcctaagaaactgcccagggacaagataaattacaaacaattcatgggagtttactacctaagttgcttctagggcatatgtataccatactagtagtctagatttctggatatactctacagtagatgggggttatggttgaaactgattctctttcagtattccctctaaacatctcccctactcccccagcttagttaaaccctgcgtttggaccttcctgcctgcagctattagtagaaagtaaaacatatttccatatttcccttcacctaacattttattttttggaagcgttatcagtcctatttggttagtgagaaccatgttccccttattcccgctaagttgctgctgtttactaccttagattctcatttgttttctctttctttcctctccttccacattaattattagaacataagttgatcaggaaaattaaatgagactttagtattttggcacttcctaattgacaccttgggagactgcaggaagggaaagagaatcaatgatcagttatttgtgtgtgtgtgtggtttttttttttttttggaagacagagtctcacacttttgcccaggctggagtgcagtggcgtgatctcggctcactgcaacctctgcctccagggttcaagcgattctcttgcctcagcttcccgagtagctgggattacaggcacacgccacaacgcctggctaatttttatatttttagtagagacagggtttcaccatgttggccaggctgttcttgaactcctgacataaggtaatccacccgcctcagcctcccaaagtgctgggattacaggcgtgaggcactgagcctggcctatttgtggtttttttttggttttgtttttgtttttgtttttgagacggagtcttgctctgtcgcccaggctagagtgcagtggcgcgatctcggctcactgcaacctccgcctcccagattcacaccattctcctgcctcagcctcccgagtagctgggattacaggtgcccaccaccacgcccagctaattttttgtatttttagtagagacggggtttcaccatgttagccaggacggtctccatctcctgacctcgtgatccacctgcctcggcctcccaaactatttgtgtgtttttctttttttttttttttgagacggagtctcgctctgtcgcccaggctggagtgcagtggcgctatctcggctcactgcaagctccgcctcccgggttcacgccactctcctgcctcagcctccttagtagctgggactacaggcgcccgccaccatgcctggctaatttttttgtatttttagtagagacggggtttcaccgtgtttgacaggatggtctcgatttcctgacttcgtgatccgcccgcctcggcctcccaaagtgctgggattacaggcgtgagccaccgcgcccggcactatttgtgtttttaacaccattctcccccacttctctcctgggtgacataagagagaaataacctgtagtacagcagctaaagtattctcctttcagagaatttttttggaggtctcatatatatttcccccttgtctctgtgatctcttatttatactatattattgtcccatgtactttctaaactgagcttggaacatttagtattcctgcaattggacttcccacttaacaattatacagactttgcttttagaaatagattaggttccaaacagaaagttcaagtgtaacaacaacaataaaaatagattatgaaacaggctataattggctcttttggatttgataggggcaagatgaaaggcaactttcttgcttttgaaatcatgttgggtaagaggtaaggaatccagctacaattttattagtgcttgaaacgggcttccttgaattctccaggccctatcattttttttttcttactaatcagaagagagctggggtagaagccccatgtttgtattccatgaaacacgtcgggttggagtaaaggcaaaaacagctagacacaccaggtgtgtctgtttgacatttataagctggcactcatcaacactcctgtttctcctttctctgggacgtgtggattaaggggtgtgagttgtgggaagaattgccctcgtacctcctggatttattatttttctcaaataccaaccagtaagatcccaaataacttgagaaaaattgtttcctgatctgtccacttctggtgtcaaagattttactcatcttcttagtacattctatgtattttatatgtataattttatacaattaaaaatagatttttgtctagtgagccagactgactctttcttgagacctatatattacaaaagtgaaggggtgggttgcccctccacacctgtgggcgtttctcgttaggtggaacaagagacacagagacaaagtatagagaaagaaaactgggcccagctgaccagcgttcagtatacggaggatccacgccagcctctgagttcccttagtatttattgatcattattgggcgtttcccggagagggggatgtggcaggatcataggataatagtggagagaaggtcagcaggtaaacacgtgaacaaaggtctctgcatcataaacaaggtaaagaattaagtgctgtgctttggatatgtatacacataaacatctcaatgccttaaagagcagtattgctgcccgcatgtcccacctccagccctaaggtggctttcccctatctcagtagatggaatatacaatcaggttttacaccgagacattccattgcccagggacgagcaggagacagatgccttcctcttgtctcaaccgcaaggaggtgttacttcctcttttactaatcctcctcagcacagaccctttacgggtgtcgggctgggggacggtcaggtctttcccttcccacgaggccatatctcaggctatcacatggggagaaaccttggacaatacctggctttcctaggcagagatccctgcggccttcctcagtggtttgtgtctctgggtacttgagattaggaagtggtttgagattagggagtggtgatgactcttaacaagcatgctaccttcaagcatttgtttaacaaagcacaccctgcacagcccttaatccatttaaccctgagttgacacagcacgtgtttcagggagcacagggttgggggtagtgttacagattaacagcatctcaatgcagaagaatttttcttagtacagaacaaaatggagcctcctatgtctacttctttctacacagacacagtaacaatctggtctccctttcttttccccacaagaagctctaaaacatccctgttcttttacatatatactaaagaagaatttttaggccaggtgcggtggctcatgcctgtaatcccagcactttgggaggccgaggcgggtggatcacgaggtcaggagttcgagaccagcctggccaccatggtgaaacccccatctctactaaaaaaaattaaaaattagctgggcatggtggtgggcgcctgtaatcccagctacttgggaggctgaggcaggagaattacctgaacccaggaggtggaggttgcagtgagccgagactgagtgattgcactccagcctggacatcagggtgagactctatctcaaaaaaaaaaaaaattttattagcatttttggggtggtagaaatgattgcataaggcagcctgcctccctttctgcagatatttaacctggagtttgtccttggtcttttctcctcaagctctacctactcccactggcaatctcacccattatggtgacttgaactccactatacacatgactctcaaatctatttcttcctccccaacctgttttaagcttttacatttactttccacatacttgacacggccatctgaatatgacaaaagcactttgaaacatatcgaaaataaaaaacatttctccatactcattcctctttgactctctagattattcgaattattattattcttattattattatttttgagacgaagtcttgctcttgtcccccaggctggagtgaaatggcgcgatctcggctcactgcaacctctgcctcctgggttcaagcgattctcctgcctcagccttctgagtagctgggattataggcgcccgccaccacgcccagctaatttttgtatttttagtaaagatggagtttcaccatgttggccaggctggtctcgaactcctgacctcaggtgatccacctgcctgggcctcccaaagtgctgggattacaggcgtaagccaccatgccccgccgatctattattagaattattatctacactgttacctaagccacacacctcagatccaccctcaactcctctaccataatgtaaatatgttgtttttgagacagagttttgctcttgttgcccaggctggagtacaatggtgcagtatcagctcactgcatccactgcctcttgggttcaggagattctcctgcctcagcctcccaagtagctgggattacaggcacccactaccacacgtggcaaatttttttatttttaatagagatggggttttaccatgttggccaggctggtctcgaactcccgacctcaggtgatccgcccgcctcaacctcccaaagtgctgggattacaggtgtgagccactgcgcctggcctacctcctaatatgttttgtccatatttactgcctgagcttaggtttggtcctttctcatctccagactggatcactacaatagcttcctagctggtcttcacctccattcttaacatcctccatactactgtcatatttctttataaaatacttatgactgtgacactcccttgcttaagccatcactgaactatctttacctttagcagcatttcccaaagtttttttttattttttttgagacagggtctcactctaatgagcaggccagaatgcagtggcgtgattttggctcactgcagcctccacctcccaggctcaaggaatcctcccacctcaacctccagagtagctaggtctataggcacacaccaccacacccaagtaattctttttaaattttttgtagaggtggatcttgctgtgttgcccaggctggtattgaactcctgaactcaaactatccacctgcctcggcctcccaaagtgctgggtttacaagcatgagctaccatgcctggcctaccatttcccagttttatatgtgttcctgagatgattttagatgatagatgggcaaacagtttttaatagttgtgcttttatctgaattcgtagtagaaaaatactgattttcctttcagtgtaaatttatgtttaaagtcagtctatttaaggaaaaataataagcaacaactagtatggaggctattttcaaatattaaaaaccatgaatactcaaatatttgaagtaggtaaatttcttgcctataggataaattccaaaatccttagcacagcagaccctaaactgtatttccagctttattttccagtcacatagcatcgggcagacagaatttcctgccattctaatattcattcattcgataagtatctaccaaatgtctaccatgagccagacattgggctaaacttcagggattttagttgtaaataactatctctgctataaggattacattctaacgggaaaaacagacaataaacaagttagaaagtaaacaaggtaattaaagattctgactggcctaagcaacatggcaagactccgtctctacaaaagattttttaaaaattagccgtgtgcagtggcgtgtgcctgtagtcccagatattcgggaggctgaggcaagagaatcacttgggcctgggaggttggctgctgtgagccataattgcaccactgcactcagcctggttgacagagtgagaccttgtcttaaaaaaaaaaaaagaatgaaagaagattctgatttaagttctgtgaaggaaatacacagttaaagacaggagggtagagaagacccctttgggtgacagtactattgagatcttaaaaatgaggtcgaactcggccgggcgcggtggctcacgcctgtaatcccagcactttgggaggccgaggtgggtggatcacaaggtacggagttcaagactagcctggccaatatgctgaaaccccgtctctactaaaaaaattttaaaaagctgggcgtggtggcacgtgcctgtagtcccagctactccggaggctgaggcagaggaatcgcttgaacccagtaagtggaggttacagtgggccgagatcgtgccactgcactccagcctgggtgacagagcgatactccatctcaaaaaaaaaaaaaaaaaaaaaaaaatgaggtcgaacccaatatgtgaaaagctagaggaagagcaccaggaacagaaagctgcggggagcagtggctcatgcctgtaatccaaacactttgggaggccgagaagggcggatgaccggaagtcaggagttagaaaccagcctggccaacatggcgaaaccccgtctccactaaaaatacaaaaattagctaggtgtggtgccgcacgcctgtagtcccagctaatcgggaggctggcgcaggagaagccttgaacccaggagacagaggttgcagtgagccaagatcgcatcactgcactccagcctgagtgacagagtgagactccgtctcaaaaacaaaacaaaccaagttgcaaaagccctgggatgagaaagagcacaccacagttgggcgaaagagcaaggagagcttcatgggttaaggagaagaacggtggttgaacaggttgaaaacacaggcagagcaggctttgtgagtttgaatttttattctaagtgcagcaaaatgccaaggaaagagccgggtgcatggttacacccctgtcgtcccagatgcttgggaggcgagtttcaggccagcctgggtagtataaccaaacccctctaacaaaaagggtttttaggccgggcgcagtggctcacgcctgtaatcccagcactttgggaggtggaggctggtggatcacttgaggtcaggagttcaagaccagcctggccaacatggtgaaatcccgtctctactaaaaatacaaaaattagccgggtgtgtgtgtgtgtgtgggggggggcgcctgtagtcccaggtactcaggaggcttggagggcgcctgtagtcccaggtactcaggaggcttgaggcaggagaattgcttgaacccgggaggcagaggatgcagtgagccgagactgcaccactgcactcttagcctgggtgatagagcgagactacgtctcaaaacaacaacaacaaggatttttagtaggtatgtaaccaactgatttttaaaatgatcacagtacctactgtggagaatgaattagtgtctcctaatcgctttttaaattttatttttcgttttactcttattcactttttttttttttttttgagacagagtctcgctcttgtcccccagactggagtgcagtggcaagatctcggctcgctgcaacctccgtctcccgggttcaactgattctcctgcctcagcctcctaggtagctgggattacaggtgcactccaccacgcccagctaatcagcttccgtttctcgggttcaagcgattctcctgcctcagcctccctagtagctgggattacaggcagggagttttatatttaaaaaaaaaattgatatctgtctcaccaaccgtattgcaaccaagtctgttagtttcctgaagagaaatttggtgctgcaggttccagaagcagctctttatgccctcactgctgatcaaactattttttaaaaacgctcctatcatacaccacgctgcctaaagacaaggtacaggcctgggatttttgaaagaaaagggtttcttcaattaccatttcccagtttgggatgaagagacgtaaagaagccctctaataaggaaattacgccgggcctcactgttaatagtacagtatttatcagcagctgccgcggttaagaggaagccacggccccctgtagtctgtacctcctaagatggatgatttagcttgcgatctgttcaagatggccacagaaacacttccggtatctttccgcactaggcccgccccaatttgcgtgtttttaccgtgcagagggagggatttagagttagcctttgattggtcagcttgactggcgacctttcccctctgcgacagtttcccgaggtacctagtgtctgagcggcacagacgagatctcgatcgaaggcgagatggcggacgtgctagatcttcacgaggctgggggcgaagatttcgccatggatgaggatggggacggtgaggacagtggagacggctggtgggaagcggggaaggtgcgagagaaggctataataggaaaatttactcttttttcctcggtcgtaaggatgggaatcgaggaaccgggtcttgggtggattagagattccgcccccttcaggagaagggagggcgtgaccgggaaggcactaagactggaggcggtgtgggtcggcttgctggtagtgtattgggaaagagacgattgttacaaatgactgtcatagttacttattcttttatcttctggggttccagagagcattcacaaactgaaagaaaaagcgaagaaacggaagggtcgcggctttggctccggtgagtgtggggaaaatggggtagagtggcctagtagggcaggagctacgggttttggagtccccacccacctcataggaacaatgggagaaaggaggagttttcggtgatctcgtgtatgtcccttatagaagaggggtcccgagcgcggatgcgtgaggattatgacagcgtggagcaggatggcgatgaacccggaccacaacgctgtgagtaataatggaacctgtgaggtatccgtgtctgtggtagtagttagaaaccaataaaatagttaaacgcagtaggaatgggttcagagatagcttaaacaatctgagtccgcactcactctattcctgtgagcctgcttaaagtgtctctcatgtactcatacaacttccccccgtcccccaacagctgttgaaggctggattctctttgtaactggagtccatgaggaagccaccgaagaagacatacacgacaaattcgcagaatatggggaaattaaaaacattcatctcaacctcgacaggcgaacaggatatctgaaggtatcctaagtgacactttattgcctcctttctttcataagccttaggtagcattcgtagttctgtgtttgctgtggttggccaagagcaaagttgaaataaaatgacattggaaatctatgttttgtcagacacgccaaagagacagaaacggagatgatgtatatatacagtagagatatatgatgtacattcattgtttaaagtgtgtagatttttctgagtttagatttgaggaaaaagatactcagtgatacttggggaaataggagggttttcatatctgtcttttcactttccccaggggtatactctagttgaatatgaaacatacaaggaagcccaggctgctatggagggactcaatggccaggatttgatgggacagcccatcagcgttgactggtgttttgttcggggtccaccaaaaggcaagaggaggtaaaatgaagagggcaaatactgtctgggtgaagggaatacgaacgaaacagaatgaggacttagtattatgtccctctaatggactcctctccctgcttctttttccctagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcacctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgctattgggctgcccctccccctttttgttaaattgctgggttttccaactgaatcagtaaaaactatttctgtttagagctacaaggttaaagtgcctgctttccagtaatggagattgagtcactattaatttgataaaaggtaagctcagtaggcatcagattcctagatacaaggcatttgggaaagtgattttagcagacatgagggacatttaggaaagatgaatagtttcagcctaagagaattttgtgaactgtttggagttacgatcaggctactctgagctagttgggaaatggtctttcctcttcccatctcttgcattcatatatttctaagttttttttttttttttgtttttgtgctctgcctaagaagtgcttgagaattgtgaggagtataaaaatagtcaaagctggctgggcgcggtggctcacgcctgtaatcccagcactttgggaggctgaggcgggcggatcacgaggttaggagatggagaccatcctggctaacacagtgaaaccctgtctgtactaaagatacaaaaaactagccgggcgtggtggtaggtgcctgtagtcccagctacttgggaactcgggaggctgaggcaggagaatgacctgaacccaggaggcggagcttgcagtgagcagagattgcgccattgcactccagcctgggcgacagagtaagactgtctccaaaaaaaaaaaaaataataatcaaagctcttggatttatagtttggtccacagccttgttttgatctttcctttatcctgttttattgccatttaccacgtactgtagaaacatccctttcaactgctgataacttggaaacaagcctacaaaaataagtaatttctaactactcctaatactacctataactacccctaagcccttaccactctaacgtgacattattaaattttttattttattaacactaatattttaactacaattacagcatatgggcaatacagaatttacctaaaaggatactaatttggaacaaaaaaaatcacctttcgcacatgtatcatgtcacaaccagtttgccattgaaacaaatagaggttgcaaatattgtcagattgtcaggctgtaagaaaggatgaaattcatttcccattgcatcatcttgtggcccatggatttcaagtgccttagccaaaatcatatagctagttagcagtagagccgagactcagaaaaaaacaaagtaaaacaggcagactgaaacaaaaagtcttctaattcccagtccacatgtaaaatttgcttcatataaacaaacctaattgtaaatggcactgtagcaacaggcttctttttaacacttggattggtaaaggtcttgtttgcaacatattagaagtattatttttctctttcccccccaccccacccccaacagagtctggctctgccgcccacgccggagtgcagtggtgcagtcttggctcactgcagcctccacttcccaggttcaagcaattctcgtgcctcagcctcctgagtagttgggattacaggtgctcaccactatacccggctaatttttgtatttttagtagagatggggtttcgtcatgttggccaggttggtcttaaactcctgacctcaagtgatccacccaccttggccttccaaaatgctgggattacaggcttgagccaccaggcctttctttgttcttaggagtatagtcagactaacttctagtagttatatttctaataattgaggatgtaagtaaggatcaaatcttaaatcagtataatgcattgtcattccagagataaatcctagacccttcttggcctccttctgacataattctaatcctacagtctcagagatgctgttgtatcctgccccccaaccccatgatagtgatagtggtttttgccttgaaggaattgctttgtatttagcttttccccctctagatttctagttccttttcagtattggattggatttgagatttgattaacctagtactcaggttcagatgctcgcctctttgcaattttaacactcattcgacaataaagtcagtaaaaaacacaaatttggttatgtcactctctttttactttagtgtctctccactgcactcagaataaagtacaattttattatttgtgatctggcttgctcttcccctctcagttcattactcaccattttctagtcctcagctttagtagcattgagatcctctatcctccatcctccctagcatttctcctattttaattggtctaacacctatctctgaagaatcaaattttaacatctggaaagcttttcctgactgcacggctgtgtcagacacccctatccactccccacccccattgtcttctttagctcctttagcataacacttttgaatacactatattgtaattgcctaatttctttgtttcttgcagtagtctatacatttcttgaaggcaggattttgctgccctgtccttagcaaaatttgagtggcgctggagatgcatattactttttgaatggataaatgaaatgtaccacaaagttttacccaaaccactgacttcactctcttaatagatccccatgtatgtttttcttccctgccccaatctgaaggaggtgaaattgggaggatgcaaagaggtagaaaccacgtgtaataaaacagatgtaatggaagaggcacagatagaggatactgtttttacaaggcaggctcttttattattattattattatactttaagttttagggtacatgtgcacaatgtgcaggttagttacatatgtatacctgtgccgtgctggtgtgctgcacccattaactcgtcatttagcattaggtatatctcctaatgctatccctcccccctccccccaccccccaacagtccccagagtgtgatgttccccttcctgtgtccatgtgttctcattgttcaattcccatctatgagtgagaacatgcggtgtttggttttttgtccttgcaatagtttactgagaatgatgatttccaatttcatccatgtccctacaaaggacatgaactcatcattttttacggctgcatagtattccatggtgtatatgtgccacattttcttaatccagtctatcattattagacatttgggttggttccaagtctttgctgttgtgaatagtgccgcaataaacatgtgtgcatgtgtctttatagcagcatgatttatagtcctttgggtatatacccagtaatgggatggctgggtcaaatggtatttctagttctagatccctgaggaatcgaaaaggcaggctcttaacagatgtaaattaacatacaaataatcttacagaagagagagcagaggtagcagggtgcggtggctcacgcctgtaatctcagcactttgggaggctgagacaggtggatcatgaggtcaagagatggagaccacctggccaacatggtgaaacctcgcctctactaaaaatacaaaaattagccgggcatggtagcgggcgcctgtagcttctcgggaggctgagggaggagaattgcttgaacccgggaggcggaggttgcagtgagccggcaaaaaaaaaaaaaagcaagcagaggcttactccctgagaattaatggctaatggcccccaagcgcaccctttaactcatgctatggacccaaatccctgtcctgcccggtcctgagtcctaggtcactcacctgggggaaggcaagcaggaaactaagtccccaggctgcccccagaagtttccttacacctgaacgggatccaagcgggttgagtactgctgcctggcggtccaatccaatgaccacaggcaggaaagctgcagaatacgtggccattagtttcaggaacatcagtgtccgacatgcgatgtccacagccagccattgaacagtgatattccaggtggcatctaggggcataaccacaaaagtgactagtaagtcggcggctgctaaatggatgaagagtctcctgaccggagaggggcggagctggctgggttcccgccgtgtcactgaccacaggactgccaggttccctccagccgaagaaacaaacagcacaatggtcactcccactcggaccttggctgctgccgagaaggtgggcagctctgagccctccacctccactcctgatccagcccagacctcctcccccgctgctgaccccaaggggtgccgttgcctgcagacatggtggcctggagagaaactgaggaggatgaagtgtgggtatgaagcggttagctttggccactgattcttcgccctccttttcaggatctggagctgattattgcgaatttcgttcactaaagcctctgcttctggagactctccatctgttctggaggaggtcacttgttcaactgtcaaggttctgcagggaacgaagatctggtaccaatcacgctcctttttccttggacagaccagcctgggcttcaggcctctactgacctagacctctttagcccctacagccctggattcagtcggggcctgcgtgcatgtgtatttgtgaggttctgccaggcgcacacctatgccggcggcctccaagacgtggagatcactgcggcgctttctcgccccgccccggcccctgcaggccccgcccttggtcatgaatatttaaagaagaaggtgccgctggaggcgtgctagggagtaggggtcgtctgataaggggaagctgtgacgcagacacgcacagtaatacacagatggaggctcaaaagacacgagtttcgcgtcctgaaattccgcttccagggccaagctttcttttctgatactgtttgtccctcgcgaggcaccgttgggtcgcgcagtaggcgtgactaggggcgggaagtggggcgggagcagggccgcggagcctgggctgcggctgtcatggacgcctgggtccgcttcagtgctcagagccaagcccgggagcggctgtgtaggtgcggcccgaataggaatgggggtggggcgggggagggatggacagaggaagactctagtgaggcgaagtcagtttaggctacaggggggtcaagaagggtcaactccggctacgggggcccgaacggaccgtgaggcgcagatttgagccgctgttgagatgattcctttccgttcgcggaagagatggggaaactgaggcatgagtgggccagcggggaggccgctcagggttgctgtgtccacataagaccgacagtgtcctcactgggcggtgatggaatgaggagcattcgccccacggtggatagccccagactctgcccccagagctgaggaggcactcccagtttccgtgtccccacaccgtgctgccattcgggaactcccctgcctccgccctggcgtttggtctccattcagctagagggccttgaaatctctcagttcacctattctgaggaataaaatgccctccaactgtctgcctccccctcatcgatcacgtacatgctcacgctgatgtgcttgtgatggacccctgcggcctgcactggccccttcaggcctcatcattgtcaaatctctaatttgctcaacattcagtagtgctccccacccctttctagactcttttttctccttatgcctttcccttcctctggcctggagaaatggtgagatatgggcatggaggaggaaggggagtgttctcaaactgggaaagggggaagtctgtctgtgccttttggaagatagttttgagcggaaggttagggaggtctccaccttaccttgcctgccctctcctctagggccgcccagtatgcttgctctcttcttggccatgcgctgcagaggcatggagccagtcctgagttacagaaacagattcgacaactggagagccacctgagccttggaagaaagcgtaagtaactctgtctttccttttatcccccaacctttcctccatccccagctcaccttcctttgtccctccttcctgtaccctctctgttcttctttctcatttggctctgcacttaccctctgcatgagtccagttgagataagagagcaggggtatggaagtaattaggcggactggagagaatgggtcaagtttgagaaaactaaactggcacaaaaattaaatttgaaattgaaaaatggactgtttctgctctttattttttatttttttgagacagagtctctcgtccaggtcagagtgcagtggcgcaatcttggctcactgcaacctctgcctcccaggttcaagcaattctcctgtctcagcctcctgagcagctgggactacaggtgcccaccaccatgccgggctaatttttgtatttttagtagagatggggttacaccatgttggccaggctggtctcaaactcgtgacctcaggtgatccacccacctcggcctcccaaaatgttgggattacaggcttgagccaccatgcccagcctgtttctgctctttaaaaaaattgtcattattattgctcaacttttgccctcttgctttctctgtttctgtttcttgttatctgcctctccacttacaaatccttgctttccctttctaatctccacaagttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtttgatatcctgttctcctttaagatttttttttgtagcctctatattgcatagcttgtcttatatgagggaaagatatcttaggatctttccagagtatataagtcttgatcagtcacttggcttccaatcacttagatcttaaactatcggagaatatcaaatggggagagatggaagacagatgctcttccataatgaatgactaatattgtgcaaggtaagatattatatcactttaattgtgcttctataccacaggttattccccctcactacctgcttactcattcattccaaagatatttattagatgcttactgtggcgcaggggataaagcaaagagctaaacagataatgtgcctgctcccatgaagcttctagtttagtgagggagttagatactacaatgaataacttctcatatatatttgtggaaaagtatgcggtattatgaaagaatatcacaaggggagctaatttagattggaaaatcaggaaaaaactctttgagaaagtaatattttagctcagacctgatgtctgagtaggaggagttagacaaagccaacagtagcagaaaagacatttccaaacagagaaaattgcacattctaagtaaggctttgaactaagaaagacttaagggaattagagaaatagaaagaaagccagtgtgattgacagtattgagtccatcagttcaaatttgagagatagacaggcaccagatctttcatacagggccttttaggcaatgttaatgtttgttttattttatcctacaatgggacattattgaaggattctgagcagggaaatgacatgattcaaattgtgtttaaaggacatctctttttgagatgttgaaaatggattgcaggccgggcgcagtggctcacgcctgtaatcccagcactttgggaggccgaggttggggggatcacgaggtcaggacttcaagaccagcctggccaacgtggcaaaaccccgtctctactaaaattacaaaaattagccaggtgtggtggcgggcacctgtaatcccagctactcgggaggctgaggcaggagactcgcttgaacccgggaggcaaaggttgcagtgagccgagatcgtgctattgcactccagcctaggtgacaagagcaagactccatctcaaaaaaaaaaaaaaaagaaaagaaaagaaaagaaaatggattgcagtgggtcaagagaggaggagatgccctaatacgagcaagagatgacgttggcttggacaaaggaggtagctgacaataaaggtagagagaaatatgatgtgggagtaaaattctctaacatattatctgtattgtttttcgttttcctatgattgtactttttcattatattaaccttgcttttcccttcatctttctcagtgatttacaactttaacatggcttatgatgtatgaggggtgggagcagaggcatggctggagcagtatggaaaagcaactccctaaaggagtctatatgttatatttattcatttcatccaacagatacttactgagctcttactatatggtaggcaccagtgtacatacagggatacagtggttaaagataaacaaggccggccaggtgcggtggctcatgcctgtaatcccagcactttgggaggccaaggcgggcggatcacctgaggtcaggagttttgagaccagcctgaccggcatggagaaaccccgtctctactaaaaatacaaaattagccgggtgtggtggcgcatgcctgtaatcccagctactcgggaggttgaggcaggagaatcgcttgaacccgggaggcagagtttgtggtgagccgagatcgtgccattgtactctagcctgggcaacaacagtgaaataccgtctcaaaaaaaaagaaaagacaaacaaggcctctgctcctctggaacttaccttgtaatgggatgagataaacataaataaacaataaattaaaatatcagatactggtaaatgttatgcaggaaattaaaacagtgttatggagtagagagtaactgactcagtgctttagatttagggataagggaaggcgtctccgaagaggtgatacttaagctcatacctgaagagcaagaaagagctagctatgtgagggttttggagggagaatattccaggtggagggagaatattccaggtagagggaataggtagtgcaaaggtcctaaggcaagaacaagcttgatgggattaaaatgtagaaggaaaccaacatggttggagcataatgattgcaggaaagaatgatacaaggtaaagttagaggggtagggaccagatgttgagtctgtaagcctctctaaggtatttatattttattatgaatgtgacaggaagaaaaccatggagagctgtggtttgtttatttgtttttggttttttttttttttgagatggagtcttgctctgtcgcccaggctggagcgcaatggtgcaatctcagctcactgcaacgtccatctcttgggttcaagtgattctgctgcctcagcctcctgagtagctgggattacaggcacgcgccaccacacccagctaatttttgtatttttagtagagacagggtttcaccacgttggtcaggctagtctccaactcctgacctcatgatccacttgcctccacctcccgaagtgctgggattataggcgtgagccaccacgcctggccaaccatggagagttttaagaagggaagtaatgatgtgatttatgtttatgctagctattatatgaaaatagattgttgggggtgggggcaacaatggccacagtgagaccagttaaaacattaaagcagaagtccagacaagagatgttagtggcttagagtatggcagtgcggtgtgatagagagatgtggttggttgggttcaggatatactttgaaggtagtacaagttattgagtacagaccaccattgtcagattggattacaaataaaaaacatggattttttactgaagaaatttataatttaacacatttggcaattacttaaacctctgggcctctaaaggaatagggattggatttagatcacctttaatatgtttgagtctctgagacatctgaaatttgttctttcaaaacaagtttgccttgttataggtcaagttgagagagagatggagagtgtgtgtgtgtgtgtgtgtgtgtgtgtgtgtgttgccaagtggaaaatgaaatttgagattgaccttggaagatttcatgatgctcatggagtttaaaccaggatcttaaggtgcacataaacatgtattagttacagaatgttgggaggactttgtttcttcatttttattgggacataattgacaaatagaaattacatatatttaaggagttatagctcgatgtttgtacatgtacgttgtgacatgatcaccacagtcaagctaattaacatatccatcacctcacataattaccttttttcttttatggtaagaacacttaagatctaccttcctggcagatttcaaatatacaatacagtattgttaactatagtcacaatgtagtacattagatctccagaacttactcatcttgcataactgaaacttatacgctttgaccagtatcttcccatttccctcactccccaacccctggcaacccccattctattctgtgcccctatgagttagccttttttttttttttttgagacagagtcttgctttgttgcccaggccggagtgcagtggtgagatctctgcaacctctgcttcctgggttcaagcaattctcatgcctcagcctcccaagtagctgggattacaggtgctggccaccacaactggccaatttttgtatttttagtagggacggggtttcaccatgttggccaggctggtcttaaactcctgacctcaggtgatccacctgccttggcctcccaaagtgctgggattacaggcatgagccaccacgcccggccttattttagcttccacctataagtgagattatgcagtatttgtctttctgtgtctggcttattttgcttagcatagtgtcctcgatggaggacatttctaataggggtaatagcattcactttacttctgatctaatgtgtaatctctttgctacaggaaaagaaaatgttaaaatgtgatgttggatatgttaagtaggtatacatgcccttactgacccttttgctctgtgtatcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgacatttggtctggtccctcattttttggtaatttgaggcccctattcctgtcactgtggtttgggtttttctcgggattagccactaacatcacccacattatttttcttgagcacctacagtatgtaaagcaacatacttagtgggcatccaaaaatctaagaagctccacactcccaactttaagaagtttataacctagctgaggagttggggtggcagaggagtggtctaatactaaagttattgtcctggctccacaaagcacatctcataccagttcagatataatccctctaagaagcagaatgccatatgacagcataggctaagagccaaggacagaaccaagtggagtggggctggtaaggatttggagctgtgtcttcacaagttgagactcccctgggtgggtagggaaatgataccactgctatcagctctttcattttccatattccaggttgagataaataaggttaggaagtgaatctatcggccaggcgtggtggctcacgccggtaatcccagcactttgggaggccgaggcaggtggatctcttaaggtcaggagttcaagaccagcctggccaacatggtgaaaccctgcctctactaaaaataaaaaattagccaggcatggtggcatgtgcctgtagtcccagctacctgggaggctgaggcatgagaaatgcttgaacgtgggagacagaggttgcagtgagccaagattgtgccactgcactccagcctgggtgacagagtgagactctgccttaaaaaagaaaaaaaaaaatctgaatctatctcctatctcccagctgggtgcagtggctcactttgggaggctgaggtgggaggattccttgagttcaggagttcaagaccagcctgggtaacatagtgaaaccctgtctgtattctcaatataaataatttgtctaaaacttttaaacaaaagtttaagattcttttcttataaaaaagaatccatctcccactcctgttccaaatttgaggaaagcattattgacctggcaacaataaacagtagaaaaaaagaaatagcagaaatgggcaaaaaaatatgttctctggatatagagatgaggcctccagggggcagcaccaaggcagagaaatagactaagatcgctcagtgttttccttggtctggggctccccacagttccccaccatcactcctcccattccttccaactttatttttagctgccattgggagggggcaggatgggagggaaagtgaagaaaacagaaaaggagagggacagaggccagaggacttctcatactggacagaaaccgatcaggcatggaactccccttcgtcactcacctgttcttgcccctggtgttcctgacaggtgagggaagttaacttcttggtttctggtggggatggaagatacatagattgtttggaattgggaccattatagttaaaattctttgggatttaggttaggaagcgaacactggttgtacatttcttgtatgtgtgtctgtgtccttgtgcatttttatgccctcacatatgactgtttgaatattgagactggcaggggctaaagctgcctaggaccttgtgtaagatttgtatctaataattatataatatataattgtataattatatattatatataatatacatataatatataacaattatatattatatataatatacatataatatataacataattatatattatatataatatacatataatatgtaacataattatatattatatataatatacatataatatataacataattatatattatatataatatacatataatatataacataattattatatataatatacatataatatataacataattatatattatatagttatatattgtatataataattattattattttttaaagatagggtctcactttgttgtctaggctggagtgcagtggtgcaaccacagctcagtagttgggactactaggtacgcgccaccacgcacagctaatttttttttttgaaacagggtctcactctgtcattcaagctggagtgcagtggcatgatcatggctcactctagcctcaacctcccaggctgaggtgatccttccaccttagcctcccgagtagctgggactataggcgtgtgctaccacgcctggctaatttttttttttttagagacagagttttgctatgttggccaggctggtctttaactcctggactcaagcaatccgcccccgacagccacccaaagtgccgggattataggcatgagccaccatgcttggctgagatttgtatctaaatatataaaatcttcatcctaagccctataggggtaaggagacaaaaaagaaatgtgatgtgaccttccacgtggctagtctgattcctattatcccctccctaacttcttacccttggtggtccctggggcctgaggcataactgactaactatgtggtcagaactctgggtttatctaaccaatgagctgcagtttctggtcatacagccctgccagttttctggatgcaaaactgctcacatactaaacacctttctgaaaatgagcatggtttgggataaagctatagccattggtaatggtgagggggtagcctgagagggggttgcttagaagtacagagcaagacatagttggggaaaggaccatgggaaggacaagaggcctggaatttttccttggcagtgccctgtaatcattgtttcctaaaataccagctctgattttaaaggcattggggtcaaaagggaagattagctagggtcgggcacctttagaatgggctgaaggctgaggaaaccatggaggtaggtaggggaccagttgggagagtagattagttaaaaaggaagcaggttgtgggaaacttcaggatgatgggacccttggaaaggatggatggcaaactatgtgtgtgggcaggcgagtggccccacccagttaattaccactgagatttccaaggctggaatcaaccagggacctagacattggaaaaagacagtgagagtgtgacaatgacactggaagtcaggaagagatagagaaggagagagccagacatgcagtgctccttagcttcctttcattccccctattttggggagaattggaagcaatggttgttctggggatacagaaaggccctctccctcttttgaccctcacagtttgttgaggagagtgtgtggaaggaatgttgtggaaaagagtagccaggcgcggtggctcacgcctgtaatcccagcactttgggaggccgaggcgggcggatcatgaggtcaggagatcgagaccatcctggctaacacggtgaaactccgtctctactaaaaataagaaaaattagccgggcgaggtggcaggcgcctgtagtgccagctacacgggaggctgaggcaggagaatggcgtgaacccaggggggcggagcctgcagtaagccgagatcacgccactgcactccagcctgggcgacagagagactccgtctcaaaaaaaaaaaaaaaaaaaaaaaaaaaaaaagtaacttgaccttttcagacatgtctgtgaatgaaatttcaggggtgggaatggaaatacagctgtacatcagcatggcagagggccacagtttaggcatctggacacaaacacaggaagggaatcatctttgcctggagctctgagtacatgacactgagagaggccagaaaagcttatgagtgaaaaagcaggcaggcagactgagattaagacgcttcctcacagcttctctcgggctgtgcctctagccattcactacctcatactaacattatgatcctgaccccacaggtctctgctccccctttaacctggatgaacatcacccacgcctattcccagggccaccagaagctgaatttggatacagtgtcttacaacatgttgggggtggacagcgatggtgaggaagaaaccggagtgccaggggattgggactgcagtagtgctaacaaaggggaggcaagatagatgggactctaaactaatctggtcttttgaaagtggctggggctctaaacttaccacctccatgctctttccctttggcctatgtcaagggtcatgtttgccctgtgcttacttacattcacatcctcttcccaggatgctggtgggcgccccctgggatgggccttcaggcgaccggaggggggacgtttatcgctgccctgtagggggggcccacaatgccccatgtgccaagggccacttaggtgagaagatgcctgacccttctcctcctaacccctgactttgatactctagaagcttcaactccctatacctcagctttttcacccctaaaatccgcatactccctgtccccaatctgataccaatccctgctcattctcctccaaaatcacatgaattcaagcaccccatctatgaccccatgatctcattctcttccacctccttccaaccaggtgactaccaactgggaaattcatctcatcctgctgtgaatatgcacctggggatgtctctgttagagacagatggtgatgggggattcatggtgagctaaggagagggtggtggcagtgtctctgaaggtccataaaagaaaaaagagaagtgtggtaagggaaaatggtctgtgtggaggggtcaaggagttaaaaaccctagaaagcaaaaggtaggtaatgtcagggagtagtcttcatgcctccttcaactgggagcatgttctgagggtgccctcccaagcctgggagtaactatttcccccatccccaggcctgtgcccctctctggtctcgtgcttgtggcagctctgtcttcagttctgggatatgtgcccgtgtggatgcttcattccagcctcagggaagcctggcacccactgcccaacgtgagccagaggaaggctgagtacttggttcccagaaggagatactgggtgggaaaaagatggggcaaagcggtatgatgcctggcaaagggcctgcatggctatcctcattgctacctaatgtgcttgcaaaagctccatgtttcctaacagattcagactcctggccaggtgtggtggcccacacctgtaattctagcactttgggaggccaaggtgggcagatcacttgaggtcaggagttcaagaccagcctggccaacatggtgaaactccatctctactaaaaaaaaaaaatacaaaaattagctgggtgcgctagtgcatgcctgtaatctcatctactcgggaggctaagacaggagactctcacttcaacccaggaggtggaggttgcggtgagccaagattgtgcctctgcactctagcgtgggtgacagagtaagcgagactccatctcaaaaataataataataataattcagactccttatcaggagtccatgatctggcctggcacagtaactcatgcctgtaatcccaacattttgggaggccaacgcaggaggattgcttgaggtctggaggtttgagaccagcctgggcaacatagagagaccccatctctacaaaaataaaaaataaaaaaattagctgggtatggtggtgcatgcctgtggtcccagctactcaggaggccaaggtgggaggatcacttgagcccaggtggtccaggctgcagtgagccatgattatgccactacactccagcctgggcgacagagtgagactctgtctcaaaaacaaacaaaatgggccaggcgtggtggctcacgcctgtaatcccagcactttgggaggccgaggccagtggatcacgaggtcaggagatcgagaccatcctggctaacagagtaaaaccctgtctctgctaaaaacacaaaaaattagccgggtgtcgtggcgggcgcctgtagtcccagctactcgggaggctgaggcaggagaatggcgtgaacccaggaggcagagcttgcagtgagccgagattgcgccactgcactccagcctgggcaatagagcgagactctgtctcaaaaaaaaaaaaatgttctctacccacatgcctttcctaatattctcttctccttaaacattttcagtcttcatagttgctaccatgtttcattcctcaccatcagaaccactctgcttttgttcccccaccatacagtcattgctatgttcctacatagcatttaattccttcttgttttttagaacattgtatatataaattatatctatgtatataaatgtgtaggtgtgtgtgtttatatacctatatatacatatatacatatatatacatttatatgtatacttacatacacacaattactaaagattactaaaggaatattttattaatttctacacttacacagagcctggcacagtaccttctttgcatgtaagaagtgccttataaatgtctaaattgaatgtgtcctcctgtgacctctttcccttgttgcccccagctcagtgtcctctacctcagtgttccccttccttctaggctgcccaacatacatggatgttgtcattgtcttggatggctccaacagcatctacccctggtctgaagttcagaccttcctacgaagactggtagggaaactgtttattgacccagaacagatacaggtaagagaaggcaatatgagctgggcacagttgcttgtggcacctacttaagaggtggaggtgggaggatcccctgaggccaggagttcaagactagcctgggcaatacagtgagacctcatctctaaaaatatgaaagaaaaaaaaaatagccaggcatggtggcatgcgcctacagtcccagctactcaggaggctgaggcaagagatcagttgagcccaggagtttgaggctgtagtgagctttgatcacacaactgcactccagcctgggtgaaagagtgagacctcatttcttagagagagagagaaaggcaatatggatgggcttggaaggggagagacagagagagaggggataaatgtaggtgttgtcttcagtagtatccaggtgttcatctctcctctcttatatactttcttcttcctcctctccccccatctcacatacatacatttcatttgaatgcgctttattcccaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctggtgaggcattgggaagacaggtgtgggaggctagagcaatgaaggcttagaagagttagggcggggccaggcatggtggctcacgcctgtaatcccagcactttgggaggcaaggcaggcggatcacctgaggtcaggagttcgagaccagcctgaccaacatggagaaaccccatctctactaaaaatacaaaattagccaggcatggtggcgcatgcctgttcagaggcatgctacttcggaggctgaggcaggagaatcacttaatcccgggaggtggaggttgcagtgagtcgagatcacaacattgcactccagcctgggcaacgagagcaaaactccatctaaaataaaataaaataaaatgaaatgaaaatctttcccttaaaaaaaaaaaaagaagaagaagaagagttagggcaggtttggagtgcagtgtgtatatcccaagatgtcttgcatactttctttgtatgtacactaatggtacaaagaggaaggctaagtgggctgtcattgtactccctctcactgcatttctacaaagtatctatgtctgtgtctctccatatttcacagacagaagtctctttctatccctccactccaacaatgatcctggcccacaggttctccactactgatgtcctagcccacgttccaaacatgatccaaaactcatctctaggggcacggtggtaaaattgaaacaaaacaaaacaactcatctctgggaggagtccctgcccagatcattcttttccgttctatatttcatcgatatttcccctcccaagtgcaatatttgttgaatgaatctgagtgtatgaacgttgtacttatttggactgataagctactctgtatgttctatgaccttcaaacatttgagctctcactccatgccatctccatgttaaatactcaggaaatggcctaaaaggcaagatgcttgacctcagggaagtgctgatgttaaatcctgtgtgtgtgtgtgtgtgtgtgtgtgtgtgtgtgtgtgtgtatgtgtgtgtgtgtgtgtgtgtctgcatacatctgatctcacctcactcctttctcttctcagcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtgagaattcaccctggatctggaagagttggggagtggcaggggggcagtgtcttgtgaactgtccaaggactgggaacttgaggaaaacaagggcattaactacttcccagacttcagccacagcatgttagttggctgtgttctgtaccaactctaatgcctcattccttgatcttatgacctcttaggtccttggtcactacctccggcggcagcgagatcccagctctttcctgagagaaattagaactattgccagtgatccagatgagcgattctttttcaatgtcacagatgaggctgctctgactgacattgtggatgcactaggagatcggatttttggccttgaaggtgaggattactctggagaaatggacagggcgggagaagttctggagtgtaggtggggctctggagtgagttcagtaggtcaaaggggaaactgtcttcccctgatattgtctcaatgttttctcatgaccaagggtcccatgcagaaaacgaaagctcctttgggctggaaatgtctcagattggtttctccactcatcggctaaaggttggacagattgaccccttcattacttctcccattctctgactcagataacttcaaccacagggccctccagattcctcctttaaccagcctccatgctcaccttcccatgcctttccaactgagcccagcagaccctcagtgatcttttcactcctggaacgttttttttctctttattccccactgtcttctcagtgaccccatctgcttctgtcccacaggatgggattctttttgggatggtgggggcctatgactggggaggctctgtgctatggcttgaaggaggccaccgccttttccccccacgaatggcactggaagacgagttcccccctgcattgcagaaccatgcagcctacctgggtgagcagcagagagttgcagaggacttacagggtaggggaggaaatacatccctagtgggggcgggtatgaaatactccctcttaactcatgcggtttctcactgacctctggttacttcccttgggacctcctgctatgcctttagggaacccccctactctggaccccatcttcttttcctttacctctgttactttgcccacttctaggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcaggtagggcatccaaggaagggtgggacctttggattcccagggacctctgggctgttggggaggagtgtgaagtgggtaagagagaggcctccaaagtctgtgcggaattctggttggcagagtctgtcagggatgtaaggagcagactagcaggctggtgagtgcttcccactgagtccacttgtctacagttaccttcccttttctctggggtcatcatcacccaccattccccagattggttcatactttggcagtgagctctgcccattggatacagatagggatggaacaactgatgtcttacttgtggctgcccccatgttcctgggaccccagaacaaggaaacaggacgtgtttatgtgtatctggtaggccaggtgagacttgctgggaccccctgccctggacttgcattgtgggggtggagggaggaaaggagggaaggtgcacatatttgagggtttgctgagaggttgggtctgccagattagcatcttctatcttctctcctccaccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccaggtcaggagtacccaaataaagcaggggcacggttgtaggaagaggaatagggggatgctctttgcttgtcaatagtctccttggcttgagacccaaactgaacaagtgcttttattagtaggcaaaaacataaggcagtggacaggttgctgaactaagaactcctgaacacaggcaagtttctcttattcccaggactgacgggagcattataaagagcaaggcatggccgggtgtggtggttcacgcctgtaatcccagcactttggaaggctgaggcaggcagatcacctgaggtcaggagttcgagaccagcctggccaacatgatgaaactctactaaaaatacaaaaaattagccgggcctggtggcgcacacctataatcccagttactcaggaggctagggcaggagaatcgcttgaacctgggaggcggaggttgcagtgagccaagatcacaccattgcactccagcctgggcaacaagagtgaaactccatctcaaaaataaataaataaataaaaagaaagagcaaggcaggaggcctgagaaactaggtgtatgggtccctgcctcagtattctctctcttcctctcagaggattgctgctgcctccatgccacatgccctcagctactttggccgaagtgtggatggtcggctagatctggatggagatgatctggtcgatgtggctgtgggtgcccagggggcagccatcctgctcaggtgaggggtcccagctcaggtggtggtggacagcatagcatagctgttaaaggcaagggccttaaagtcacagatggagatttggttttcttggtcaacttactctgtgcctccattcttagtttataaaatgacagtagtaatagtacctaccttataggtttattgtgaagattaaatgagataatccatataatgatttgaacacagtgcctagcatgtaagtgcgtattgaagtgaatctagggctgggtacagtggctcacacctgtaatcccagcactttgggaggcgaaggtaggaggatcatttgaggccaggagttcaagaacagcctgaccaacatggtgaaaccccgtctctactaaaaatacaaaaaaattagctgagcatggttgtgggcaccagtaatcccagctactcgggaggctgaggcaggagaatcacttgaacccaggaggcagaggttgcagtgagctgagatcgccccactgcactccagcgtgggccacagagtgaaactccatctcaaaaaaaaaaaaagatcaatgacatgaatctattatcttacttctgtcagagggttcggggtagggtgacatgtgcattcagcccctccttctttgttttgaccatggggaagcaaacactgggcttgcacttctcagagggcttacctcctactgctagaatttcttttccacactgttcccagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctgtgagtgactaaaatgcattacaggcaactctcaattccttgcatgccttcctcactagacccctttccaccctcactcttgcctccttcattcagacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggtaaggagagggcagtaactgcttagcatcagggcctgagaatgaggagaaagctgggtcagaggaggaattttagctgaatcagcaagaaagccaaagccgggaaaatgagatgattcagactttggagtcagggctgatctgggtttgaatcctagctctgccatttaccacctatgaattctggcaagtccaaccctcagttttcttgtctgcaaaggggtgataataataactgtatcataggagttgtattaaaattaaatttagccgggcgcagtggctcacgcttgtaatcccagcactttgggaggccgaggcaggtggatcacaaggtcaggagatcgagaccatcctggctaacatggtgaaaccccatctgtactaaaaatacaaaaaattagccgggcgtggtggcaggtgcctgtagtcccagctactcgggaggctgaggcaggagaatggcctgaacccaggaggcagagcttgcagtgagccgagatcatgccactgcactccagcctgggcgacagagcgagactctgtctcaaaaataaataaataaataaataaattaactaattaattaaatttagtaatacagttaagatcttaggacagtgcccagcacacagaaaatgcttcataaatgatcactacaattatcacaagatccttgactctgtgactctgtgactctgttttccttcaggatacatcagattacctccggccagtggccttgactgtgacctttgccttggacaatactacaaagccagggcctgtgctgaatgagggctcacccacctctatacaaaagctggtcagcagtgccatgccctgccccttgctcccaacactgccctccttcaagagaaaagggagggagggagaagacatgagatcatggtgaaatctgacctgggctcctctaatcaaaatatacccacttttgtcttttcactttccccctattctattcctttcctccttgctttcctctcaacccttagccccttccctttcttccaggtccccttctcaaaggattgtggccctgacaatgaatgtgtcacagacctggtgcttcaagtgaatatggacatcagaggctccaggttggatggacatgtactaggcaaaccagggtgacctgagacagactggaagggactcgaagggcgggtagggggttgtttcttacccatgataacaaaagtgagacttttggcactcccctccttcaactcctggtctctccctcattcatcattcccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcaggtgcctttggaggagggggtgtgggagaaggaaagaaaggaggaggaagaagattggggtattggcctcagctgtgaggtcctctagagaaaggctcagtgtttagaggctgtgggtaggacagcagttgcagccccagctccagcttctatctccattcccctgccctcagagagagagcccaataaaggtggaatgtgccgccccttctgctcatgcccggctctgcagtgtggggcatcctgtcttccagactggagccaaggtgggttggggtctaggatgaaaagagggctctaggagggcagaggctgggatctgagggtcctgggacttcagggaagggggcgcacaagggctcctgttcctctgtagttgttccatgaggaagactctaccattaccctgtgtcccctgcccctaggtgacctttctgctagagtttgagtttagctgctcctctctcctgagccaggtcttcgtgaagctgactgccagcaggtgagaatgaagggaactttcttccagacctctcctcctactgagtcttgactggaggggtggggaggaacaacattgattcctctattaacagagaagggtgtcttctgaggaggggttgagatgtgagcctctcccctctgaccctacagtgacagcctggagagaaatgggacccttcaagataacacagcccagacctcagcctacatccaatatgagccccacctcctgttctctaggtatgcccagcttctagggtgggacccagttctgacctcagactcatacccttatgctgcttccctccccttccatgtgcctcagtttttccaaaaacccaagcccttgcggctgctcagtctttttgccctcaatcctattcatgctgaatcttcccttttaagcatcttactttcctaggtatagtgttttgccaggccttgggcactggagctgggatgaggggatatgggatgtagccataaagcttgcattgtctgtgtcatgttctacttctgtcttctccatgtacccccacctctttatccatgtgctggccctgcctcctctgaatccacgtctgtgtgctgatcatatgcccctgtgtctgtgttatggctgtgaccatgtacttcctgacttggtgttcacacagtgagtctaccctgcaccgctatgaggttcacccatatgggaccctcccagtgggtcctggcccagaattcaaaaccactctcagggtgagaagctggaggggtcttggcatgaggagaatgtgggggaacaacagctttgtgggaaaaggatgggaagggtctctcttggattttaatggtatctagggtgaaggggaacaaatgaggaagggtcttctgtctcccacttcttcctattcccaaccttcctcttaggttcagaacctaggctgctatgtggtcagtggcctcatcatctcagccctccttccagctgtggcccatgggggcaattacttcctatcactgtctcaagtcatcactaacaatgtgagtctggtctaggagggcatggaatcctgccaccttgagctggtggactcactgaagctggacaccacaccagctccctatctgttgggcctctgctcttggggctcttctctctggggggctttctttttacacatgtggcttattagagagaagaaaaaggtattataaggggaagaactacaagggtgtaggtatgttccaactcagccttgagtggctagcgccaccccatcaggagggtctttcaagttggatcttcctctaggcaagctgcatagtgcagaacctgactgaacccccaggcccacctgtgcatccagaggagcttcaacacacaaacagactggtatgagtcacaaaggggtgtccagagtgggaatgcaagtggagttgggtgacttgggacaagagggtaggaactggagtggggaagaagggatctttccaccccagggtcctgatctggagtgggaatgaaaatggagtcaggtgccttgggacaagactgtgtgaactagaggtggggaaagaggatgtttctaccccagagtcctgatctgtctctctctgtctcttctgttagaatgggagcaatactcagtgtcaggtggtgaggtgccaccttgggcagctggcaaaggggactgaggtctctgttggactattgaggctggttcacaatgaatttttccgaagagtaagcctttccttttctagtactccccacttctgctcctttctggaactttagcataggttttggaggtagacagacccacgttcaagtttcacttttgcctcttactagctatttgaccatgagcaagttatttcatctctctaagcctctttttcctaatctctaaaatgggaagataataccaatttcatggggttgttataaagaataaatgaataatgagctggacatatggtgaacactcagtggaagctagttattatccttgtattttcctccactgaccattacttttttttttcctgaccattccttagtgctgtatcaatcaacatttgcaggatacctaaatttaatcagttaagaatccatcacgttcctattacgtaaaaggccctgtattaggttgacactgagaatatctccaacatttagcctcatgcctaactcattgtaggcgcttaacatatttttgctaaatgaatgaattattgatattacatgcaggatttgtactggggagtggtgggaagtaagattgtataggtgagagggatctagattacgaaaggcctctgaagccagggagaaactgaacttaatatgacaggtagtgaggagtcagtgtgagttcctcctgggcagggaaatggcatcttaattgtaatggctgtttggcactaaggtcaatgttgtgctttcccatatctacctggaataacacaagatccctgggatgtcatcatatgttttagggaagttaagtccaataaaccacccttctccaagtctctgtccttctttggtatctttttttcactagtctattcatgctttcaacaaagatttattaagaaaccactacatggccgggcgcggtggctcacgcctgtaatccctgcactttgggaggccaaggtgggcagatcatgagatcaggagatcgagaccatcctggctaacacggtgaaaccctgtctctattaaaaataaaaaaattagccaggtgtggtggcaggcgcctatagtcccagctacttgggaggttgaggcaggagaatggcattaacccgagagatggagtttgcagtgagccgagatcacgccactgcactccagcctgggtgacagagcgagactccatctcaaaaaaaaaaaaaagaaaccactacatacttggtactctgctatctagtaggcactaaggacacaaaggttagtaaggcacagcctttaacctagaggatcttatagttcaggagtgaaaaacagaagtaaacaccagtgttggtgggggttaggaggaatgatttccctaaatcccagaggggatgacatctaaacttcaatctaaaggaggggtagaggtcagccaaaggaaagaggagtagaatgcatttcaggtaaagcaccagatgtattgattgtccttggaaaacaaacagcagcagcagatgtgaccaggggttttccatctattacccttcctctcttttcccattggtcttcagccttttcttctggtcttgagagccctcaacattatgcctctcagcctcaactttgctgttgggattccaaagaactatatcacctgataatggctcattttaaatgtcttcctatccacttgttccataggccaagttcaagtccctgacggtggtcagcacctttgagctgggaaccgaagagggcagtgtcctacagctgactgaagcctcccgttggagtgaggtagggctggagaccgagtctgagagctgtgaaaataatgatgatgggtatgtggtagggccacccgtgggctttttcagaacgaaggcatctccatcaggcagcaggatcctagtgttccactgccgccattcctgcctcagtttctttcctttaagtagcaggaggttatttattctatttgggggctggctttgatataatgtggggtgaggctagctgggttataggatgcatgtagaaaactactcttctgtccacgcagagcctcttggaggtggttcagacccggcctatcctcatctccctgtggatcctcataggcagtgtcctgggagggttgctcctgcttgctctccttgtcttctgcctgtggaaggtaagcactgctttagtggggagtgtggagcatgatgcccatgagttgagggatccttgattatagcagagagaacaggatttgtgctgggcagctaaccaggctgtggatgtcatgcccagatctccttcactgtaccccacaaatgttggttaaattattctaagccaaataaaataaatttgaattccatttttggaaacagaacaaaagtgaagacctcagataagtctgagagctactggcaaggttcccagtctaggcatttggcagtgacgcttatcttttcttctacagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatgacttttggctctatatgtattccctaggatatagactgctcagtaatagtgagaggtagatacttgttttgcctgggattttacagagtggagtccctggaaggcaaagttaagaagtattttaaatgttttctgtggctttcccacaggagatgtattctagcctcctgtaattctcacctgcttaagtgaccagaaagtataaaggtctgggaagcacagaggtttagattgaaatcctatctgccatttattagctgtatggccttcagcaaatcataacttccttgaggctcagataataaaaggctgtgtattacagtggttaacaatgaaggcagatttgggtttaaatctaggctacacaacttaaaaagtctgtttgacctaggacagacttaacttctctaagtcttggctttctcatctttaaacctattagggtcatgaagacaaaatgaaataatccaagaaaagtgagcatttagtaaatgctcagtaaatggtaactattattataaaactattttgtcataaaataatctaccatatcatgccttgtgaggattaagggagaaagtatactggagcaccaggtggtggtgttcctgctctctgacccatctcccagattgtgaagatgtgtttctacgtgctgttgtctcatccactaaatcttgtcctatgcctcatcttttttttttttttttttttttttttgagacagagtctcgccctgtcgcccaggctggagtgcagtggcacgatctcagctcactgcaacctctgcctcctgggtccaagcaattctcctgcctcagcctcctgagtagttgggactacaggtgtgcaccaccatgcccagctaatttttggatatttagtagagacagggtttcaccatgttgaccaggctgatcttgaactcctgattcacgtgatctgcctgcctcagcctcccaaagtgctgggattacaggtatgagccactgtgcctggcctgcctcatcccttttgaaataagctctttgagccctctaaggtgataattagctgaagaatttaaggttctaatggtagagatcaaatctatttgattccattaagcaggtatcttctaggctcctcttgagacacccagagtttttccattatcctgagagaacacgtgcacttaagcaatggccttctagagaccgagtctctgcctctattgcctaaccctgagaattgtggcctgtctggcctatttggcatgaacaccattctgtgtcaacctgctgagttgttttgtgacaggaaagggtttccattgtgaccctcagtgcacttcatacaggctgtaacttgatcagcctttatggagcacacagtttctagggctgagaccgcaaccagattatgttgacagactctcctctcctctttaccctcagtcagcccccaaatggaggtaggtttccttgagtactggttcatctaatgctcacacatatatacatatacacacatatatatgtgtgtgtgtttgtgtgtgtatacatatatatatatttaaattttttttagagagggggtctcactatgttgcctaggctggtctccaactcctggcctcaagcaatcctcccgtcttggcctttccacatgctgggattataggtgtgagccactgtgactgacctcatgtaattcttttttttttttttttaggattaatttcttttatttatttatttattttattttacttcaagttctagggtatgtgtgcacaacatgcaggtttgttacatatgtatacatgtgccgtgttggtgtgctgcacccattaactcatcatttacattaggtatatctcctaatgctatccctccctgctccctgacctcatgtaattctttatccatatgattaagagagcacttttaatatatttttccaactagagattcccctcctatccatcgtcagctccagactggggctttctctaaacccaatcttgttacccctttctttgcaatagtattagtttaagaagcaactgtgtattgttccttcctttccttgttgttgctcctttgcttcttcattaatttttttcattcatttattcatcagatatcaagcacgtaatatgtgcttgacaatggcaataatataaaacacaactaccatcaaagagtccagtccagtagcagaaacaaacatgtaaacaaatagtggcaaatacagcctggacgcagtggctcacacctgtgatcccaggactttgggaggtcgtggcaggtggatcacttgagttcaggagttcgagaccatcttggacaacatgtgaaaccctgtctttaccaaaaatacagaaacaattagctgggcatggtggtacgcacctgtagtcccatctacttgggaggctgaggtgggaggatggcacgagcccaggaagtggaggttacagtgagccgacatcacgccattgcgctgcagcctgggtgacagagtgagacactatctcaaaaacaaaaaaaaatggcaaatgcaaagaggtggttgctatatatcaacaagcactaggagtatgtcatacaagaggcatactttgttgggcggtgggggtggcggggttgtaagggaaaactttatagaaaaaagaaatttggctgcggggttgttctgtgcaggaaacgcacaaggggagaagaagagacacacacaatacctttaagggtaaacaagctttatcccatgtaaatggcaatggagatataataagcaaatggtacaagcaaattaatataataagcaaattatataataagtaagcaaatgatataataaacagattgatataataagcaaattgcaatgggaaggggagaagggaaaagatgtttacattcaccagactatggaggatttaccaccagactggaaagcaacagcctgggttccagagttgaacaccgcactcataagactatagaggattcaccaccagactgagaagcaacagcctgggctccagagttggccactcatccatgcacagacgaggagaggtctcatgaagttttggcgcagtctgggaccctagctctttttgtaacgagttgtttggcatgaggcccagtcacggggcccttggcgactgggctcaaggaacacaaaacattcaacttatttttgcaattgtctattgtttttcaataactaacgtgtaggaatagattgaaatagagatttctccaaaacagtgctggacgaacacctcaaggggctcacacaacctgttctgggacttggtgaccattgtttctgtccacgttcaattgagttcaaatttaatatttaacttttccaccgcagggatcaaatgtgacaggaggcattcttgggaggattaatcaccagctgcaaagggaattgtaaattagaacagtttgaggcctggtgctctgggagttgaggtgaggagaatcgcttgagcccaggagttcaaaaccagtctgggcaacatggtgaaaccccatctctaccaaatatatgaaaattagctgggcatggtgatgtgcacctatagtcccagctactcaggaggctgaagtgggaggatcccttgagcttaagaagtcaaggctgctgcagtgagccccgatcatgctatcacactccagcctgggtgacagcgagaccctgtctcaaaacaaaaaaaacaaggccaggcatagtggctcacgcctgtaatcccagcactttgggaggccaaggcaggtggatcacttgaggtcaggaatttgagaccagtccggccaacatggcaaaaccctgtctctactaaaaatacaaaacttagcgggcgtgatggcacatacctgtaatcccagccacttgggaggctgaggcaggagaattgcttggaccgggaaggcagaggctgcggtgagtgagccgagattgtgccactgcacttcagtctgggtgagactctgtctcaaaaaataaaaataataataataaaaaaagaaacagtttgagtggctcttttgtgtgaaagtaatgagagatgggactgggaaagagggcggcagcgtatgactcctgaagagccttgtaaaccacttaagaactttgggctttaccctgtaggttttcatatgcattttagtgagctctctccggcggggagaggagaaaagaaagacaggaagaccagttggctgcgactgactgttcaagaattaccaagagcctgaacttcaagggcagtggaaataatgaagacagttttttgtttggttattttttgtttctatgcgggggcgggggcggggggggcagcttaaaataaaattgctctcctcgctctctgctgttttctaattcagatgtgcgtttaaaaattgagcctgggccaggaatagtggtggctcatgcctataatcccagcgctttgggaggctacggtgaggagaatcgcttgaggcctggagttgaagaccagactgggtaacatagagacactccatctcttaaaaaaaaaaaaaaaaaattagccaggcgtggtggtgcatgcctgtagtctcagctactcgggaggctggagtgagagaatcccttaagcccacaagttggaggttacggtgagctatgatagcgccatgcactccagcctggccgacagagggacagattagagacactgtctcagaaaacagaaagaaaaaataaaattgaacctgatcacctttccttaggttttgtcccccaggttaccgtgggccgcgcattatctctgctctgcttaacactacaatctcctatttccgaactgctctcttcaaatgctcttttttgcttgggtttttggccggggaatagtggcgggggagaggcggggggagttggcgggggcagaggtaactttaccagtgattaaatgcaaatgcgacagtccgtgagaccgaagcccctggtagaagccgggaccctcctgcctctggctgccgctctccgaggggcggggctgaggcggggcttggggcggaggccccgcctggaactgagggtggggcgggtccgggtccgggaggagtctcagctggagcccacccggttcctttcctgattgagcaggtcggatcccagggtgggttcagatttgaagggcgaggttcgaggccaagcccccgtcgcagcctaagactgcgggcttttctcctctgcagggatggggtagggcagggccaggggcggagttttgagcccagcccttgggttcttgcctctgattgagcagggcgggttctgaggcggatcgtggggcggggcccgctctgctttttgacagctgtctcttgcacagccgcagccaagtccggtgggttcgggaacctgtggcccggctctctgcgcgtccccatcccccgtggccccgaccccggccatgaagcgtatcttctcctgctccagcacacaggtggcggtaggtgccaaaatgtgtgggaggatggggttgggatcccagctctgtggtgacagaagtctttagtcccgtctcaatgcatcatcgccttttctttttatcagtctttctagctcttctagtcttgcaaggaagcccgccagctttgccttcctcaagaccctgccctgcagcttctgacttgccctgctcacctctgccatccccaaggccctttccccggcccctttcttgtcctcctagcatctacacccccgatttctggttcgttttctgcaactctgtccccttcccatggccctgaccctacttctgctccgtctcccagtaccaaacctcccccaagcatcttcctcagcccctgcctggcctcaagctccattctacaccaccaagtcatgccccagagccccatatttcatccctgccctgtccccgcaatcttgccttccacgtagctctatccttgctgtttcctgttagttcaacaagcactcccagccctgtgccttctgctaaccctttttcacaatctcctctgtcattgcttccctcctgccccatgccactttcactcccatctctcaccagcactgctgttcctcaaacatcactccaaacctttttccaattgatgctcccacaacagcaaccttctgttctcccctccaacctctgccctactctgcccagtggtcgccagtcccacttttcctcctgcctgcttgctgtgagttaatattgcagtctggtcagcctcacaggcactgccagaggatgcacagttgcctgactgctccccagaggactgggtgagttgcctgcagagtccaccccagccagttcactgcagtgtctgatcatcagactggttcttgggccagtcaaggctcaaggcctttctgcctgcttttccccagattattcatttcctgaacccttgcccagttgcttaggaatgatactctctgtttcctttggttgaggtgggggaaagtgatgatgagagaagaggatagagcagactcagagttcccagcagaagtcactctattccccatgttctcccagaaaaaaaaaaacataagattatagaaggtggtggcttagggagggtattgcttcttcttctctagagatctcttacagagagcccccttatttggaaatggaattttctgtagaggttggggttacggctaatttagaagcaaattagccagctacttgtagcaatattgctttgctaacttgacttagtagtatcgttcataagaaaatatcagaaatgttcaattagctcattctgcatgggcaggttacagaatcctggaagcaagctatgaggcaagagtatgaactctgttgaggcctgtccttgtcccacttacatttgcatctctacttagtttccacacattgatcaaccaatcaaaaggtatttactattatatgcaccagaaactgaggctgcccagactcagtcttaactcataatgactttttagaaattcatatggactcttccttagttactgaaagtattcaatgttgcctttcccttacaggtttgtggagtctgcctgcttcttaggaatggggaaactatttcattctttctgatcccccaatccttgggcagtacctcctttccaaggtgctggaatgagtgggctggcttttggaatttggaaccatccctctgtcctccttgattctagctgtacagaggtttgaccataaagaatgaccacccattctaaacttttagtataacaagatcttactataatgagattatgggaagtaagttggatgggtttagaattatctagctggaaagaaaactgtttcttcagacagattggagtcatagaaagcttgcaaatagggcagtttcagctgcagattggttcctcatgaaatttccccacacttctcatgataaattcctccactgttttgggtggcaaactactctggaaccatttgtcagagaagtagtgtggcagtctttatggccactccaaaagcctggcttcccagtcacactggaagactgcctctacccatctccactcacacatttgggtccagggccagagccctgcactgtcagtctgagtaaggactgaaaaagcagtgatcattttaaagctaatctaagttaccagtatataggaaaatccacacacaaaaaaaccccaactcctataatcccattttattttagtcaagtagaggatatccttgagggtatcttacctatgagcttactctgcctaggtagaccagaagtagaccagaagagagctttaaataattggcactggatcatctgggcgcagtggctcacgcctgtaatcccagcactttgggaggctgaagcgggtggatcacctgaggtcaggagtttgggaccagcctggccaacatggcgataccctatctctactaaaaatacaaaaattagccgggtgtggtggcaggcacctgtaatcccagctacttgggaggctgaggcaggagaatcgcttgaacccgggaggcggaggttgcagtgagccgagatggtgccatcgcactccagcctgggcaacaagagcaagactccgtctcaaaaaaaaaaaaaaaaaaaaaaaaattggtactgtctactgcaattacaacgttgagaattaggtcctggttcccctttctgtttccactcacctgacctacagcagaagtcattccttctctctctacttgctggtgtgcttccatgttataggatgcttataggtacacagccagagatataaggagaaggtacaattacttctacaaaagtcctctaatctcagctatggaaatacaaagcttatacttattgagtctgctgattaatttggtgattgctcccttgaggctgtgatggtaatctagtgcctcctttccaaggtgctggggtaagctacagactggatcttgacatttgaaagcatctctctgtcctttacttcagctctgcagaggcttggccatgaaaagtttctacccattctaaactctacttagtataatgagattataggaagtaaattgggtggatttagaactatctagctggaaagaaaagtacccaggccaggcgtggtggctcacacctataatcccagcactttgggaggctgaggtgcggaggatcacttgagcccaggagtttttgagaccagcctgggcaatgcagtgatacctcatctctaaaaaaaaaaattacctgggtgtggtagagcatgcctgtagtcccagctactcagaagactgaggtgggaggatcacctgagcccagaggtcaaggctgcagtgagccatgatcatgccactgcacttcagcctgggcaacaaagcaagactctgtctcaaaaaaaaaaaaaaaaaaggaaagaaagaaaaagaaaaaagaaataaaaagaagtggaaagggccaggcgcggtggctcacgcttgtaatcccagcactttgggaggccgaggagggcagatcacgaggtcaggagattgagaccatcctggctaacatggtgaaaccctgtctctactaaaaatacaaaaaattatccgggtgtggtggcgggcgcctgtagtcccagctactcgggaggctgaggcaggagaatggcgtgaacctgggaggtggaggttgcagtgagccgagaccacgccactgcactccagcctgggcgacagagcaagactctgtctcaaaaaaaaaaaaaaaaaaaaaaagaaggggaaagaaaagtatctatattgctaagaagcatctttaccatctgtacagcttggctgttattcgctggctagtatcagcaagatcccttccactctcctggctggagaattctgagcccaggaacatctaaaatgtgctcaggaaggatggattgtgcatctactatgtggcagacaccgagctagatgccttataggttgttatagtattaggaaactgaggttcagagatgttgttacatgcctaaattcacagaggcagacagtgttagagtcaagacttgaaacatttcgagaactgcaggttgacgtcagctgatggcagcaccctgtcgtggggcatagttctagctctctgctttcctgggggtgacctggtctccaaaggccattagaaaatgcgttcttacatgtcagagtctgttagtatgtgaaggagtcattttgcttattttgtcctttgagagttaacctgtttggagactccatgagacagtagagtctgagggtgggtggctttgccctggaggcaacttgagactgtttatctggaaataagtaaacctgtttctatagcttgtagtagtgtggtctggtggggagagctaggatttggcatcaggtggactgggttctttttttgtttgtttgtttgtttgagatggagtcttgctcttgtcacccagactggagtgcaatggtgcaatctcagctcactgcaacctccacttcccaggttcaagcaattctcctgcctcagtctcctgtagctgggattacaggcaccggccaccacccccagctaattttttgtatttttagtagagacggggtttcaccatgttggccaagctggtcttgaactcctgacctcaggtgatccacccgtcttggcctcccaaagtgctgggattgcaggcgtgaaccaccgcacccagccatggcctggattctaattccaattttgccactctttttcgtgatcttgaatggttatctaatcttggtatacttctgtttcttctgtcaaagagatggaataatagccctagctactttccagggatgttgagagactaattgaaatagcatgtgaaaggactgtgagaagttacaacttctgtacaggagtattacctcagaatccatctaccttagataattttatggtttggatatttagagctttcctgtggttgattaataatttgccctggctacgtaaacagtgtttgaaaatgagttactgggcttccacagaccctatttttcttcacccctttctatagcctcttgttgagattataccttataaaatgctatgtgccaccaccaacaccccactacttcctgttttgttacaaggatgccatatatttgtatggctctttacagtttataaagagattttgtatatattagcttgtttaatagtcacagcatgatgaggtagttgttattagccgtattttatagaagaggaaacaggttaaaggtgtttaatggcttactttaggtcacatagccgagaatgtagctgaactaggtcccaaactcaggccagccagcgaaatatttgtctggcagcctttacatcagaccacagatctttgcatctgtctcttccttttcattcccttctctggacaaaaccaggcttttctgtactttcagccctgggtgtttttacatagctgtctcttttatgccctataacacttcaattattataattaccctaccacccacaaaacccaagctggaatgatagaacaatgcatgcccaggtgtggctgttgtctagacagctgctccctgccagggaaactgggagggaggagaaggggagctacctcttgctgcttcctcaaacataactagaaacctctttgccttttggttgttgttgccatggaaaggagagagacggtcgccaaagggcctagatatgatatgggaaaacagaaactctagtttcctcttttaactgtggggcccaaagccaatgaaaagaggtggaatggttaggtattggaactcctagctgtaacctgaagctcggtcggtgccttaatgtacttctcaaacaactgacaacaaaaagcagagcagcagggtttcaggggtggaggcggtggtgagaggcaacatgagtcctcaaaagtggtcacgttggttccatttgctccagcaagacctagagagcaaaagggaaaggattgctctgaggttgggcactgaacaacaactctaatcatgatgacaaaaggacatttgaaatactgtgcattcagcactcaaatgatttttaattcagtggtccagggtccttctggctcagggctggaaataaccagcaatagttcttggtggcatattagctggttaagatttagctaggcccacctaagaaggactaaatgatctaggatgtgtgacttgtggaagagaaaaagggatgttccttttctctcatttggcatcctaaccatttgcctcttttctttctccacactacccccatgccctatattcacacaacctgtggctctggaccaggtggagagatggaaccgccatgatcagaagctgctggaggcagtgcacaggggggatgtgggacgcgtggctgccctggcctccaggaaatctgcccgacccaccaagcttgactcgaatggccagtccccgtaagtcagtcctcctgcccctgccccttacatgtggctcccttttgaagcccccaaatccaatataacataggaccagggaatgcctacaacttcagagctcttttcattgtcttaattagcaagtatatcaatagttttttgctacatataagttctacacaaagtgaggaaagaaaatattgttcctgagctccatccattgcacaacccagattgacaccactgacttgtaaagtacataaagcccattaaacaaacagaaaatgaatatatacactaagtagagtgtttcttcattgcacaagtaggagggtgtgtatgcatgggaaatttgaaatgaagtggtagcatgggagtcacatggctagagggagtagtgattaagtcaaaggaaatgttatcccttgtctctacccaaagccttcgaatgtccagccttcactctgctctggctgactctttctgtgacacttccacttccgctaaggttctgtgctcagagaggcaggtaattatgtgttccctagacacccctgcaatagtctgagattccttgagacctgtagctcttatttcttccttgcttttagcatcctttgtgattggaggccatatagacttctctttctcagaaattcaagctaggggagcttcttttcctgcttttaggattggctttggggtagggagcatagcaagaagggcttatcaagattctcccattcctcatccctggtccctttatcctttggcctctcggccttgattctggcaggtttcatctggcagcctccaaaggcctgacagaatgtctgactatcctgcttgcaaatggggctgacatcaacagcaagaatgaggatggtgagtgagccggagcactgggccacgctgcttgcttgcccctggtacagcagcagtcgggggcggtgctgggccctgctggacattcctactgtggccccttgcttctctccttagtaagttctggccagcatccttccaggagttcccctccccgtaagctgggcacacctcacccccactcccaccttcatcacaggtaccaggcacttggggaacaggaatttctggccccgtgtggctgaaagcttctctccctaatctcctgattatctgtgcgtctcttgccttccctccctgtgagtcatcagcatgcatggggccacctaccctccttctccccttctttctgttccaggaagcactgccctacacttggccaccatctcctgccagccacagtgtgttaaggttctgcttcaggtaagagcagtcccttgataccactcttatgaagggaagaagtggtcccagagttttctaacttcatttcatacttaaaaggaatagttggccaaatgtactcgcctcatccccaataggagggctgataatcatttgtttgccaacatttatttaactactatgtgcaggcaccatgtttgatagtgcctttgagggcaggttataaagcagagttgccaggcactatcgattttgtcattagcagagccactgcagagacttcctgctatgatgaggggcaagaggaaggaggacagagatgttcaaattaaaccaaagccctactgtctgtttctgaagagtttatagtctagtagtataaagagaaatatacatgtaaaatgacatgtggatcatttataaatgagtctccaaaagcacaaaaggcagttactggccgggtgcggtggctcatgcctgtaatcccagactttgggagatggaggtgggcagatcacaagatcaggagatcgagaccatcctggctaacacagtgaaaccccatctctaataaaaatacaaaagattagctgggtgtggtggcacgtgcctgtagtcccagttactcgggaggctgaggcaggagaatcgcttcaacccaggaggcggaggttgcagtgatccaagatcgcaccactgcactccagtctgggaaacagagagagactctgtctcaaaaaaaaaaaaaaaaaatcagttatcttaaccggccatcaggcaaatggatgttctactttcgttcttcctaatcctttccaaatttcacaattatgtttctaaagtaccagccacggggacattgggtgtcattttccctaacacgtttattaccatctgatttttcttagccccttggtttagaaaccagggctgatattcaaggctgcctatcatcagcaatggatgaactgggcttgcctagtagatagccttctccaaagtggacctcctgcccctcctcatattaccatggaaattggtgacccaatgggggtatgggatgaggatgttaacaccaagctccatgctgcttccctttgtggccatttgcagcatggtgctaatgaagatgctgtggatgcagaaaaccgtagtccattgcactgggcaggtgtgtgcaggggactcatgggaacagggctgcagagactacagggtgggaaaggggaggcgtgaggagggaagggcagccagggccaaccaatgaaatggtcggaggggatgttgggtcatagtctgagtaggctttcttcatgcttccccttaacccaaacatcttctccccagcctcctctggctgtgcctcaagtgtgctcctgctgtgtgaccacgaagccttcctggacgtgttggataatgtgagtgtcagatgggcaagtgggcagtgtcctacacagaagggctgctgctctctctcagcttgactggccaacttccatgacctagggctgtgttagcaccacccttctcttccttctcctcctgcttctcctcttcttcctcacagagaggttaagccttatcttctggagagcttctaaccctccaaaagggagtgttcagacccaagatctgggcttttattttttttggacaggtgtgaggggaggggagccggtaggattgtcaagcctctgcagtccctggctgctcatgaacctcttcctacaatctgtgcaggatggacgtacacccctgatgatcgcatcgctgggtgggcacgcagctatctgctcacagctgctgcagcgaggcgcccgagttaatgttacagacaagaatgacaagtgagcccccctcgtctatgcaccccaattcccatgcctgaccaatttagaaagaagccagtgggcaacgtgtgtgtgtgtgtgtttgtgtgtgttggggaagaagtcaggttggtctttgtgttcttgggaacctcattccttcccagtggaggttctgaagagctctgcctgctgccaccaccatcttcatagatagatgaccccagaagtagaatcgacacttctggacccgttggctgaatttactggttgtcaaattatcttttatgcaagaggatccttttttccaataaaaaatgtatgtagaatccctgtgatcccagcactttgggaggccaaggcgggtggatcacgaggtcaagagattgagaccatcctagctaaaatggtgaaaccccatctctactaaaaatacaaaaaattggtcgggcatggtggtgggtgcctgtagtcccagctactcgggaggctgaggcaggagaatggcatgaatccgggaggtggaggttgcagtgagccgagattgcaccactgcactccagcctgggcgagagaggagcgagactccgtctcaaaaaaaaaagtatgtagaaccttgatatacagagcagataaaaatggagctcatccagttggccccctaatttctgttcctgcagctctaaggaatggcatttgaaaagcctagtcctggcctggtgcagtggctcacacctgtaatcccagcactttgggaggctgtggagggtggatcacctgaggtcaggagttcaagaccagcctgaccaacatggagaaaccctgtctctactaaaaatacaaaattagccgggtgtggtggtgcatgcctgtaatcccagctactcgggaggttgaggcaggagaatcgcatgaacctgggaggcagaggttgcagtgagccgagatcatgccattgcactccagcctgggcaacaagagtgaaactccgtctcaaaaaaaaaaaaagagaagtctagtctggtctaatgttggtctgttgttctcctgaccccactgaatgagagcttaccctgtgagtggaatgtctggaaccaggacttctgggttccatgtggaaagtctgtgctcagatttgtctcaacccacagatcggctttgatcctggcctgtgagaaaggcagtgccgaggtggctgaactgctcctgagccacggagctgacgcgggggctgtggacagcacagggcatgatgctctgcactatgctctgcacacacaagacaaggcactgtggaggcacctacagcaggccctgagccggcggcggcggggcggtaaaggcccttgtgtaacttccacgttctctaagaatcagagaagtttcttagagtcccatttgtttccatggaagtaatctatctgacaaataattgtcacctgggttgagagtttacgtatttattgctgctactgtgagaggaccccaaatccccatcccaaaagtatgatcacaaaattctttaatgcagcctggtctctcactgaggacagctctggctagtgttgtttctggcgtttgtgagttgtaattgtacatctatttgtgtgatttgttggtcactctctctttcctctaccagattgtaacccccttaggtgacaggccatttctgttttgctcaccattgaagttccagtgcttattaaagtgctggacatagtgaccaataaataaatgagcgaacaaaatgaatgaagtggcccatttctgggataggaaaccaaagttgctggatagttagggatccactaaacaagattggcttctggcaccaggaagatgtgcagtgagattgatcacagagaggccactcctctcagaaaaagtctgaagataagaatgtgggctggaagtacatggaacctgtcttctctctcattttcctcatatcttttcttataggtcagaggctagtccagcacccagatctcgcatcccaggtaagaccctaagtgcctcccccttttgcttttgacacaccccaggctatcccactgtgactattcctagtggtccttggggtgtcaagacatttaagagaagaaaggcactcctagggctcagttcgttgcctagtggccacactttactattctgtttccaacataggcctctccatctgagccccaggcaggttctcctcctaagagctcatggagagcagagcctgaagaggagcaagaggagaaggaggatgaagacccgtgctcggaggagtggaggtggaagtatgaagaggagcggaggaaagttgttcggctggagcaggagctggtgcaaaagacagaagagtgtaagactcaagctgcagcctatctggaccttgagaaccagattcgagagcaggcgcaggagctaggggtcctcctatcctgggagcccagagcttcaggaaagcaaggctctagtctccggcctggaggggatggcatggagcagggttgtcctaaggacctgctggctgagagtacacaagagctaaagaagcagcagcaggcagcagccacagtaaatccagtattagctccaaagaaggctgaggactcagccccaggaaagatccagtatgaagtccatggaaggtcccaaccagaagaacaggggccaccccagagcccagcgtctgagaccatcaggaaagccacaggacagcaactgactaccaatggggcacagacctttggccctgatcatgctgaccagctgcctgctggtcagaaggagagttcccaggttctaggagttgaaccaggaggcacagtggctgaaccagtgggcccagcagccatgaaccagcttctgcttcaactaagggaggagcttgctgcagtgtggcgagaaaaggatgctgcccggggggctttgtcaagaccggtcatggagggagccctggggactccccgtgctgaggcagcagcagctgcctgggagaagatggaagcccgactggagcgggtgctggcaaggctggaatgggcaaaggcaggactacaggtgaaacctgaggttccttcccaggagtccagagagggagccctaaaggcagccccagggagcatcaaacaggatgaagagaaggagaaaagggttcctggggctcgaggagagcctctaggggcccttggaggggaaaaggccctaggaggcctggcaaagggacagctggagaaggagatgtcagtactgagactgagcaacagtaacttgctggaggagttaggggagttggggcgggagcggcagaggttgcagagggagctacagtccctgagccagcggctgcagcgggagtttgtgcccaagccagaggcgcaggtccagctacagcagttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagaggaagtggctgagctaagggcccgggaggcagccagcctacggcaacacgagaaaactcggggttcgctggtggcccaggctcaggcttggggccaggagctaaaggctctgttggaaaagtataatacggcctgccgggaagtgggtcggctgcgggaggcggtggccgaggagcgccgccggagcggggacctggccgctcaggcagccgaacaagagcgccaggccagcgagatgcgggggcgctccgagcagtttgagaaaacggcagagctgctgaaagagaagatggagcatctcattggggcttgccgagacaaggaagccaaggtgagcagctgaggtagccctggggagcactggggaaagtttctgtgtatttgggagtttactaacctgaatccagcaacctttattgcagcagtgggtcagattaataccccaaacggagcaccagtcctttgcagggaccacactactatgttctcgtgggtctgagggggttggtgagattggaggtgaggtaaggtataagtggaagagagaagggggcttaggtactaaaatttggcacccagattcagaagcagtgtgctcagggctgccaccagtgcagcaccatcgtttattagcatttggacttgaattgcatattagcctgggaagaggcctaatagcatgatgggttgctgtggttttactgaagttctgaggaggtcactcaagaactaatgagttaagaaaagtagacccagcgagagctgctcttctcgcctccacttcagggtgggttctacaaaacgatgtccattggcaaagagggcaccaatgcaaagaaaaaaatcttgaggccgggcgcggtggctcacgcctgtaatcccagcactttgggatgccgaggcgggtggatcacctgaggtcaggggtttgagaccagcctgaccaacatggtgaaacccggtctccactaaaaatacaaaaattagctgggcgtggtgcgggcacctgtaatcccagctactcaggaggctgaggcaggagaatcgcctgaaccagagaggcagaggtagcagtgagccaagattgcaccattgcactccagcctgggtgacacagcaagactctgtctcaaaaaaaaaaaaaaaaaaaaaaaaaaaagaaaaaagaaaagaaagaaagaaagaaagaaaaaaagcttgaaaaccactattagataccagagtttcctaatgcttgctctaaatgtgagtctacatgtttctatgagacatgttttatgaactctaaatatcaatttacacatggatttagtacttccagacttaaccgtgaaatgaatgatttcagacttcttattaaaacttggatacatggtcaaatttagaatgattaaaaaatataaaaaggccgggcatggtggcaaaaattagatgggtgtggtggcatgtgcctgtaatcccagctcccaagaggctgaggcaggagaatcactggaacctgggaggtggaggttgcagtgagccaagatcgcaccactgcactccagtctgggcaacagagcgagactcctccttctcctcaaaaaacgttatatatatatatataaaagaatgtatgttttctatagtgtggagtacataaaaatagaaggaatgttatccagaataggaatcagtgcgggttgaggttaattaaagaaagtatttttatgttgcattgaaggagaagttgaaagtagacaatcgggtgaaagcaaacatagtgtcatggttaagaatgtgttctctggaccaagattgtctgatcttgggcaagttatttaacatctctagtcctcagttttcttatctataaaatgaggataataaaatggttgtgaagattgcattaaataagaaattatatttatttaaaagatttggggctgggtgcggtggctcatgcctgtaatcccagcactttgggaggctgaggcaggcagatcacgaggtcaggagatcgagaccatcctggctaacacggtgaaaccccgtctccactaaaaatacaaaaaaattatccgggcgtggtggtgggcgcctgtactcccagctactcggagaggctgaggcaggagaatggtgtgagcccgggacgtggagcttgcagtgagctgagatcgcgccactgcactccagcctgggcgacagagccagattctgcctcaaaaaaaaaaaaaaaaaaaaatttggaactcttggcccatggtaagtactcagtaaaaggtagctatcattattcctactaccactattcctattactgctagttaccattaactgcatttgtgcctctgcctcaataagccataaggactcatctccatttcccttagtggtcagtagccaggagtaggttaggatctgataccaagttaagagcatcggccaaggagtcaaagagattgtggttcaaatcatgatttcatcacttattagctgtgtgattttgacaaattacttaatttagtctctttatctacaaaacgtagattataatacttccctcaggcggagcacagtggcttatgcctgtaatcccagcactttgggaggccaaggtggatggatcgcctgagcccacgagtttgagaccagcctggacaacatggcaaaaccccaactctacaaaaaaatacaaaaattagctgagtatggtggcatgtgcctgttcctgtgctactcaggaggctgaggttggcttgagcccaggatttagaggttgcagtgagctgagatcacatcactgcactccagcctgggtggcaggtgagaccctgcctccaaacacaaaacaggctgggcgcagtggctcacacctgtaatcccagcactttaggaggctgaggtgggcggatcacctgaggtcaggagttcgagaccagcctggccaacgtagtgaaaccccgcctctactaaaaatacaaaaattatctgagtgtggtggcgcatgcctgtaatcccagcttcttgggaggctgaggcaggagaatcacttgaacctggaggcggatgttgcagtgagcagatggtgtcactgcactctagcctgggtgacagagcaagactcagtctaaaaaacaaacaaacaaaaaaaaacaaaaaaacaaacttccttcagagaagtattgttcctcccggaagaaaagctgttttttttttaaatttttttaagttttcaatgttttatcatattggatagcagctttttttttaattggttacaaaacctaagcccatatacaaaattaggaacacatttagatgcctcttttgaaagaacattttagtctttttaaactgagttttaaaaaaataaaaacaatgcaatttttaaacactgttttgaaaacttaaaagtgcagcaatatagttagtttcctttatctacgaaatggggcaattccaattcagaactggtaaggtcacaaattgaatcaaggaaatgcatacaaatgtctgcactacttgatgctaatgttcacttaaatgttagtttgcactttaaaacatgagaggaaataggaatcatcacagtagaggcccacttttaatcataatgtgtgcaaattttaaaaggtaactgacaagtaaggaaagtccagaagaaactaaactggaaggggtatagttcacaatatcaaaaagatttggacttttaagggtttcaccgaagtttgtgaccttaattagcttttacgttgttattcctacttttagtgaacaccacacagaagaaaagctgttttgagtgttaaatgagacaatttgtataaaattggcacatattaaatactcagtaaaaggaagctgaccttgacccttgtgggagaaatgacttggagcctcattggttgcctctttcctcttggcctcagatcaaggagttgttgaagaagctggagcagctttcagaagaggttctagcaattcggggagaaaatgctcgccttgccctgcagctgcaggtatgttttggctgtcagggatggtgctggagaagaaggtcagcagtggaagtgatgtatatgtgggagacattctaggaattactgagggagacattctaggaattacagaggcctggctaggcagtggtccaggatgggccagtgatgggccaacgagcccacctggtactgctgaccacttcattgtgttgctcctcatgcttgggtgactgagggtggacatgtgacttcccattgatgttcattcccaggattcccagaagaaccatgaagagatcatctccacctacaggaatcatctactgaatgctgctcgggtgagcatggtggagttttgagggaggtatagacataaagctgagtatagggtattgcatttagggtccctctctcttctccagggtccctgtacacacttgctgtttctcggaaagctggatccagtgctaggtctctgatctcatttggtagatcaagagaggttgtgcatgaatgtgagaaggagaggtgtttccccctctgtttcaattctctggcctatagtaaggacttttcctgtccccaataccctttctcagtctcctcctggagccacttagtcctaaacaaggaagaagaggtaggtgtcttgctcccttgttaggaataataactacaaagaatggaacgaacacctattgtgtacctggtgctttgcttcatattcatggttgtaatcctcagagcaatcctgaaaagtagacatcattatcttccctgtgaagatagggaaaaagccatggagaagttaaatactataagtgaaggtatatagtaaataaatagccttccactgtaccacagaacctctccctcacctctctctctccattttctgttcttcatctccttttcttcctttcctgacatctacagggttacatggaacatgaagtgtacaatatcctgctgcaaatccttagcatggaagaggagtgaggcagcctcactgtgtgccctcagggatacgagattctctgttgtgagttgtgggttaagggtgatgagggaaggagtttgggagaaagggcttgggaaaggtgtatggaatgaaattagtcccttttgcccccgtggtggctgacaatggggagccttttggggcatagagcatttgaggtgactgagaagacagaacatggagaatcactgggtggagtcaggaatcagtgagcaggtggactaagggggctgacttatgagatggagactgaaaagaggggttgggtctggggtagggagatgccagtgaaagatgagtgatggtaggatagtggtagacagttgttccttagggcaggactctacaaaatccagaatctcttcactttgataccattcattcaaagagcagtcatcccccaaacctccccccaccccaatgcagatagtccccttctccagtccagatagatgagggtcccttttagcatgttgatatgagtgggaggagactgaggatatggaagtgggtgcatttcatctttgaatttcttctttcagggaataagaaaccctggttgacagaggcttcatcaggctgtggtgggcgggggtgttggccactaggcaatggtatgggcagggcttcacctgacattatggacctcagacctgagaacctggaccctggaatcagcatggatgagaccagaggaggtatggatggaaacaagctctatggaaaataaagcatgaggcaggacggggctgagtgtaattttttttttttctaaaggggagtggggaaaggaatatctttcatccctttattcttttctttttttctggaaacaaatattaacagtatgtctttattcttaaaaacatttttttacaagtagattttttttttgaggcagagtcttgctctgtcgcccaggctggagtgcagtggcatgatctcagctcactgcaacctctgcctcctgggctcaagtgattcttgtgcctcagcctcccaagtagctgggattacaggcatgtgccaccatgcccagggatacaagtagattttgttttttattttgcaaatagactttatttttaaagcagttttaggttcacaacaaaattaagcagaaggtacagagattttcatatattctctgcccccatgcaggcactgcctccccaattatcaatatcctcaccagagtggtttatttgttataattgatgaacctacattgacacattattatcattcagagttcatagtatacattagggttcactcttggtgttagagagtctgttggtttggacacatttatattgacatatatccatcattatgttatcttttttttgtttttgtttgtttgtttgtttgttttgaggcagggtcttactctgctgcccaggctggagtgcagtggcatgatcataactcactgcagcctcaacttcctgggctccagtaatcctccaactcagcctcccaagtagctggggctacaggcgagcaccaccacaactggctgatttttctgtatatttaatagagaccaagttttgccatgttgcccaggctggtctcaaactcctgggctcaagcgatccacctgtcccagctccccaaagtgctggggattacaggcatgagccactgtgcctggccatctctatattatcatacacagtggtttcgctgccctaagaatcctctttgctctgtctgctcatctccccatccctgctaacccctggcaaccactgatctttctcccatccccagttgtgcttagttggaattatacagtatgtatccttttcagactggtttctttgagttagtaatatacatttaaatttcctccatgtctttccatggcttgataactcacttatttttagtaccgaataatattccattgtctgaatgtgtcacaatttatttatccattcacctactgaaggacatcttgattgtttccaagctttggcacttttttttttttttttttttttttagcagagtctcactctatcactcaggctggagtgcagtagggcagtctcagctcactgcaaccgccgcctcctgggttcatgcgattctcctgcttcagcctcccgagtagctgggattacaagtgcatgacgccacatccagctaatttttttctatttttagtagagacggggtttcaccatgttggccaagcagtcttgaactcctgacctcaggtgatccacccacctctgcctcccaaagtgctaggattacaggcttgagccaccatgcctggccttggcaattatttaatttgtttttgaatgaaattcacaaatggccctataagtcagcaactttcaaactttttgatccctagtaagaaataaaaaaaattttttttgaggcagagtctcactctgtcacccaggctggagtgcagtggtgtgatctcagctcactgcatcctctgcctcctgggttcaaggtattctcatgcctcagcctcctgagtagctggaattataggcgtgcaccaccatgcgtggctaagttttgtactttttgaagacacagggttttgccatgttggccaggctggtctcaaactcctgtcctcaagtgattctcctccctaagtactgggattacaggtatgagccactgcatctggccaagaaatacattttgtatcttgtgtatacatagctcgaataatactttactatttctcttctattctttgctaatatactccatcaaaatgcatccactaatgggtcaagacccacggtttgaaaaatagccctcagtgaaaatggggtttgacactcttcctttccactttctcgaatctgtcacagctctaatcttttttctctgccttgggactgttgaatccatgatttttttttttttttttaaggggagattgagagacctggattttcttcaggatatactttctaaagtattttatcaagtgttaaacaatgtgtctatatttgacacacatggtctcactgttctttgtcccaggtgacaaaagggatgaaaagtctgattcctgggtagaggatgaagggatacccaagtttcatttttgcctgtgattccattctcagactgaaaaaaaaaatgtatctctcttggccacttcccctgggtctcctcctctgcctgcccttccaccaggcatgctgttaggtgaaaatgaggcagtgaattcctctaaaatctggaattgcagtttggtggcccgcacgctgatccctccccattccttctctcagtccaccctctgcttggttacactgggtcagacagcagcagttttggcagtaaagaggctgggttgagaaaaaagagtggggaggggctgccatggaagacagggggctacacaagggctgcagaggccagctccagagtttggccaagagtgaaaaagagcatctgagatatctggatcagatcctagagaaggtgcagaggttttacgtggatgggcacgggactgctttacggccaggaaaatggaaaaaggagggattgatggagaaagggggaagaggtgcagctattgaagaaagatcatcaaaagggtctgagtcatttctattaaggggaacagaacctctccttgccttcctgctctcaattaccaatgtatattaaaggactattacatttcttgttatatatgacgtgtggggtggggagaatgaagaaactgtagagagaagggtccagaaagggggagatcattgggctaaactcaagaatgagtcaggaagcagctttggtaatggaagccaggactttggctccctccggggctcctggaaactgattccaggatgggctgagctatgggagtggtgagtgatgttaatgttaacacaggagtagaaacttccttagcccctggttttcccagtctccctccctaaaactccacaaacttacctcaacagccccagtcttaaaatttttcttgagttcataaatttttttccccaaagtagctataatcctaatgttccctttattcctcctgggctctctaatgggacttagcagggacttatgattcctgcttcatctccccaccccattccccaggcttgagatgtaggagtatgtgggtgaaagtaggtgaaacccgatgggccatgatcaggttcagaccatgtttttgaatgccttcaatctggaactttgcttctgattcacagtttccctcctttggtaacattaatttattaaacagatatttaaggagtctactatttgtcaggcactgggaatagagtagaggcagcacagaaaaccttcttatccttttggagcttgcatgcaggataagattcaggttccccggttccgtcatcctgtagggatgctagaacttataacctcaaattaacttttttccaatttattttttctctctttcaataactttagtaacctcaaattaattttttttagatgtattattgctctgtcacccaggctggagtgcagtggtgtgatctcagctcactgtaacctctgcctccctggttcgagtgattctcccacctcagcctcccaagtagctgggactacaggcatgcgccaccacacctggctaagttttgtatttttagtagagatggggtttcactatgttggccaggctggtcttgaactcctgacctcaagtgatctgcctgcctcggcctcccaaaatgttgggattacaggcgtgagccaccatgcctggccttcaaattaacttttttcgtttgtttgtttgttttttgagacggagtcttgctctgtcgccaggctggagtgcagtggcacgatctcagctcactgcaacctcagcctcccgggttcaagcaattcccctgcctcagactcccaagtagctgggattacaggcacacgccaccacgcccggcgaattttttgtattttagtagagacggggtttcactgtgttggccaaaatggtctcgatctcccaacctcatgatccgcccacctcggcctcccaaagtgctgggattacaggcgtgagccaccgtacctggcccaaattaacttttaaaggagattcttccttcatgaaatcactagaactcaaggtgaggttttctcttaaatgtttacagctttatttatttatttatttatttatctagagatggagtcttggtctgtgccaggctggagtgcagtggtgcagtctcggctcactgcaacctctgcctcctgggttcaagcagttctcctgcctcatcctcctgagtagctgaaattacaggcgtgcgctgccacgcctggctaacttttttgtatttttagtagagacagcgtttctccatgttgaccaggctagtctcgaactcccgacctcaggtgatccgcccacttcagcctcccaaagtgctgggattacaggcgtgagccaccgtgcccagcatttacagctttacttattttttattttattttattttatttttttgagacagagtctctgtcgcccaggctggagtgcagtggcgcgatctcggctcactgcaagctccgcctcccgggttcacgccattctcctgcctcaacctctccgagtagctgggactacaggcgcccgccaccacgcccggctaattttttgtatttttagtagagacagggttttaccgtggtctcgatctcctgacctcgtgatccgcccgcctcggcctcccaaagtgctgggattacaagcgtgagccaccgcgcccggccatttacagctttattgacgtacaactgatatacgtcaatatgtctctccatgtaaaatgcatgtatttgaagtatacaatttgatgtgttttcatatgcatatacacccataaaaccattacacaatcgagataatgaacatatccatcacttccgaaagatccccgctttgtctctttttaataatcctccctaccttcctcatcctgcaactactgaaaattcttagaaatacaaactatagtaacttttgatctagaggactgaacagaacaacagcaaaaaagatctcaggacctgatgaagactcaggtgttggaagggagcagctggaatttagaactagttgagtctgagtttagcttgaagcgctcaccaatttgggtagcaaagcagcaaggaaagaacctgagtgttaggagagggtggcatcttccctagggacaaaaaccacaaagtaactgggcctagttccagttcaactggcaccttcaatctttggcctgggtagggtcttatgaggaggattatactgaaggcttaagctaaataaaaggatttttcctatttattaaagcccttttttggtgtgctgattataggtttaacatgtcttgtctctgctgctagactgtgaactcctgcaaggcttttatgtcctcagcacctaatgatccctgataagcactcaaatatttattgaacaaatatgcagccaactataaaatgctgtgagtttctcagtatgtagtgcgggtacatttcccttaagttggtattttctgggtcaggcgcggcggctcacgcctgtaatcccagcactttgggaggccaaggtgaggcgggcgcatcacgaggtcaggagtttgagaccagcctggccaatatggtgaaaccctgtctccactaaaaatacaaaattagccgggcgtggtgacgcaggcctgtaatctcagctattcgggaggctgaggtaggagaattgcttgaacccggggggcggaggttgcagtgagccaagtcgcgccactgcactccagcctgggtgacagagtgagacttggtccccccccaaaaaaataaaaaaataggtatttccatggatacagaaacagatttaatttggtgcctgcatgtgagtgatcagcttggttgggatggggcctctggagggtccaaggctttggaggaaggagagtgggtaggcagttcagagagggacagaaagatcccttttgtgggtaagaaaacccctctgttcatcttcagctacaccaaaggtatgggggctctggtggaggtattctgcacgtgtatctagggtagttactgttaggtacactttggattcagtaccccaggctttgccctagggagggacagttgtcatttcaaggaagactgctttatactgtcagatacctggttcacaccggcttagcagcagtgtgccaccaccccaatcccatacgtaagcgttgaggggtcacagaggtagtgagaatgatgggatccaaggatctcgtctctccagatccactcacaccaggagttaatctctccaacgtcgagctctgagtccctccctctctcgcccgagctccgccccccttccctcttggcggtcctggcgggcttcccctggagggggcggccccagcccgagcgctaggcggggcggagctccggcccgggcggagccgcggccgccgcgtccggctgctggaccgaacttctgccgtgcggacagcaggagcagcgccgagccccattcccccacctctccagctcgccctctgagcctcccgagccctctctccatttcccacaattgtgctggtaagtcccgctccccgcaccaaacttttttttgctgccgagtttgagtcctacgatcggaccacgagctgcactgtagttggtgtatgggggaggaggagagggtgaattactgaatgccgactccacggcttccctaagacggatcagcgctcgcccatttcccgagttggaagacctctcgattttagttgattaaacttatgcagagatggagatgagggtttgcgctccaacttcgctaccccctcccccatttctctgagctctagcagttcccgatactttccctccatctttcaagtatctttggctccctaaaagcttgtcccctcccaactctgccgtggcaaagcccccctccaccaggcacttcgggcccgcctcctccccgttgccctagggaccccgcgatcttgggggccatacactccctccggggctacgcgtcctgccaaccggccgcagacgtgtagctgctgggtcggctgtggagggaggggctcaggctggggcttgtccgaagccaggcgggcggggccgggaaggggaggtatagggggccggactgggcggagcaggcggcatttgcggccggcgccagggtggagagttgtgcgccggtccctgggcctgagctccggctccggctggggcgcctgcgatgtctcaagatggcggagctgggcgaattaaaggtaccggccccctccccccatccccatctggactcagcccggcggtacgccgtgtccgggaagcgaccgagactgggtgccggggctcgggtgggcgccgacgacgtggcaggcacgagctgctgaggatgggagagaagtagctgagagcgaggaaggggctgcggcggggctccgggggcggggctgcggggcagatgtaggggtggggccgaggggaattgcagctgttgggggctgaggcgcagggggcggggacgaggggtagaagtcggatttagtagtaggggcggttgttggggtagggccagggggaaaaggtgctgtagaggcactgggggcgagtcgatcaaggccaagagatgcaacagtagggggcacatgcagggatgggaccgcggggcagacgtaggggaggctccgggggaaaggcagctgagaggatagggtctttggggtactctcgggatccgagctttgggaaataccagtaggctgctgagatgcagggggcggggctgtgcgggccgatacctcgaggggtggggcagaagcatcctggaggctcagaggaaggtcctgccgtagtgaatcgcggtgtttgggaagaggcagaggcatgtgaaactatgggatagaaaggtgggaagttataggggaagctaatggagaaaaaaagacaggacagaggagataaggatggggagaaagaggagcaagtttctcatcacattccataaaaggggtccaagacaaagcctcctatgagaagaattgtgtagggctagcaagccctgcacatgacaggatctcctagagattcacagaagggagtcttctaaggagagcgctcccctcctgctacatagagtttggagggtgaccacatctgaggacatctcatagaacctcaaactaccgagttcatccgcctgcctcctggttttcttctgccctttgaaatgggagctatggtcctgggaaggctggaggtctagccactgggcccagctaccttcaggggatttgcgattctgtgccctgactcagaggcttttccttcatccacccagggtctctgtttagagctctgccctctcctcttccacccctataggggggcgctgtaagttgtagaggagtattaatttctctgtgtaggagagatgccagattatggttcctggcagatagagtaaacaggcaggatacttggactcagtgattcactgttaatctccccgacccaagttttggtcctgtttcccttccagaaaaataggactaagttgtggggagggggtggttatataaacgattccaagaaaggatctggggaagttatgagcattgaaccctgacctgaaaaccctggccacagaagcttcagaggcttgggggaaatagctgaggtgaattaaggtggttgggaggggtgggctgaagggcacaatcctccagccacctagcccctttcttcccctggggctgtctggcttgaatcctcttgtctctccctccttctccctgtctcctatcctgttcccaggaggctgggatgggtttgagagtctgagaaagggcaagagaggagataagcagcttaaagcagagtccagggatggaggcgggaggctgcatggactcggaggtgtgtctgagggtggcttgctgtctgccattccctgccccactctggctgcttccaggcctggggaaatagtgttgctcaagctcgggggtggtggtgatgatgctgacctgatggttgctaaagtgggactgagatgtccctttggataggtcgactacctggcagtaatccactagctgcgaagcatcatctttcccatcagtgctggagagaaaggcactgcccacctggtagctcagcccatgtcttggcagggcaggcctgtgcaagggaggatgctcaagcttctctgtttttctccacagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttggtatggctctttgtggtcccttagtcttctggactccctacctgttccccaaacatttcttaggctttagtcctatgggatcagtgacctgggatgggggcgatttctgtggctgcctgtgcatgggcttggaataactgcccctttgtatcctcagcatccacttctagccagcggtttgaggaagcgcactttacctttgccctcacaccccagcaagtgcagcagattcttacatccaggtacatctcttccagtcttcctgcctcatccctggtctctgctttctgactttcttctcttctgccctgtgctcttccctatccctcctcctatacctacttgtctcttgttcttctgtgtgtctcttctctatctcctggacatctgactttcagcctttctgtgcattcacccttgccctctgggggctacatgctgacatctcttcatctccctccctgttacagagaggttctgccaggagccaaatgtgattataccatacaggtgcagctaaggtgagttcatcctccctgcctatcctgggtacccactgggggtaggagtgaagtaggggtatgacagatacccttacgagatgtccctgctctgccactgcctactgcagccctgcgactcttgttggatgctgagggcttcaggcatctatgactgattttctggggttccctgtctctctgccagattcaagttaagaaatttcttcccactctttcttcctttctcatctcttaccaggttctgtctctgtgagaccagctgcccccaggaagattattttccccccaacctctttgtcaaggtcaatgggaaactgtgccccctgccggtaaatgctctccccttcttctgtcagtaatcccttaccgtttcagttcataaatattaactacaaacctattctgaaagagacatgcctagcacagtgcgtggcacatagtaggtgctcagtttactgactgaatcaatagaatctcgagagtattaagatagggctgaacaaaggttttgtgagaactcggaggaggacattagttcaacccgagatgtaagaaagacttcttttttgttttttttttttgagacagagtcactcgctctgtcactcaggctggagtgcaatggtgcaatctctgctcactgcaacctctgcctccctagttcaagcaattctcttgcctcagcctcccaagtagctgggattacaggtgcccaccaccctgcccggctaatttttgtatttttagtagagacggagttttaccatgttagctaggctggtctcgaactcctgacctcaggtgatccacccacctcggcttcctaaagtgctgggattacaggcatgagccagtacacccggccagaaagacttgaccccagagctgagagttagaaaaggtgaggcatccttattcctcctcctcagggactcagtgagttccttttttctcagtcaataaataagctctcctttctccccaggagtgaaccccacacataaccctagacagtgctccagttttgtgagccactgaatgggcctccatccccttggtcagtgagtgagcgagttggccttccctccagggattgaataacccgagacaagatatcttttgttcaaagagcagagccccttcccagagccacttctccactgaccaatccctcccttctccagggttaccttcccccaaccaagaatggggccgagcccaagaggcccagccgccccatcaacatcacacccctggctcgactctcagccactgttcccaacaccattgtggtcaattggtcatctgagttcggacgggtgagcacagctaaagcaggtgcctggaaaagcctgctgagggtgaaggggaaccatccagtgtcctgggttggggaagcattttcctctttatgagtctgtctctggtcctcatggaacaaaagtgggcagtggtggtatgagaagcagaggctaattgtctaccccctgcctccaagtagaattactccttgtctgtgtacctggtgaggcagttgactgcaggaacccttctacaaaaactcagagcaaagggtatccggaacccagaccactcgcgggcactgagtgagtaacatctttcctctcttccccacctgatctggattcaagtcttcctggccctccagccttcataattaaacccatacctcttttttgacaacttactccccttctcacatgaaccccaaccctccccctctacccctgaccagtcttccagtctttatagttgaagttggaccactcccaggcacccttgaatttccaatcatgtatctgctttgcacctcacagtccctaactccagccctgctagaatatgggctctccggactggaaagaatcttaggggtcctctaatctaaccctcacatgatgcttcaactcctccagatcatctctaacatagccagagtgtcacgctatgtttaagcatcttcagggatgggaaaatcccccacacccagccttcatcatccatatcccagaccacttccatgtgacgtcccactggcccccaaagacgctccacccagcagcctctcagccagagccatctgttcctggccttaccaactcctgggcttcctccagccttgctgaccccatggctctggcctcacttttgtttcagtcaaggagaaattgactgctgaccctgacagtgaggtggccactacaagtctccgggtgtcactcatgtgcccggtgggtaaaaggggagaagggaacagggtgggaagggagttgggtttagcctgtggactttgatgagggttcctagggatactggcgtgaagttttctgggatgaaatcagagtagggcctctgacaagagaacttgcttctcctcagctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatgggtagggccattttgcttcctcttacctaggacatccactagaacctcttttcttggttatttctttttctttttcttttcttttttttttttttgagatggaatcttactctgttccccaggctggagtgcagtggcacaatcttggctcactgcaacctccacctcccgggttcaggcgatactcctgcctcagcctcctgagtagctgggattacaggcacccaccaccatgcctggctaatttttgtatttttagtaaagactgggtttcaccatgttggccaggctggtcttgaactcctgacctcaggtgatctgcccacttcagcctcctaaagtgctgggattacaggcatgagacaacatgcccagcctataatatttcttttttcttttagccaccacctccttcagggtttttaattcatatggcttacttcccctcacatgaactgcaattctcaccttatctatcccttttaccagtctgtgtgtgtgtgtgtgtatgtgcatgtgtgtggagggggagggcaacattaaggacttagtatatacaaggcatcttgctgagcactttgcatgagttatctcattgaatcctcacaataaccctatggactcggctcctacctgtaattccaacactggaaggctgagatgggaagatcatttgaggctaggagtttgagaccagcctgggcaacatagtagaccctctctctataaaaaattaaaaaaattagccaggcatgttataatagctcatgactgtagtcttagctgctcaggaggctgaggcaggaggatggcttgaacccaggagtttgaggctgcagtgagctatgattgcattactgcaccccagcctgggcaacagattgagaccctgtctcaaaaaaagaaataatcctatgattggctagtgacactcacccagaaaaaaaaaaagaaaaaaaaaaaccctatgagataggtagtatcattacacatgaggaaactgaggccgagagagattgagccttgctcaaggttatattgttaagtggcagagccagtgtactgaactgtcataatatatcacctataacaactacctgacttcccactgagcattgcaataaggttcttttcagggcctggatgttctaatcttttgatcttgctagtcttaacctctttttggaatctacattatggttcctgttcccagtgctcccccactttttgtttgtttgtttgtttttgagacagggtctcgttctgttgcccagactggagtatagtagcacaatcatagctcactgcagcctcgacctcctggcctcaagtgatcctcccaccttggcctcccaaagtgctaggattgcaggcatgagctaccatgcctggcccctagtgcctttatttatttatttttacacaagtgtttagaaagccaaagacccagtgccttttggagatggtttatggacttctgtgtctctgctccttttgttccttatactacacgtaagtgctcagattttttttttttttttttttgagacggtgtttcactctgtcacccaggctggagtggtatggcacagtctcgtgatctcagctcatgcaacctctgcctcctgggttcaagcaattctcctgcctcagcctcctgagtagctgggattacaggcatgtgccgccacatccggctaattttgtatttttggtagagatggggtttcaccatgttggccaggctggtctcgaactcctgacctcaggtgatccacccacctcagtctctgaaagtgtgattataggcgtgagccaccacgccggctttttttttttttttttttttgaggcagagccttgctctgtttcccagggtggagaacagtggtgtggtctaggctcactgcaacctctgcctcctgggttcaagcgattctcgtgcctcagcctcctaagtagctgggattataggcatgtgccaccacacctggctaatttttgtatttttagtagagatgaggtttcaccatgttggccaggctggtcttgaactcccagcctcaagtgattcacctgcctgtacctcccaaagtgctgggattaaaggcgtgagccactgcacccagcctcagattgtatttattttaaaacctattacttactttgcaaagctcttttacataccttgtgttatttgattccaacaactcagagcggtccagtaggatggataatgttcttattttacagatgaggaaactgagatacaggaaggtgagttacagaactctggctactgttctgctcatctcccagccccgtgaattttcatctctctcttcccccagtttatttatggagattcttagttcctgttcagattgtgatgagatccaattcatggaagatggatcctggtgcccaatgaaacccaagaaggaggcatctgaggtttgccccccgccagggtatgggctggatggtgagtgaccccctgttccccagctaagctaaatcttggatggcctcttctctgagacgtagtcttcttaatacccacaggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaagggtatgagaaaataggctgagtctacagcaaaacggacaggggaagaagtcaggattgctttctgatcattggacaaagcctggggcaagagaaatgtggaggggacagagagggaacctggggacctgagctgggtgagggcatctgtggtttgctggctgcctcagctcctctctacccacagagtcctgacatctggccaccagccatcctcggtgctaaggagccctgctatgggcacgttgggtggggatttcctgtccagtctcccactacatgagtacccacctgccttcccactgggagccgacatccaaggtatgacatgggtcataagatggaccctgcactgccacaccctccccagagctacatcagaacccctgttccttctcaaagcctcctgcttctcctgcaaggggccacagtccacagtgctttgtcttttggtggtaaaggggtcagataggaggttaattttgatttttcttttcctgccaggtttagatttattttcatttcttcagacagagagtcaggtaagtggttctttcttcagaaggtctcagatctctgaagcttcctttctagacactgatggggcccctccctctcttatgatctctggggatgtaaatctgctttcccgtgagggcagtggggtgtaggtatcttattatctcctcagccccactggtagttcctgagattcctacttaggcctccttcctagatcccctgttacttttctgccctggcctactcacccctacccccgtgtgcacttagagcaccatgcctgctctaaccggacattccacacatttcagacgcccacaaagccaagaacctaacaagttggaggagctctctcaaggcagggaaaggggaagggtgtagggaagtaggggaaagagggagaggctctcctgcttctcaagagaataccttcggatccacaggggttgattgctctcatacggcatttctgagatgagtgactgggaggtggggaagtcaggattgagatcttaaactatgcccttgattcttcctagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctccatttatatatctaagttcacagtgtttcttattcccccctaagcttctagaggctcatggccctgtagttaggcctggctcattctgcaccttgccagggaggtggaaggaccctgtgccctccttcccaatcttctttttcaggctcgccaaggcctaggacctatgttgtaattttactttttatttctaaagttgtagtgaagctctcacccataataaaggttgtgaatgttctgtgagtgtcatggagatgggctagggaggggattttacacttcactttccagacccctggtttgggggaagagggtccatgttccattcttcctttgctggccctgggtccaggtaagctgcacttttacacggtgggggtgttctgtggaggaattccaagagaggttgtcctttcctgctttcccccgtgcctgtaaaaactagaccattccagcccagtactgtggagctctccagtcctttttcacttttacctgcccagatgttgcagccagagcttgagggcaaacttggttccagtgctgactctctctttgtcctctgccatggttgggatcatccgcaggagggtggacatgtgcaggaccagaggtcgggctcttccatcctcctctagttccactgcactgcatggtgacaactcctgttggggctgtgccttgtagcttacaaagaacttacatatatgttaggtccccgaatcctcccaactaccacaggaggtgggtgggtgttgacctcatttgcagaaaggaaacaggttcaaggagggttaaatgacttgcccctgtgttagaactgacacttagaccttcaatgctagccagttagagcaagaatctttggggtttgatggtcagtgtcttagatttcatgtaccttcttaattatcagctgacccactctccttaaatctcccccacaacacaaaattccatcctgaggacaggatagacgctgaacttctcaacatgaatatgttggtgtattagaggctgagggagaagctcttacttacaggacagagggtggtaggtcctgggggagaagtccgggtgtctctgtcccatcctctgcggcagccactgcagcagctacatctggtgtcagccacataagggcgctcacctcatttgggtttggttggatccgggcctggggtcagacatggtgacccctcagtcattgcctctccctgggctgcctgttcgtgatcaaaacctacccgcaggtttcatggagaaaggcaggagcaaggggaaagggcattgcatattcttcgttatctctgactacccccgccacccccgcccagctcctaatcacagtcagaaccaggttgcttgggctcccctgagccctgtttccttccctcactgccagccctacctgcaactgctgctgtgattcctgggagatcacgagtagatacagaacaatgtgatggtatttgggtaaaccccagctcagcctaggagggtaggcagactaggaaaagaaaacagcaaaagtgagaactttccgtcactttttttttttttttaagatggagtttcgctcttgtcgcccaggctggcatgcaatggcgtgatcttggctcactgcaacctctgcctcctgggttcaagcaattctccagcctcagcctccagagtagctgggattacaggcgcctgccgccacgcccagctaaaatttttgtatttttagtagagacggggtttcgccatgttgtccaggctggtctcaaacttctgacctcaggtgatccgcccacctcagcctcccaaagtgttgggattacaggcgtgagccaccgcacccggccctttgtgtcactttttgagactttgttaatacagctttagggtgaaacaaaatggtggccaaaagctgagggcgtggatggtacagatgacacagcagggacatgggtgagggttatggatttggggattccagcccacttatgtgctattgtttcccttgtagccaaggcaggtaggggctgatctatggaggagcttctcccagctacttgtctcacctcccataaacccagagggacccaagagaactggccctggggcaggtgtagtccactctcctcccaaagttctcgaagccctccgtccagcagctgggagtcagagaagacacatcagaggggccagtgcctgactcttccaagtccttttgcttgcccctccctcagcccacacccaagatggtcccaggcatgggtctcttggctcaggttggatcagctgactggttacctcctcctcaagttccacgtgcccacctgcaacaacagtggggccagtaggtgaatggtggtggtcttggccagggagcccccactcactgttgacactcctctcccctccagtggacacagagggagttgcagtcccttgtgactatgaacatgccacattttggggcccactttatccttctgagactgggaaaaacattgttgcggggaaagggcaaatttcttctctgtacttggggccttgtccccagaatactcacccgggggtacccagaggttgggggaaacgctcagggtgcgtgcccttcgggttagcaagacagtcttgtcgctggactgcagaatgacggccacacccaggtccacacctcgatctgtgggcagctcagccccagggaccctgggccgctcctccagggccgcaaaagggcagaaagggggtcgctggcagaaggaagccagctgggttaaggcttcagaagggcggcactgggtgggcgtgacttccaaaaatggggctacaccgcgcgttgggggcggggtcctcgccgccagttcccacccgatttcagtccccatctttggcccttcactgcccccgctctggggcccccttctgccgacctggagcggaagcctagcggaggcgcctgggaagggcctgctcgagaggacaagccgtcctcgcttcaagctgcagtgaatgggccacgtcccgagccctggtccggctcccaggaggccacacacactccgtgcgaagctcaccgactccggacgccgggacaggagcagctgcacccgcacctcggccataacgcgactctggagtcgctgcggcccgcctggcgccctctggtggcctagagaagcttccccacggaacgttccgcggggtcgtagcggggtttccgaaagtccccggggaaataagggcacatcttttgaggatgacccatgggtataatattaaaccacaaagaagaatacctctaaatgctcagctcctattccttcctatcttctctgtttaggacaatgacccccagaccgactgacttcaggacccacatgttacttccaaccagccctaagctgaactgtaagcatcctctacagcactatgcacacctgttacagcaggcatcacttcgaattaattatctccaagcgaaacacaccaaataacattttcgataccacttctcctttcacttcactcaaatggcaaccaagtatgcagatgctatctccttaaacttcctcaaacccatgttctctccagccttcattcattgccctagtttaagccttcctcgtattttgcctgaaatattattgcaagtctccaaatagtcttgaccctaccagttcattctctacagtgctgccagagtgatgttttgttttgagagtctcactctacagcccagacaggagtgcactggtgtgatcccagctcactgcaacctccatctcccaggttgaagcgattctcgtgctttagcttccgaagtagtagctgggattacagggcgcccaccaccacgcgcggcctttttttttttttgagacggagtctcgctctgtcacccaggctggagtgcagtggcgccatctcagctcactgcaacctccacctccctggttcaagcgcttctcccgtctcagcctcctgagtagctgtgattacagatgtgcactacccacacctggctaatttttaaatttttttgtaacgatgaaatctcactgttgcccaggctgttcttgaactcctggcttcaactgatcctcccagtgtgttgggattacaggatttaggcaccatcaaaattatcttctagctgttttgaaatgtacagtaaattaataactatgccaccctgatctatccaacaccagtcttacttcttcaaactgtattatctgtgcccactaatcaacctctcttcatcctccccatccttcctagcctctggtaactaccaatctattctttattttcttgagatccacttttttagctcctatgtgagacagaacatgcaatatttgtttctgtgcttggtttattttacttaacataatgacctccaattccatccatgttgctgccaatgacaggatttcattcattcttatggctgaataatacattttctttagcctttcatctattgatgggcacttaggttgattccatgttttggctatcgtgaatactgctgcaataaacatgggagtgcaggtatctttttgatacattgatttctttccttttggagatatatatatacccagtagtggaactgctggagcatagttctgtttttagttttttgaggaacctctgtagtcttccacagtggctgtaccaatttacattcccaacagtgtaccaggcagggctctcctttttccacatcctcactagcattcattctttcttcttgataaaagtaatgaattggggtgagatgttatctcattgattttgatttccatttctctgattagtgatgttgaacattttttgatgtatctgtcggccatttgtgtatcttctttcgaaaactacctattaagatcttttggccatttttaagttggattgttctttttgctattgtttgagctccttatatattctggttacgaatcccttgttaagatagtttgcaaataaagcatcctcatctttcaaactatacattgtcactctctgtgttcccttccctgcctgacccttttccctttctggcctctctgtacatagtgtttactcttctactgtagcacccctaatacttcctggtacttatgtacttatttgtctcctcctactagactgtatgctcaaaatttattaatctttatatccccaaggcttaccccagtacttagcacaaaacaggtgcttagtaaatgatggtgactggcttgagggcagagatggtgtcttatttatctatccttgtatgttgtgtttagtatggtggctggcaattgtttgacactcaagtgtttaaacaattagaaaacacattggtgagagaaaactgaagatattataaaacaacatctaactgctttaaatgaattaaagctgctgggacaaattatatccgtgatactgagagagagaatttagcgttgccagttttaaggaaccatggagaagaggaaggcgctaatttactgtgtgcttaccatatgccaggcattgagctagctgttctacatacacagtttcagatgtgttagaagcctggagctggcaaatgtggcttcagtccacagattctagtgtgactgcttgggacaatccacctgctaaccctgaaaataattttttcttctactctgtgatagtctttcacattccctacactgtgtgtgttaaaaattacagttcatcagcctgggcaacacagggaggccctgtctctacaaaaaaaaaaataaataaataaaaaatagctgggtatgtgtggtgcatgcctgtagtcccagctactccagaggctgaggtggaaggactgcttgagctcaggaggtcaaggctgtagggagctgtgattgcgctattacaccccagcctgagtgacagagtgagatcctgtctcaacaacaacaaattatctatcatctatctatctatctatctatctatctatctatctatctatctatctatctatcacctatctcaacaaaataaagaacaggcatagacatctgaaaataaaattaacttcttaggaagtttcctattgccagggatataggtaaccataggtgtgggtaacttctttatgggaacagatgcatctgatagatgattaaccttgttgatttaaggttcttcccactgccaagatttgatgaggggagactacagcaatggatctaaatatgccaaattctttcaggtgtatcctgggctgcaggggatagagaggggggtttagttgaagactctgcgacttatcccactgcaaataatgcatccaggcacctcctttattttgctttccatccccccagatcttctgaggaagatgcttcttctggatcactgtctcttcatggtgcactcaatgtaagactccagcaggaagatggtttcgtccacctggatctcactggcatccaacctgagtgaaaagtaaaggcatttgcctagactgaatgttcattagcatatttaagattagaggttagggtgggtgtggccatggataactgcttggttacccttgagagtggatggaaagaaagcaggagaaccagtagatcattttgctatttaccgagcatctttatgtgccagacaccatgcaaactgctaagaatacaaaatacagagcctctgtcctgggggaaggtagtcttcatttgcaatcaggaaaacgaacgtaaaggcacaggtataaaaggacctagtgtgttttaaaatagcaagaaactaagagtgtctgaagcttaaagtgagtggtgattaggaagaaatggaagcttcttcagcctgacaaaagccatctaggaaaaacccacagctaacatcatacttaatggtgaaagactaaaagcttttctcctaagatcagaaacaaaacaaagatgtctgcttttgtacttctattcaaccttttactggaggttctagccagggtaatggggcaggaaaaaaaaaaagtaaaggcatctagattgaaaagacagaagtaaaactctctctattcatggatgacataatcctattataaaaaatctcaaagaatctgcaaaaaaactactagaattaataaatgaatttagtaaagttgtgggatacaaaatcacaacacaaaagttggttgtttttgtataacactagcaatgaacaatctaaaactgaaataagcgaccactaaactagtatccaaaaaaatacttaagaaataaatttaatgaaagaggtgcacaaattgtgcactgaaatgtgaaggtctaggaaagaggtgatgaaggcctgcgtgtggaccaagatgaaaggccagatttgagacacatgactcaagtaaaattaagccagcgcagtggcacttgcctgtagtcccagctacttgggaggctgaggcaggaagactgtttgaacctacgagttcaaggccagtctgggcaacacagccaaaaccccgtctcttaaaaaaaatttatcagtacttgatgaacaagagagtgtatatggtgatggagaagaagctcagaacatcttcagaattgctagtttacaaaaataggtggattaaattctgttaagtgagctggaggagacagtgagtttaggtttgctcatgctaagctggagggttacaggaggtcaaaatggattttctggatggtattctgaaatgcaggtctgaagtttatgatgcttacttgttgacattacgtttcagggtctctagctgctgacgttcaggagctgtgatcatctcctctatttcttgtaactgtgcttcctctgcaccagtagcctgcatagatgcaatgatggcttctaccctctgagatttttctagtagacgcctgtcaaacaaacacaactctgagacatcttccctaacctgggagattctcttaccacgtgtgtctgaggcactacccaccaccctttaccattttcctgatcaaagtagataatgtcaccttctaaggacattttctacaaacttatttggaaatataacttcactcctgaaattcttattgcctctcatttgcacttaaaagtttggtgcttttgtacgtttctcacaaatttaatctgaaaaattatttcactgggagcatgttagaaaagtgtagactaatgcatgatttacactaatctaagccaatgattcaatgcaagtagactggttgctatctctactggttcctacttctcaaaaaaaaaatttttttttttgagatggagtctcactttgtcgcccaggctggagtgcagtggcgtgatcttggttcactgcaacctccactcactgggtttaagtgattctcctgccttagcctcccgagtagctgggactataggtgcccgccaccatgcccagctaatttttgtatttttagtgaagacagggtttcaccatgttggccaggttggtctcaaactcctgacctcaagtgatccacccgcctcagcctcccgaagtgctgggattacaggcatgagccaccctgccaggcccagcgtctattgattcctatttctagaggaaatttcccctgaggcccttgatcttgaaagatgtaaataactcaactgaaaatgttacttacttattctctttggtttcaaattgcctcctttctatcaagttggctatgctctgaggaaagagaagacagacaaggaatgcacatagttctatttcagcagctcagggcgaagtgggcacatgaggggtacttgaccgtatggaggaaatggggagaaggtccagattgagttaccttgtagcacctgtgcaacaacattcgggcagctgacaggatgttcacagtatataaatagaaggtcctggatggggcatggtctggtgttttgggaatttcctatttgtccaatagaaagaaaaatagcagaaattatactgttttagaactggcaaagcacacactcattctacctggagttacttagccctcctttttacttacactttcctgtttcctagtcattcagtacctgtgtttattttatttatttattttgagactgggtcttgctctgttacctaggatggagtgcggtggcgtgatatcagctcactgcaacttccacctccggctcaagcaatcctcccacctcagtcccccaagtagccggaactacaggcatgcaccaccatgctccgctaattttttaatcttttgggggtggtggagacatggtctcactatattttccaggctggtcttgaattcctgggctcaagtgatcatcccgccttggtttcccaaagtgctgagaatacaggtgtgcccggcccagtctttgtggtttatgtcataatcagtcaaatggagagctgggcttccctgttttttccatttgactgtcagcatcctgagctggggaagaaagggagggcaactaacatttactgaacaactctatgtgccaggtaaattctatttgatctttacaaaaaatcgtattattattatttttgagacagagtcttgctctgttgcccaggctggagtgcagtggcacaatgttggctcactgcaacctctgcctcccacgttcaagcaattctccttcctcagcctcctgagtagctgggattacagacacacggcaccacgcccagctaatttttgtatttttagtagagacagggtttcaccaggttggccaggctattctcgaattcctgacctcaagtgatccgtccgcctaggcctcccaaagtgctgggattacaggcatgagccaccgcacctggcaaccatattatttttattatcaccatccatcactgttttatagatgggaaacgtggtaacttgcttaatgtaactgggtaaggcagagctgtaatctgactccaaaaatccattctatctatttactcatatgctctactaaatagccctgcaaagactcagttagatgtgttgataaatttaaactataacagaattaaggcttaaggaaggacagaaatgagaagagaaaaaaaggcagggtgggtttggggtgatgtcctggctctgcctcttttttgttttttgttttttttgttttttgagacagagtctcactctgttgctcaggctagagtgcagtggcttgatctcggctcactgcaacctccccctcctgggttcaagagagtctccttcctgcctcagcctcccgagcagctgggactataggcgtgtgccaccaggcccagctaattgttttgtattttattagagacggagtttcaccatgttggccaggctggtctcgaactcctgacctcaagtgatttgcccaccttggcctcccaaagtgctgggactacaggcgcgaaccaccgtgcccggccacctctttctcactagggcagttaaggccccaaattatcctccaagtgctcgctatgtctctgtgaatcatgtttttctgtctcagagctggatatagagtttgcttgggggttcagtatgtttgcctaagaagcttctctcaccctaggccagctttgctggttggcaattattacgcccttggttggttacctggagtgacatgaaattttctgagagcatcttatatagcatatcctttgcctcctttgcaggaatcattgcaaagtcttccacttgcttctgctctatgtgtttcttctgcaaaactagacggaatattctagcacagcgagacccaaatctggaaaggaatgaagaaagcaaatggcatgctaacatagatcagctttagttcccagtcacagatggggtggttgttctattccatgtgtgaagccagtaccagacaggaacagtgatcagaaaattattctacagctccataggttggtgatggtaaggcatcaccaactgctgttaatcataaggcagtcaccaactgctgactcatttgagtgccacagttcctacatttgtaagcaaaggctttagggaggctggttaatttgcatcggtaggaattaaacagtaggttattttaaggtaaagagcagtattacatgagatccataggagtccagtgaaaaaatggggaaaagtatgccaaggtgtggttatattggtggcttacataatgatcaaattacttcactggggataggaagtatgtgatcccaaacccaaccagtgtcccccttacctctcctgtacgacggactccagagtggctgtggctagggatgctaatgccttatggaggtctttatgtagagaattaaggtcactcagtaatgttttggcctagttattgtgatctgagttttattcctaagtttctaatttataattaaattttaaatgctattttgtttttcatgttataatttatggtttcagtcatggtacataaatattccaaaactttaatacaagtgtttaagtaagggttttgcttaactaaaatttggttgattaaaagtcctttttccttttcttttttgagacagggtcacccaggttggagtacagtggcatgatctcagcttactgcaacgtctgtctcctgggctctagcgatcctcccacctcagcctcctgaggagctggactacaagcatgcatcgttacatctggctagtttttgtatttttggtagagatggggttttgccatgttgcttagctgatcttgaactcctgggttcatgcaattcacctgcctcagcctcccaaagtccaccatgcctggcctctttttacttcatcatcaatgcagttcactgaaaattcatagaaaaatttatttaacaattacttcaattttctaatttatttagtataataaacattaccaaatctttctttcctaaggcaccattctgatttataggtcaggctgcctgactctaaggaaataactggtaaggatactgatgacatacattcctccaccactgtcgccagactttccaacaaactctagctattaagaaaaagagagagtgttaactgaacggaaagtccagtgattctgtttccaatggaacaaatctgaccaaaagtctgcagcaggtagccctcctatcaaatgatgtggagaaattgtctgggctggctaggtagagaataactctgcaggaggatgatactaggtatcagtgcagaaataaattatcaacagtacaggctaaagaaaaaagaaaaaaagcaaaaacagacttactggatcatctgccagcagagtgagatactgatcaagaacttgcttagagatgttatagccaacaggtagggatctgaagatctatggagcaaaggacacttaaaatgggtttgggaacttagaactcctgaccttactgaaataaagatgttttaggccgggcacagtggctaaggcctgtaatccgaacactttgggaggctgaggcaggtggatcactttgggtcaagagttggagaccagcctgaccaatatggtgaaaccccgtctctagtaaaaatacagaattagctggacgtggtggcgcatgcctgtaatcccagctatttgggaggctgaggcaggagaactgcttgaacctgggaggcagaggttgcagtgagccgagattgcgccaatggactccagcctgggctacaagggcgaaactccgtctcaaaaaaaaaaaaaaaaaagttttaattttagttaccacaaaactgtccaaaaatattcacagcaggattgtttgtaagagtaaaaaactagaaacacccaaatgaccagtaccgagtacactaaaataaaatatagcacggccattaagtggaatatgatacagtcattatgaagagtgagacaaatctacagaaactaacatgaaaggaagttttacatacactgtcatataaaaaatcaagttatagaacagtatgactaggttgggtgtggtggatcacgactttgtaatgccagcactttgagaggctgaggtgggaggatcacttgatgtcaggagttcgagaccagcctggccaacacagtgaaaccctgtctctactaaaaatacaaaaattagcctggcgtggtggcatgtgcctgtgatctcagctactcggaaggatgagcaggagaatgccttgaacccaggaggcggaggttgcagtgagctgagattgcgctactgcactccagcctgggtgaaagagtacaagactctgtcacaaaaaaacaaaaacaaacaaacaaaacccaaccaaaaagccatatgaatagtcccattttggggttaaaaaatacatatacccacatatatgttagagtatgcaaggtctgaataaagatatataccaaactttttttttttttttgagacagagtctcactctgtttcccaggctagagtgcagtggtgcgatctcagctcactgcaacctcccattcccgggttcaagcgattctcctgcctcagcctcccaagtagctgggattacaggcgcccatcaccatgcctggctaatttctgtaattttagtagagatgaggtttcaccatgttggactatgctggtcttgaactcctcaggtgatctgcctgcctcggccacccaaagtactgggattacgggtgtgagctgctgcgtccggcctttttttttttttttttttttttgaaatagggttttgctctgttgtttaagctggagtgcagtggcatgatcatagttgactgcaacctcaactcttgggctcaagcaatcctcctgcctcagcctctcgaatagctgtgactacaggcatatggcaccacacccaactaattttttaaaaaaattttttgtagagacgggggtcttgtcatgttgcccaggttggtcttcaactcctggcctcaagggatccttctgcctcaacctcccaaagttctaggattacaagtgtgagtcactgcacctggccacagaactttaaaataaacaatataaaaatataggaatatttaaacatagtcatgcaccatataacattttagtcaacaacggaccgtgtgcagctgtggtcccatattatactggagctgaaaaattcctactgctttgtgatgtcatagctgttgtaacatcatagcacaatgccgttgtgaaacacattactcacatgtgtggtgaggctggagtgcagtggtatgatcttggctcactgcaacctctgcctcctgggttcaagcaattctcctgcctcagcctcccgagtagctgggaccacaggcgcatgccaccatgcccggctaattttttttttttttttttgtattttagtagatgggtttcaccatgttgcccaggctggtctcaaacgcctgagctcaggcaacccaccagcctgggcctcccaaagtgctaggattacaggcgtgagccaccccgctcagcctgttactggtttttaataaatacagtgtagcctgagcgtgtagaccatcacattcacattaatctgccattcattcactaactcccacagggcaacttttagtcctgaaagctccattcatgttaagtgcactaaacaggtgtggtttttaatttttcataccatatttttactgtaccttttctgtgattagatgtttagatacacagatgctactgcgttacaactgcctacagtattcagtacagtaacatgctgtacaggtttacagcctagaagccataggctatcccgttcagtctaggtgtgctgtagggctacaccatctaggtttgtgttaagtacaccctatgatgttcacacaatgatgaaatcacctaacgacacatttctcagaatgtatccctgctgttaagtgatgcatgactgtattactatgaaagtaatataaataacacatattggatatattaaatatcgatattttaagtacagggggtcaaataatgtcctgaatgccaaggctctcagagtccaaattgtggattcttaaaataattaggaataggctgtacttgacgaatagatactttgactaagtgaatagtgtagatttttaaaagctggatcctaagagaccaaacatttcagtgctcatcacttgaagataatccctgctccacatcaaatgcccttctctttcaaggctcagacctcaacccaaactcaggatctgtgtataataaacgttgataacacccaagaatctgtcagaaagttagtgcaagaacatgaaactcacctcattggaagacaatggctgggtgaagggagcactagaggaagtggtaatctcactcattcggagcatggttcgcacaatctcgctgcttgtctgtttgaaaagtaaactagaattcagaaatcacagtgctgcccctggctctatgtgccaatggccatatctgacaaataagtaaatgtccctgatgaccaatgacagacccacttaggtattacctggtccatcctgttagcaactgcgctcacaatggcttggtcacggaagtgttggtggaatctgtcaaggttggcctgccaataaatcccatcatctggaatgggctgaggaagagatttagagaaacatttagctatagtgtaaagttttctggtgaggagcttggatttaatggttcaccatttcttttcctacacagtaacaattacattggttggaaaaaaatcattcagtcatgtagactggtgtctagacaaattccgacttcaaacaggttttctaagctcatctccaatctttctctccctattttattatttaacatttattttaatttttttctgagacggagttttgctcgtcacccaggctggagtgcagtggcatgatctcggctcactgcaacctctgcctctcgggttcaagtgattctcctgtctcagcctactgagtagttgggattacaggcaaccaccactgcgctaggctaatttttgtatttttagtagagttggggttttacaatgttggccaggctggtctcgaactcctgacctcaggtgatctgcctgcctcggactccaagtgctgggattataggtgtgagccaccacatccggcctttctctctctattttaactcttctccattactttcaagtctccaacttgacccttcttccttctcactctcggcagatgactttgcctctcatttcacagagaaaatagaagacactaggccagaactcactcagctctgtgcacatcctcaccacatttcttttttgttcttgattcatattttcactcacttttatcacagctgaaaaatgctccttttacctaaggttaatgcccatattggtattccaaatcttactctctcattcattcttggggatccagctctattttaccctgtcctctaacatcttcaggctttccttctctaccgccttcttatcagcctttaccctgtccaagtctctttctactctagaattctctttcaaccctatgccttctcttcttttccttactgtcacagccaagcttctcaaacagttggccatctcagttgtatctctacctagatttacgcaacccatttccactattgtactgaaatgtcaattgtcactcgcattccagtgaaattccacaactgtccttaaggattctatgttgttaagttcaaataataatttccacttctgatcttatttaaccttttggaagcatatgacatggttggacattttttccttcttaaaactttatgtggctccttggttttatgacaccattttttttttccttttaaagacagggtctttgtcacccaggctggagtgcagtggtgtgattgtagctcactgcagccttgacctccctgggctcaggtgatcctctcatctcagcctcccaagcagctgggaccacaggtgcgtgccaccacgcttgggtaatttttgtatttttctgtagagacggtctcaccatgttgctcaggatggtctcaaattcctaggctcaagcgatctgcccgccttggccttccaaagtgttaggattacaagtgtgagccactgggcctggccgacaccattttttcttggcgttactttgaacctttctggctacctttcctcagtatccacagattcctctttcagatcccaactgtaatcctggtgttttgtcagggttctgtccatacctttcctttctttttactctacatgctctacttgggtaattttatctgctctccaggcttcaactattgatgcatttccaaatctgttactctatcctagaactctctcttttttttttttttttttgagatggagttttgctctttcgcccaggctggagtgaagtggcacaatctccgctcactgcaacctctgccccccaggttcaagcgattctcctgcctcagcttcccaagtagctgggattacaggcctgcgccaccatgcatggctaatttttgtatttttagtagagacggggtttcgccatcttggccaggctggtctcgaactcctgacctcaggtgatccacctgcctctgcctcccaaagtgctaggattacaggcattaccgcacccggcctatcctggaactctctattatgctccagatgcatagactcagctgcctatttgacacttccatttgttccccaaactgttctgttttgtaagttttcaggtaactacactataaccaacccaatttttttttttttttgagacagggtcttgctctgttgcccaggctgtagtgcagtggcaccatcatggctcactgaagccttgacttcctgggctcaagtgatcctcccacctcagcccctgagtagctgggactacaaacatgtgccaccaggtctggtgtttttttttttggtacagatggggtctcactatgttgtccaggctggtctcaaactcctgggctcaagtgattcttctacgtcagcctcccaaaatgctgggattacaggcacgagccactgtgcctagacaacccaatttcttttttttttttgagatggagtcttgctctgtcaccaaggatggagtgcagtggcgtgatctcagctcactgcaacccctgcctcccaggttcaggccattatcctgccgcagcctcccaagtagctgtaattacaggcacctaccaccatggccggttaatttttgtatttttagtagagacggggtttcaccatgttgaccaggctcatctcgaactctgacctcaggtgatccacctacctcggcctcccaaagtgctgggattacaggtgtgagccactgtgcttggccagccaacccgatttcttaagctacaaacttgggtatcacccctagtcccttgctctccataatctaccaccccattaccaagttctatctattctttatatttatcagatgtctacttttctttctcctatcattaccttatttcagactctaaatcttggcccatctggattactacaatagcctcctaactgggtttttttttttccctttaaaacatagcagacactataaaaggagtaactgggttttctccttctaattttgttttgcatcattcttcccatttcttagagtagtgcttttttttttttaaactgttttgggtcacagttcctttgaagaatgtaatgaaaggtacggagagcttcactgaaaaatgcacgtaagtataactggactctctgaaatccatccatggagtagaacaagttaggaactgctgtgctataataatctttctaaaatataaatccagtcacttcatttccctgcttaaaatccatcaatggctctcctttgccttcaggataaagcccaaacctcttagacaaacatgtacacaaataataaataattccagttataaatataaatgctgtgaagtatatgaaatgagaaatgtggtaggaactagtgtaggagtgggcaatggtgcttgaagtctatgaaaacagcatttaagatagaaatgataaaaacagagaccactacatgaagatctggggacaaacatttgaagccggagccaaagtctaaagaccagaaagagtttgacatgtttaagagataaagtcagtagagggaacacagtgagtaagatggagacggggcagaggtgaggttgaagagccctgtctccagcagatcatacgaagacctagatcacgtaaggcttcctagcccgtaccttggatttcttctaaaagtaaaggaaagctattaaaggagtctaatcagtggatgtgttgttttgttttgaacaacttagaaagtcattttggctactaagtaggtaagaatgcagctagggagaccattaacgaaagcgtttgcaaagagttgagagatggcagtgaaaagatgagaaatggttggatttgaggtaattttggaaactgggctgatatgttttactgtgagattagagggttccaaggattttggcttaagcagaaatggtggtgtcctaggcggctggcctacgtggtagtgtcttttactaagatgaggaagtttatgagggagcaagatatttgggaggaggaatcaattattctgttttggccacactaaatttgagatgcttactgacatctttataggtacgctaagaaggcatttgaatatgagttcaggcctatgtatagtttttagacccatttttcatcactggcccctgtaggtctttaggttctcgccatattgagcaacctaaactttttctaggcccctttttacataagctgttacctctgttcaatgaaagaattaagttaaggctcagaagggagacagtaatggttcattctttgttagtctattcctaatatttaatgaggttcataatcctactgcttcttagctcaggaagctttaagctctcttggggcttgttatctgagtgctctttctggcctgcttcagggtgaggacttctaatcaagaagccccattacctccttgttatctgtagtatattttggtctcttggccttgggctccccagcagcatcttcatcagatgatctcctccttttacctttccctgccaaacaaacaattaaacacttagactatatctcatatgatgacaggaaatgaccaaacatgagagcaggtgtctttcattccaaagacatctgtagctgcctctagatcagagttgcttagggggctgaagagctataagaaactcaagtaactgatgaaataatctgaaactcaacatgttcaaaaagagtcttatagtctttctcctccaatgctctctttcatggccagtgatatcatcctcccacatgtgcaagtcagacacacagatgtcactcttagtacttgtttccttcaccctctctctttcattttccaccagtctgtcaacatttacctttgccccattctcccatcctttctgtagacaaaaaatcttttgaaagtgcaaattagatcatgtcatttccttaaaaatccttcagtggtcttcctttgctcttagcataaagaacagatgctctataaggtcttacttgattcagcccctgcctgtctcccatccaagtactaagcaggttgatcctgattagcttctgagatcagacccctgcctagctatgtctctaaccttacctcatgcctctcttgctttgcttacaatgctttagctatactgacattctttcatttcctcaaatgctatttttttactacatactattccctctgccaaaaatgcttttcctgttacctcactgttagcttctacttcaaatcttagctcaaatgccaccttctcaaagaaacatgaggcctaaactcccagatgaatcccgtctctcgttatatattttcttttcttttttttttcccgagacagagtctcactctgtcacccaggctggagtacagtggtgcaatcttggctcactgcaatcgctgtctcctgggttcaagcaattctcctgccccagcctcccgagtagctgggattacaggcgtatgccaccatacctggctaatttttttttttttttttttttgagacggagtctggctctgttgcccaggctggagtgcagtggcacgatctcggctcactgcaacctccgcttcccgggttcatgccattttcctgcctcagcctcccaagtagctgggactacagatgcccgccaccacacccagctaattttttgtatttttagtatagacggggtttcccggtattagccaggatggtctcgatctcctgacctcgtgatccgcccaccttggcctcccaaagtgctgggattacaggcgtgaaccaccatgcccggctacctggctaatttttataattttagtagagatggggtttcaacatgttgcccaggctggtctcgaactcctggcctcatgcaattcgcctgcctcagtctcccaaagtctccattatatattttcataacacctcatacttttccttcatggcacttattacagtttaattatatactgatgtgattttctgattaatgcatgtctcataatactatgacagttccttcataggaatatttccttcatagtacttatcaccgtttaatgatatatcgatgtgattttccgattaatgtatgtctcctatactaaagccccatggcagagaccatgattttttcattgttatacaccacgatgtctggcacatagcaaatacttggtaaatacaatcacatttcatacacttgacaatcaagaagaatccacaattaaggcaagtcacagttccaggggttaaaattccttacctatcaagctgagtttaggaaccaggtacatgtccttttcattaatgacaagtgtgggggcaggtggtggtggcccagggtctgaattctcagtggtaggtaccgaagggcagcgttgtacaaagtgtgtgtctgccagtcgcacaaatgtgtttgatacttcagcatagtccatggtcttgccatctgtataacaggaggaaaaaggcagatgagatggcctaagatagctcagggttcactcccatagccagctgatctatgcttttgttaacagctatggataccatactgaccctccatggtctctgtgagccggtctgccactttcttcacaacagctgacattgtcagtttgccgttcaacagaagctcctcaacaatcagctctccagtgtcactgtacagagttttggtagtatagatgtaccggggatatctaagcattcgcaatacccggctgcactgggcttcatactccaccacaccacgtttgtgcacttgataactcaccaggttatgttggacgaggacacacagggctttcttcacctaaatggaacataaagagaagaaagagaggaaagacctgaagatatagctcattactgctggcaattttttgtccaacagcttagtaagcatcagaaaatggctagataatttctgcacttatttcctctctccactggaggagctaataagaatcacacatcaatacaataaatcaggaagattccttgctatatttcctctgatccttatctctcaaaacacaatttactttcatcattctcattccttaaaggcagtactgagattaatagacttattgtgaataaatgaggtacggcatgggaagagcaaagatttgcctaaaagctgtgatgaactaggaacactttgagaaacaaaatgttgatgtctaagtctcatccttttctccccgaaataacattgttctgctccaagggcaggctttcttcatttttccttttctggggtgagaagaacaatattcaaaggtgggtgaaataaattagtgaaagaaatgagagaaaatgaatgtcatttagacatacctgatccagtgatgttcctgtgtcatgggcaattactcttagtggctggctgccggttcttatcagatggactccaattttttctacaatctctccaaaatgctcttgcagcaacaaagaacagagcttaatttctgcttgagtcattgtactggggagtctgagagctagggaaaaaacaccaaaatggtacaatagaaagtctttcacgctggaagcagagctgctgagtgtaaattcatgtattctttctggagggcaatttgacaatacatatcaaaaagccttaaaaatcttgcatatctttgaaacaacaatttctttttggatattgtgtccaaagaaagaaaaagctaataataatgaagtcattagttctctttataataccgacttagtggaaacaatctaacgtctaacaataaatgatgccatacccatacaatggcatactacaccaacatttaaagttatttagtacgatgcgtattcatgtagaaaattattcataataggctggcgcggtggctcaggcctgtaatcctagcactttgggagaccgaggtgggcgtatcatgaggtcaggagtttgagaccagcctggccaatatagtgaaaccccttctctactaaaaacacacaaaaaaattagctgggcgtggtggcgggtgcctgtaatcccagctactagggaggctgagacaggagaatcgcttgaagccgggaggcagaggttgcagtgagccgagatcgcgccactgcactccaacccgggcgacagtgcgagattctgtctccaaaacaaaaaaaaccaaaaaaaattactcataatatattaagtgacagaagcaagctgaaaaaatataaaaattcaattattgtaaaaaaaaaggaaaaatgtatgcataggaaaagactatgcatcaaatttatctctatgggattatgcgtgattctgattttccttaaagattgggagatgattttgcggtctgtcacagaccttagtttctacacttccctgcttggaagaattaaggtcactgttcacagctcggtgggagtgaacaggcagtgttattctcagtccataaaggaaatgataatttcgaaaaagaaatttaggaggtaaaggactgcttctcaacagggtgtgtcaaacaggagatgaggttacgttgtttgcaggacagtattcaattcttaaacttctactccttgacaaagttgacacaatcagaaacggacgtagttaattttatgattacttccttattacaaattgctaccaaacattgtttacttatttcttccaattcctaagaagccaagtctttgcctccccgtccccaccccgcctcagtatcaccagagacctatttcgtccatccacatatctttggagaagcattcccagatcctttgccatcctcggaaagggcttccaaggcgcttggctcctagctctacacttcctttacacaggttcccgtttcggacgtggtctcttggtccagtcagtgccgccacgttcagacagcattttccactaacctcagggtcagcgcaatccgggggctccaactccaattcggctgagcttcccgcgacggcttcctacggctcccgctggccttctaggccgaggtggagcccaccgccctttctaggacgcggatcgccaccgaagaagacgcggaaaagcaaaaagcgcgtgccactctaccccagagtttcggcggcttccggggacgctctttctttcttctcgctggaagactggaggaccagcgaggggctgtttgtggagccggcgggcgggccgtttgtctctccttcctgcgcctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggtaagagcgctgtgttctctatacttgggaacctcatagattcctggccccgatttcccggaactgggtctggagctttctgcacatcattgactcgcccgacatcggtctgccgaatacctgctgcccacttctaagccgccggccctaaaccctgggcatcacggcctcggccccgtacctcctgcccacctcttaattcatcctgggctgctccacctgacctcacctctttacctcccgtgtccttaatttttttttttcttagcaagtttccctctgataactctcccctcaattttcttgcattcttttatacctggtctttttcctacgatgacctccccccacacttcttccactgtgtcttctcaccttcctctgtgttcttttccacttttcaccccccaccgcccccgccacctcccttgtcagtgaagcgaaatagcggattgctgaggattgtcactcttcggttttttctagggaaggaagcacagaaagggggttggaaggtatctgtggggcgaaaagggggattttgctcttcagtggtttccagggtccttgtgacagtgaagacagcagcgtactaatgacttgcagacggtctgcactcctatcactgttgaaggaaatggctttaggaagaaggcaggacgtactgtttcaacttcgtttattttggttgtcatgctgccagtgtctttaatatcattgttccgccccccgccctgtccctttcttcacctaagaaaaagagccgggacagaatgttggggatgcttcctctgacgtgaaattggttttcacgagtttctgccagagtgttagccccttgagaggcagtgctgtggttgggaagaaaacacttttgtaggtcaggcgcggtggcttaggtctgtaatcccagtgctttgggaggacgaggcaggaggattgcttgaggccaggagtttgagaccagcctgggcaacagagtgagacccctctctacaaaaacaaacaacatttatgcagcatactagccagcaccagcatcacaaacccagaagctgttttgggttgggttgtagctactacgaggagctcccccagagtgaatgtcaatcctgtccttggccaactgtctttatggttgttcctttccttacaagtgtccaggttcagtcttgtgatagagtggcaacattatgtttctatttatggtgtctcagatacagtgtaggagaaaaccttctgaagtgagtctgtatatcttatttcttagaaacacaaatggagtccagtgaataagtgcttaaagggtgttttatagtcttctctcactcaaaagttttgtttaaggcattatgatacattctttcctctctacttgccgcaccccctacttcagagtcatagtttcatctaaatgctacttagctgtttttcttttttcttttttttttttgagacagcctctgtctatcacccaggagcatgatttcggctgactgcaacctccacctgccgggttcaagagagtctcctgcctcggcctccgggtagctgggactataggtgcacgaccaccgcaccctggctaatttttgtgtttttagtagagatgcagtttcaccatgttggccaggctggtctcgaactcttgacctcaagtgatccacccgactcgggctcccagagtgctgggattacaggcgtgagccactgctccccgcctaaatgctacttagctttgtttgctgattttgctgtgtgtttatgtttttttttttggccatatttcagtgctgggaagagcaggtgtctagtttttttccagccaacatcagagcctgcagaactcttttaccatagagagggagtctggaattcagccagtatgtgtgtgaccagtggtgtgttgttgaatgtgatgccttgttgaatattccatccttagcttttttgatctttaagttgctgttcactattttgcctttaagagtgagaagttggccaggcgtggtggctcaggcctgtaatcccaatactttgggagtccaaggcaggcagatcgcttgagctcaggagttcgagactagcctgggcaacatggagaaaccccgtctctaccaaaaaataaaaaaatttgccgtgtgtgtggtggcatgcacctgtagtcccagctattcaggaggctgaggtaggaggattgcctgaccccaggaagcagaggttgcagtgagctgagatcgcaccattgcactccagcctgggcaatagagccagaccctgtctcaaaaaaaaaaaaaaaaaaaaaagagtgagaagacagtctaaacttccccaattgattatatcttttcttctcacctttaagtccttacttcaaagggataatttgaaaagctgaataggtgtttttctaagccttagttaatgcctggagaagtttcttgatctttttggtgtgatatattatttgtcatatctgatttgtaaattgaggcctaacacaattgagtataaccggattcttcctaaatatatccaaggttctctgctgagtgtcctggaggtgatagggagtgatatgtggctcctgcccttaaggatcttacagcttttggggaaagacaaggcaaacatagaaaaagtaacagcataaagggaatgaggatatgtgctttaggattcagagaggggaatttcatagcgttggtgtggccagtgggatttaaattgagttttgagggatgggtgcatttcagattgagaattccaaagactgtgaggtagcaaaaggaagagggagttgatgaagaagggagaaatatttaataaatcatgtttttttcacaactaaaagttgtatactatattttttatagtgttcagcatgatttgatatatgtatacactgaatggttaaatcaagctatttaacatgcattacctcacatacttatttttgcgtggtgagaacacttaaaatctgtcttagcaattttcaaatatacagtatattccctttttctttttttgagactgagtctcgctctgtcaccaggctggagtgcagtggtgcgatctcggttcactacaacctccacctcctgggttcaagcagttctcctgcctcggcctcccaagtagtggggactacaggcacgtgccaccatgcccagctaatttttgtatttttagtagagacggggtttcaccatgttggccaggatggtctccatctcgaccttgtgatatgcccaccttggcctcccaaagtggtgggattacaggtgtgagccactgcacccggcctctttctttctttttaaatagagacagaatttattctgtcttgttgcccaggctgttcttgaatttgtgggctcaatgtgtcctcccactatatcctcctgagtagtagtagataggtgtgttccaccatgcctggctaatttttttttcttttttgtagagatgggattttgccatgttgccccggctggtctcaaatttctgggcttaagcaatctgcctgcctcagcctcccaaagtgctggggttacaggcatgagctattgcggctggcctgatatgtggtatttgtttttaattctgtttatgtgatgaatcacatttattgatttgcctatgttgaactaaccttgcatcccaggagtaaagactacttgattgtggtagattagcttttaatttttatttatttatttttttgagatggagtcttgctctttagcccaggctggagtgcagtggaacgagctcagctcactgcaacctctgcctcctgggttcaagcgattctcgtgcctcagcctcccagatacctgggattacaggtttgcaccactagacctggctaatttttgtatttttggtagagatggggtttccccgtgttggccgggttggctttgaaatcctgacctcaagtgatctgcctgccttggccccccaaagtgctgagattacaggtgtgagccaccacactggcctgcattagctttttaatgtgctgctggttcagtttgttagtattttatttagaatttttgtgtctgtgttcattagggatattggcccggagttttcttttttcattgtgtctttgccaggttttggtatcagaatgctgctggcctcatggaatgggttagggaagagtccctcctcgattttttggaataatttcagtaggattggtacaagctcttcttcgtgtctggtggggtttggctgtgagtccgtctggtccagggccttttctgattggtaagttttttatttttcattattttttgagacagggtctcactgtgtcgcccatactggagttcagtggcatgatcacggctcactgctgcagcctcgacttcccagactcaggtgatcctcccaccttagcctcctgagtagctggacctacgggtatgtgctaccacacctggctgttttttttttttttttgagagataaggtttcgtcatgttgcccagcctggtcttgaactcctaggctcaagcgatccgcctgcctttgcctcccaaagtgctgggattgtaggcatgagccatggccctggccaggttttttattactgattcaattttggaactcgtcattggtctgttcagaatttcagtttcttcctggttcagtcttgtgaggttgtatgtttccaggaatttatctggaattttaggttttctagtttgtgtgcataaaggtgtttgtaatagtctctgagggttctttgtatttctgtgggattggtggtaatgtcagttttgtcatttctgatggtgtttatttagatcgtctctctttttttctttattaatctagctagtggtctatcaattttattttttgaaagaaccaacttttggtttcgtttatcatttatttgtatggattttcgcatctcaatttcattcagttcagcactgattttggttatttcttctgctggctttggggttggtttgttcttgtttttctagtttctctaggtgtgatgttaggttgttaatttgagatctttctagctttttgatggaagtgtttagtgctataaactttcctcttaatactgctttaactgtatcctagtgattctggtatgctgtatctttgttttcattagtttcaaagaactttctgatttctcccttaatttcattttttactgaaaagtcattcaggaacaagttgtctcatttccatgtaattgtatagttttgagagacctttttagtattgatttctattttaattgcactataatccgagagtgtggttggtatgattttggtttttttgcctacgcacttctcaaaagaagacatatatgcagcccaataagcatatgaaaaaatgctcaggattactaatcgtcagagaaatgcaaaccaaaaccacagcgagataccatctcacaccagtcagaatagctattattagaaagttaaagaataacagttgttggcaaggttgtggagaaaagggaatgcctatacactgccggtgagaatgtaaattagttcagccactgtggaaggcagtttgatttcccaaagaacttaaaacggaactaccattctgcccagcaatccattactgggtatatacccagaggaatataaatcgttttaccaaaaagacacatgcacttgtatgtttattgtggcactgttcacaagagcaaagacatggaatcaacctagatgcccatcagtggtggacttaataaagaaaatgtggtacatatacatcatgggatactatacagctatttaaaaaaaacaaaaccgaaatcatgtcctttgcagcaacatggatgcagctggaggtcattatcctaagtgaattaaagcaggaacagaaagccaagtaccacgtgttctcacttaaaagtgggagctaaacattgagtacacatgggcataaacatggacacgagggcttacttgaggtggtgagggtaagaggaggatgagggtcaaaaaactgcctatcttgtactatggtcagttgctgggtgacgaaataatcagtacaccaaattccagtgacacagtttatccgtgtaacaaatgtacatatgtgcccccaaacctaaaatcaaaaaaaatatgtgtagaaaacaaagagcaaaatgaaggacctaaaacctaaaaaccatttatagtcaatatataaaaaggcttaataccccagttaaaatcagatatggataaattttataaaaacaaagtaaacaaagagggtactgactcttgtgatagttggataccaagaaccatccctcactggggcatgctgtggctcacacctgttataccaacactttgggaacccaaggcaggagaggattgcttgagcccaggagtttggcactagcctgggcaacaaagtgagaccctatctctacaaaaattaaaaaaattagccaggggtggtggtgtgtgtctgtggtcctagctactcaggaggctgagtcggggaagattgctcaagcccgggaggtcgaggctgcagtgagctgtgattgtgccattacactccagtctgggtgacagagcaagagcttatctcaaaaaagaaaaagactccatgatttaatctaatcaacttcaaaaacccaactcattcctccacacgccctgtgccttggccatagcatttacctcaccattctcctatgcattatctatttttagacctctgtctccctttgtttaaaatgttctcccagcctggataacatagcaagaccctgtctcaacaaaaaaaataaaaattagctgggtatggtggcatgtgcttgtagtcctagctacttgggaggctgaggtggaagaattacttgagcccaggatatttgaggttacagtgagctatggttgtgccactgtactccagcctgggcaacagagacccagtctggatgagagagaagagagaggggagagaggagagaaaaaagaaaagaaaagaaaaagaaaaagaaagaaagaacccatcatctatgagtgctgtcctcactgaacaccagaggctgggtattgagtttacatcagcttttaatgagctctcactaggtttcttcacccattcaatgggaaggtctgcttcagagccataattgtgttcaacgggactaggttgcaaggtttaataactcttctcttctttttaaaatttaattactttattatttcacctttttttttaaagccacatgtaggctgaattcatttaatttgacagaataacactccttactgctaatcctgatcaattttagctttgtgtgtctttgggttggatccactcagataagaggacaaaagagggccgggcatggtgactagtgcctgtaatcctagcactttgggaggccaaggtgggcggatcacctgaggtcaggacttcaaaaccagcctggccaacatggtgaaacccctgtctctactaaaaatacaaaaattagcctggcgtggtggtgggcgcctctaatctaagcaatttagtgatttgagctgggctcgggaggctgaggcaggagaatcgcttgaaaacccaggaggcggagcttgcagtgagctgagatcgtgccattgcactcgcaaaaagagcgagactccatctcaaaaaaaaaaaaaaaccattcaaaaagaggacaaaaggttcatttggaaagaggatattaagaaataaggagaaatcatgaagggaattttaaaatgaaaacatatttagtggcattgttttctgttaggtttcaaaaaagtctccattccaagtgagtattggtttaggaatttctttctccttattaaaagtgttttcctatttacagtgaaaataactttagtaaaattttgtgagtactaaacttggattttaaaatcagagatttcgattatatagtctggagcctcaggattttaagtttctgtaggattgggtaaaatgccattgtagattttttggtcatcagattatagaataaatacttaaagtaacttcagattattattttcaaaaccatagcagaaactcttaccttacctatcttattgagagacaatgtgaagccaagactaatggagttagtgtgctacattgatgatgaatgactgggtagtacaccacagagggctgtgtcatggagtgtaaaggtgttattccattcctacaccctaccatccgtctttccccattaaatcaaggtcagggaatgttaccttatgtgattaaatctggtagagtcatcattaaacaggtgagataaatcatatgcagagtaacctacttttggtattgatgagactagggtggttcttaagtattttatggagatcagggtatcttcctaaatccagatgaagagatcaggttaagaactgctcgctttcaggctccacctgaagaaactatgtagtaggcttctctccctctacttattttatcatcttctttgatctaataaaatgttttccttatcaataagtaatgttatctagtttggctctaccaggtgctagagaaggcattcatcattgtattgtacttgcaataactctaatacaggaaaatgttcaaaccacccataataaaagtagctaaaaagcagatttcttaaagactttgtgaccgtttaagctcagctgacctttctaagttgcatgattcttagaaaggtcccagagagatgtctatctggtgctatatagcagttgctaattaaatattttttaattgaatgattgatatgagttgaacacccagtaattatatttaaaaagtgatgacttcagtgttttgacgcctttaaaaggctacagtggtacaaaatgtaggtgctaccatgtgaaatttgaatgtacagtgaagtacatatattcactgcaatatctagaaataaatatgtattcttataggtagaggctagtttatccttgtaattctactgataaatataaatgtatatattggggaaatttgtgggactttttcagtataaggaagaaaaaaatctgaaaattgaactcactgcagaagaaattttttgtattttcgggggaagtaccaactagatgtgctaacactttgtatttctttatgtttagttgcctcttttttttttttttaaacggagtttccctctttcacccaggctggagtgcagtggcacgatctcggctcactgcatcctctgccttacagtttcaagtgattctcctgcctcagcctcccaagtagctgggattacaggcgcctgccaccacgcctggctaatttttgtatttttagtagagacgagggtttcaccatgttggccaggttggatctcttcacatcctactgagcaataaatgagatagcctagagcagtggttttcaatttcaggtagttttgtttcccggggaacatttggcaaagtctgtagacaattttttatcttttttttggagacagagtctgactttgttgcccaggttggagtgcagtggcatgatcacggctcactgcggcttccacctcctgggctcaagcaatcctcccacctcagcctcccaactagctgtaccaccacacccggctaattttttaattttttgtagagacagagtctcactgtgttgcctaggctggtgtcaaactcctggcctcaagcagtcctgcttcggcctcccaaagtattgggatggtaggtgtgagccaccacacccagcctgtagacatttttgatttttgtaactaggggctggaggagggttgctactgtcatgcagtgggtggaggccagagatgctgctgaacatgctgcagtgcacaggatagacccctcaaaacaaagaattatattgggcccaaaaaggtaagagggctgaggttgagaaaccctgggatagatagagggatagtcagtgtcatcttgtgctaattgtgtttaaggttttgttttggtgtaggtttgatttttaattttgggatcccagtgaattttcagtaagaaaattgagaccgtataattttaggcaaacctctgatgggagagagtgtttagaacaggaactagggctcagttagtggctgcaattccattatagcagtatctattggagttactttctgtctttggagttactgagaccagaggaattggattacccctctcaagttacatactgtaagggcaacttataaaagaaaactatccacatttttttgtcagttgggaattaattgagatagaaacactgcatgtaatttagtaagacagctggaaatcccagtttgaaaacaaaatgaaaagcagacaacaagcctaacttttagttttgctttctgtgtttctcttatacctctcagaagtttcataagctccagaaattttgtgtttaaccttttagtttcttcaaattcttggttgagagggtatattggagttattaatctttgttctaaaattcttcgggtgacttctcgctgagtcatctgaccgtctcagtttacctaagtatatcccattgtaaaatgatacttaggtgcacgtatgggaagcttgaatgaggaatggagctgtataatcctaattgaaaggcagtgtaagaatcatgagcaatccttatttgcagagaaatagggccattaccgtattagaagcattttaggttgttgttatagtttcacatacagaagtttaggtgctgaaaaattattcttttttagaaatttcttttttcaattgtttgctgttcagagtttctcagaggtccccagatgcatgtatatcagttagaagtaggacaggtatggtggctaacacctgtaatcccagcactttgggaggcagaggtgggtggataacttgagctcaggagtttgagaccagcctgggtgatatggcgaaaccccatctcttaaaaaaaaattaaaaaaagatagaagtgagttggcgccagtgatttttaaaccaggcatacttttcttgtatgataagtagactgttggtgactcttttcccaaaacagaccagttagattttgttttttgtttttttttgagacctgaagcctcactctgtcacccaggctggagtgcagtggtgtgatcttggctcactgcaacctccgcctcccacgttcaagcaattcttgtgcctcagcctcccgagtaactgagattatgggtgtgcgccaccacacctggctaatttttgtatttttagtagaggcggggtttcaccatgttggccaggctggtctcaaactcctgaccttgcaagtgatgcacctgcctcggccttccaaagtgctgggattacaggtgttagccaccacgcctggccagaccagttagttttgtcttccttgaaaatctgttaagacagattaatctctctccttgataatttgaacaagtgtcacaggaaacttcttagtagacaaggtaatgtttacctccttgccactcactttgatgttgtacagatttgaatagacttttaacccatagtaccatcttccagaagtttcattttgcttacctttcaccatgcttagaatttacattctcaaaagaaaaaacaattatagttacatgctctttcttaccttttgctggattaactgagacctgcaggtatcctacaatgatgctgatcttctagcccgttaattctcagacctctcagattcagtgccctcttcttataagtattttgaaatactctctttagtgaaatgaaatccacaggtaatacagcttttctacatatatgtgtgtgtgtgtatatatatatatatatatatatttttttttttttttttttgtgagacagaatctctgtcaaccaggctgcagtgcagtggcgtgatcttggctcactgtatcctctgcctcctgggtgcttcaagcgatgctcgtgcctcagccttccaagtagctgagattacaagcgtgcatcaccacacctggctaatttttttgtattattatttattctttgtagagacagggtttcaccatgttggccaggctggtctcgaactcctggcctcaagtgcgcccacctcggcctcccaaagtgctggggttataggcgtgagccaccacacccggccctacatatataattaaaaaaattatcttgcagtaagataaaggataaatagaaaatatttctgacagattagcttgacatgacagctacctgagtagactgctataagggtatttgcaacttaaataccaggagaagcaaaccagtacagtgaacaattctttgcaaatgtacaaataaaactcaagtacaacttctttcttcttcttcttttttcttttttttttttttttttttttggtagtgatggggtctcacttagttgcccaggctggttttgagttaggctcaagctgtcctcctccttggcctcccaaagtgctgagattacaaacgtgagccactgcatctgccccaaagtacagttttctcttactttattcagcagttgcttttctggacatttagtgcatgttaaaattatggactgggcacggtggcttacgcctgtaatcccagcactttgggataccaaggcggttggatcacttgagcccaggagttggagaacagcctgggcaacatggtaaaaccctgtctctacaaaaaatttttttaaaaattagccgggcttggtggcacgtgcctgaagtcccagctacctgggaggctgaggtgggaggattacctgagcccaagaggtcaaggctgtagtgaaccgtgatcacaccgctgcactccagcctgggtgacagagtgagaccctgtctcaaaaaataaataaataaataaataaaattatgcagaaggacttggtgcttatacgtagaatgtaattaggttctaggctttggtaattatacagattttaaaaatccagttaactattcataaggaagtttgagaataaagacattttttctttgtgctggacttgcctatgctttcctggcctctgccaattgaatgtcagtaacacttttttttttttctgcaacttttattttaagtcccggggcacatgtgcaggatgtgcaggttttgttatgtaggcaaacctgtgccatggtggttggctgcacagatcaactcatcacctagctattaagcccagcatccattagatattcttcctgaggctccctcaacaggccccagtgtgtgttgttccccaccatgtgtcctcctcatttagcccctacttacaaatgagaacgtgtgatgtgtggttttctgttcctatgttagtttgctgaggataacggcttccagctccatccacatccctgcaaagtaatcactcgtcctttttatggctgaatggtattccatggtgtatatgtaccacattttctttatctagtctctcactgatgggcatttgggtttattccatgtctttgctattgtgaatagtgagaagcacttcttaactgctgtgacaaccaaagcacttccatagatgtcccaactatcccctagatgattgtgttgtcctcattaagaatgacctctagtcatacaggaaaacatttttctgttttatcattcactcttcttttttttttcttgcttattattcactactttagcacagccttttagtctaaaagacaaagatttacttggcctttagacaattcctatatgtctttaaatttcttatttcctcaccactcttattattgatgttttcttttccataagtgttaggacagtgccttggtacatagtagatactcaattagtatttgttgaatgaaggaaacttaactgtaggctttttcttcttgccactttctgctttttgtacctgttgaaaatgatggaggtaccagtgttcataaaaaccttgaaaacaggctgggtgcagtggctcatgcctgtaatcccagcactttgggaggccgaggcaggcagatcactcgaggtcaggagttcaagaccaacctgatcaacatggtgaaaccccgtctgtactaaaaatacaaaattagccaggtatggtggcgcatgcctgtaatcccagctactcgggaggctgacgcagaagaattgcttgaacctggaaggtggagattgcagtgagccaagatcgcactactgcactccagcctgggcaacaagagtgaaagtcttgtctccaaaaaaaaaaaaaaaaaaaaaaattagctgggtctgggtgcagtggcgcacacctataatctcagcactttgggaggctgaagcgggcagatcacctgaggtcgggagtttgagaccagccagcatagtgaaatctgcatctactaaaagtacaaaaattagctgggtgtggtggcacatgcctgtaatcccagctacttgggaggctgagggaggataaccacttgaacccaggaggtggaggttgcagtgagctgaaattgcaccactgcactccagcctgggcaacagagtgagactctgtctcaaaaaaaaaaaaaaaaaatccttgaaaacaaagcacagacctgtagactaatgactaaagggttggctcaaagcagcagtttgatggaccacttgctattagttagtggccagtagagtggagcctcttgtggaatacggctttatttctgcatatgagagcttataagaagaggagtcatcccataattacatgcctttcagataaacagctgatgggctttgtaggcagagttactttaatgaagtcattaatagctgaatttgttgaatgaaagcttcttctagagaatcttttctaatttaggtactactgtgaggtatttttgctctcaaacttattaaactgttggttccctgattttgaatttatggtgccagttattagatcctgatctcttaatatggtcactgctaaatgtttacaggtattagcatacctagttaagacaagttaggttggggaacagaaatttttatatcttagcctcgttggtttgaaaaaaaattagttatttggattgctgatatagtgcaaaaactatttataatggtacatttactttctgtttaataacatgtaaaaggcaaacagcaaattaattttcactgctagtcttgatttgtatgttttagattaaagggttgttgaaactataataaaaaaccaaataatggttgggcaaaggaggacatgattagacatttctcaaaagaaggcatataaatggccaacaggtatatgaaacagtgcttaacatcactaatcatcagagaaatgcaaaccaaaaccagaatgagataccattataccccagttagaatggccattattaaaaagacaaaaataacagatgctgaccagaatgtggaagaaagggaactcttaaacactgttgatgagaatgtaaattagtatggtcactatggaaaacagaatggatatatttcaaaaaaaactgaaaactaccatacaatccagcaatcccgctactgggtagttatccagaggaaaagaaatcagtatatcaaagggatacttgcacttccatgttcattgtagtactattcacagcagcaaagacggaatcagagtatccatcagtggatgaatggataaagaaaatgtggtatatatatatatgcaagagaatagtgtttggccataagaaagaatgaagtcgtgccatttgtagcaacatggatggaactggaggttattatgttaagtgagataagccaggcacagaaagacaaatattgcatattcccactcatatgtgggagctaaaaaagttgatttcatgcaggtagagaatggaatgatatctgaggctgggaagggtgtgtgaaggcagagggggtgaggtatgtggataaagagaggttgattaatgggtataaacataaaattagatagaaggaataagttctgatgtttgatagcagagtagagtgactaaagttaacaacaatgtatatttcaaaatagctagatgagaggatttcagatattcccagcacatagaaatgataaatatttaaggtgatagatgccctaaatgccctgacttgatatgcatgtaccaaaatatcacatgtaccccatgaatatttacagatatctgtagcaataaaaaagtggttgaaagtaatattaataagtgagaatcataaaaatgtttaatttgctgaatttttcaaccttagtttactaatctttaaaattgttggtttattattctctatcaagtgcaggtgctgattgaatggatagggagaagttgttttaatattatattagcatcctattttaatatgcaatcagtattagatggacagattcagagttcctaaggtttttaataagattagcagtataatataggtctatctcgtcctgtaacactagtactgtaaaaggtttccagaagtatatctatttctattcctgagtgtgattgattctggatattttctttgaggacacacacatatactctatttgtgaagtacagcacttcgaatttagtttgtatttgataataacattaaaataacaggcactagattatgcaacagtaacagcagtccatttttatttattcagtaactgtattggtaccttctatattccaggagctgttctaggtacttgggctgttgtcttagtccattttgtgttgcttataaaggaataactgaagctgggtaacttaaaagaggtttacggctgggcgcagtggcgcgtacctgtaatcccagctgctcaggaggctgaggcaggagaattcttgaacccaggaggtggaggttgcagtgagccgagatcctgccactgcactccagcctgggcgacagaaaaagactctgtctcaacaaaaaataaacaaaagaagtttacttagctcattactctgcagacagtacaagaagcttcgcaccagcatctgcttctggtgggacctcaggaagcttccagtcatagtggaaggccaaggggaagcaggtgttccgcaaggcaagagagaaaggggaggggtaccacactcttttaaacaaccacatcactcattcctgtaaggactgcaccaagacattcatgagggatctgcgtccatgacctaaatacctcccactaggccctacctccaacattggggatcaaatttcaacatgagatttagaggggacacatatccaaactatatcagctatattcaggaagaagtacggagattaataaaatgttgagaaaaatgggtagtaaaatcaggatttaaatattttcttctccttttggctttctttaaatttaatatttatttatttatttatctattttatttttttgagatggagtcttcctctgttgcccaggctggagtgcagtggcacgatctcagctcactgaaacctctgcctcccgggttcaagcgattctcctgcttcagcttcctgagcagctgggattacaggtgtgggccacaatgcccagctaatttttgtatttttagtagagacggggtttcaccctgttggccaggctggtcttgaacacctgacctcaagtgatccacccgcctcagcttcccaaagtgctgggattatagtcgtgagccactgtgcctggacttaaatttaatatctcatttaaacattaaattaatgtagctatctctggattagagcaaatgcctttttgcccatttcaggtctgagatattgttgttgtaagaactaacaactagccctcattttgcaactgttgtcagccctttttatagctgattttatttattttaattaattatatataaattgtattctagtactgtgggaaaaaatgttttattttagctgttaaattattgaacctttcagggtcttcattttccttgtctgtaaaatgagatagttgtgtttattcctgctagctacggtttagtgatttgagctctggggtatttttggattttgtgtaagggaattttcttctgtagtttttccacatagatcatgtggtagccactgacatactaggatttaaattttacccctgaaataatctcctttatgagttacaaactattagtgcatattttatcttataatgatgaacagtcttgaaaatgttaggatggaggacataatgcaaagcaatgtcaaaattttccttttataaatcaaacaaagcaataatgctggtaatgttgactgaataaattaaaacttcattttttttttttttgaagacttgggattcagtaacaggtaaacttggcctggataattttttttttagaactattttataaatattctttgtttgctttgaggttgcatttacattgcttttgtttttaaagttgtattcagttaactgattgttttcttaatccaatggtcagtggctactgttaacaaccagtttgtatgtgatctttcctgacttgaatgttcctgctgtgagttgaattagatcatacttgtgaaattctcctatgtcattgatggcaagtcaatgctagaattccaagtattacttttatttcgatgaagagttctcagtcagaagctctgattgctctgtgggtacatggtaaaatagtactttttaaaatgaaatggtgatggtagatggtttttttttaaatatttatacttggcaaaataaaaaagctggcaatccttgcaggtttccaattttttaatttgaaaattgaactgctttatgggaaccaaaagtatggaaatcagtagtctagatcagtgtttctcaaactgtgtgccaggagatttaataggagttcagaattatggtaaaatattgcataccaaattgttgccctatctccatccctccacttccccttttatgacatggaatggcatattaatggttctgaaaaatcattcattaaagcagcatgtttgatatttagttcaggcttttctaaatctagtttttctccccaccttaaccactggttaatatcctgtgaaacgtggtttgagaaatattccatatccaaatcactcagaataatttattagaacctacagtttgttgagaatttagtatattcccagtactatctcatttagatgaagtgagctacccagtgtcacacaactggttggttattctgtgtttccagtccgattgtgtgtgtgtgtgtgtgtgtgtgtgtgtgcatgcatgcatgcatttaaggtggacaacatgatgttttgaagtgcacatacatagttgaaatgattaccagtccagctttgttttgcttcacattcattactctaaccacttaggctgttctgaagcattgcttagttctcatttcgaggctaagtacctaagactaggatattcagaagttcattttatatgccttttgacttccctaactactagaatgtggttaagggaagtatgattttatcagagcatatactttgtaggtgattttagtgacttttaatcccaggttatttttctttctacacaatgcttggaatgtagagcttagaatttttgctgagtgaatgaatgttgtcactttgtcaaagaagattctgtcagcctaagctaaaagcaagaaagtacattttacttctaaactattgtggtacacatcagagctaaacatctatactttttggctcatttatcattttatatttatgccactgggttgttccctttcttgctgcctttagtgtgagcaagccaaaaacactataaatcttttctgctatattatgttgtctgaggttaattaacattttctctggtaattcttgtagtcctgtgtgtttcttccttagaaaatttggcttcttgaccatctgatcaagcttgtatcaagtaacactttgtcttgtgacctgattttctgccttggtacacaatgagctaaagaagcttggttgattatgcactcctgtttggaatctgtaatgtcagtgttcaatcatggcctgaattaaggaacaaaatgataaaggtggctgggtgcggtggctcacgcctctaatcccagcactttgggaggctgaggcaggtggatcacttgaggtcaggagttcaacaccagcctggccaatgtggtgaaacccatctctactaaaaatacaaaaattagctgggcataatggcgggcacctgtattcccacctactgggaagctgaggtgggagaattgcttcagcctgggaggcagagtttgcagtgagccaagatcacgccactgcattccagcctgggcaacagagtgagactcagtctcaaaataaataaataaataaaggttgtgaatgtgaatgttactattcttagggggatgaaaccataaatcaaggtagttttattggcctggaactgaatcacagcccttcaaacagtatttaaattgtataggtatccttgtgtaacactgaaactgtggcctattgttttcctttttagtaaactgattttctttattaatagccaagtgaacaattgcttacaactccttgagctcagagaactaatttcaaaatgtttagactggaaactttctctttcttgtaatgaatgagaggtatgtcttccttaatttcttgaaggagagttgagagaaagaagtcagtgaggacagtatttgtactctagaaagagattttcacagagaccttgaggataatggtggaactgggaacagaactcagaagttctgttgtctttgttttggggttcacttgatgcttttgaaaagggaggaggatgtataacctggcttgaaaagggaaccagtctctttgacctagtgacgagacttagcatcagagtaaaagtatagtgggtactggcctaggagctgtgatgtgtggcaaacattttgtgttcttaatccttctaattagaaatttctgactgtcttgccatgtgatactcaaagagagtataaacaatagaatgtgactaacttaaaattgtggctgtcagactagacagaaaatgggcttcttttttttgacactttaatcaccattggaacttctgttttagataaaataaacactttaagttgataacgaagaggtagaaaaacatagctgtgaaattaggaaaaaagtagtaagtctttatattacatttgatgtactgaataagtattggatacaaacttgtataggtttcaagagtatttaaatttcacattatgtgacctgatataaataggtctgaatttgtagctccttgtcctctaaggtgtcacgtattgtgataactaatcctttgaaatacgggaggcaaaagaaataatgcattaaaaccacccttttcctttccttcctatatttctagtgctttgtgtcctcttgggctgttcttttaagtgggtaagcatcagggctaagctatgcttagggagttgttctcgattcagaacctgccactgagtatcttcactagagttgtttacagtaatcttttagagcctagggggaaagcagcttagtttggtggaaacagttgggttcctgtttccagtgattctaggtaagtaacttaggttttttgttatgcttttcttttacagatgggatgatagaaatgactcggctgggcgtggtggctcacgcctgtaatcccagcactttgggaggctaacatgagaggattgcttgagctcaggagttcgagactagcttgggcaacatggcaaaactccgtctctacaaaaaatataaaaattagctgggcgtaatggtatacacctgtagtcccagctactcgggaggctgaggtgggagaatctctggagcctgggaggcagaggttgcagtgagccgagatggtgccactgcactccagcctgggcaacagagcgagaccctgtctcagtttaaaaaaaaagagagaaatgagttactgaattagaaatgagttactgaaaaagagagaaatgagttactgaggggtaagatttcgtgactgcatacattggaaatattttggggagaggtttgttgtgaagacttgacgtattaataggtaagcgtaggatagatttccatagtgcctgacatataattggcatttgattattattcttgatttagtgttcctccctttaaaagcatagttattttctttctttctttctttttttttgacatggagtctcactctttcactcactgcaacctctgcctcctgggttcaagcaattctcctgcctcagcctgcacagtagctgggattacaggcatgtgccaccacgcctggctaatttttgtatttttagtagagacggggttttgccatgttgggccaggctcgaactcctggcctcaagtgatcctccctccgtggccttccaaagtgctgagattataggctgagccactgtgcctggcctaaaagcatagttattttcaatcagcatggtataatgaaaagaagatggaattttggattcaagaaagaccaaggtttaaagctccttttctttttctttttttttgagacggagtcttgctgtgcgctctgcgctgtgcccaggctggagtgcggtgtcgtaatcttggctcactgcaagccctgcctcttgggttcatgccattctcctgcctcagcctcttgagtagctgggactacaggctcccaacaccacgcccagctaatttttatgtatttttagtagagatggggtttcaccgtgttagccaggatggtctcgatctcctgactttgtgatctgcccgccttggccctcccaaagtgctgggattacaggcatgagccactgcgcccgtcctaaagctccttttcatcccttgggcaatgttctgattttctattattgcctaacaagtctatccaaaatgtagtggcttaatacaataacttattattatctctcatgtttctgtggattgacagggttcagctggacacttctccccttaaggtctttcatgtggttgtggtcagatagtacctggagatggggccatctgaagactctgccctaggctggatccaagatggtgttttccttttacttgtctgatgtctcagtgctctttgagatggcctctttatccagcagagtagcctaaacttatgtggctgctcagggttccaagagttaggaagtagaagttgccaggcagttaagggctttggaactggcatagtattgtatctattaaagaagtcacagggcctcccagattcaaggggcttgagaaataaactgcatgtctttaaagggagtgggaaggtcacattgcagaagaatatatgggctgagaggtcttattggggctgtctctggaaggccatctgggcacaattttttttcattttcttgtttgtaaaatagcaataacaatatttacctcacagagtggttaagtggaatagcacagtgtcaagcacatcatgtgtttagtaaatataagtagacttccccccttaattctctaatgtaacaaattacttctgatctacttttattttaaatggccgcaagtttgctcagtatatggtttggttaactgtttcttcacccgactatgtttctcagactgttgtaacttaaaacaaactttatcatggaaaatttcaaacacatcaaagtaaagagaataccacattaacagaataagggacaaaaactgcatcatcatctcaattcatgcagaaaaagcatttgatagatccagcatactttcatgataaaaacactcaactaggaatagaaggaaactcagcatatcaaagtgtatttatgaaaagcccacagtggctgggcctgttggctcatgcctgtaattccagcactctgggaggccaaggtgggaggatcacttgagtccaggagtttgagaccagcctgggcaacaaagtgagacctaatctctgcaaaaaataaacacaattagccaggcatggtgatgtacgcctatagtcctagctacttgggacgctttggtgggaggattggttgagtctgcagtgagcaaagatcgtaccatatcacttcagaatgggcaacagagcaagacccttcccaccctcacccaccccctccccccaacaaaaaaaagcccacagtgaacatctcattcagtggtgaaagaccgaaagctttccccctaacatcaggaacatggcaaagatgcccattcttgccactgctatttcaacatagtattaagagtcctggccagagccaatttaggcaagaaaaagaaaagcacccaaattagaaaggaagaagtaaaattatctctgttcacagatgatatgatcttatttgttgaaaacccggaagctggctgcagtggctcatgcctgtaatcccagcactttgggaggccgaggcaggcggatcacgaggtcaagagatcgagaccatcctggccaacatggtgaaaccccgtctttactaaaaatacaaaaattagctgggcatgatggcaggcatttgtagtcccagctactcgggaggctgaggcaggagatttgcttgaacccaggaggcagaggttgcagtgagccgagattgcgccactgcaccccagcctggtgacagagcgacactccatctaaaaaaaaaaagaaagaaaaccctaaacattccacaaaaaaccctgttataactaataaatgaattcagcaaagttgcaggatacaaaatcaacacacaaaaattagttatgtttccatacacagtgaacaacttgaaaaattaagaaaacaattccattaacagtagcatcagaaagaatgaaagttaggaatgaccctaaccaaagaagtgaaaaatttgaatattaaaaaccgtaaaatactgctgaaaagaattaaagagcatacaaataaatagaaagacatcctgtgttcatggattggaagacttaatattgttaagatatgaattcttcccaaagcgatctacagattcaacagaatacctatcaaaatcccaacagcattttttttgcaaatagaagtttcatcccaaaattaatttggaatctcacgttacccctaatagccagaacagttttcaaaaagaaaaacaaagctggaggactcaaactttctgatttcaaaatatattactaagctatggtaataaaactagtgtggtactggcataacaacagacatatagacaatggaatagagactccagaaataaacccttgcatatgtggtcagatgatcttggacagaggtgctaggacccctctgtggagcaaggacagtctcttcagcaaacagtgttgggaaaactggactttcacatacaaaacaaaaatttggactcatattttacactatatataaaaataaactcaaagtggattaaagacctaaatataagacctaaaactgtaaaactcctaaaagaaaacttagaggaaaggcttataacttaaaacttagaggaaaggctttataactttggatttggcagtgatttctggcatatgacaccataagcacaggcaacaaaaggaaaaataggcaaatgggactgcatcaaacttaaaaactttggtgcatcaatgaacacaatcaacttgaaaaggcaacctgtggaatgggagaaaatgtttgtaaattgtgtatctgttaaagtattaatatccagaatgtagaaagaacaacaactcaacaacaaaaaatcaaataaacagattaaaaaataggcaaatgacttgaatagtcatttctccaaagatgataaaccaatggtcaagacacatttgaaaagatgttcaacatcactaatcatcagagagatccaaatcaaaaccacaatgagatatcacctcacatccattaggatggctactattaaaaaacaaacagggaattacgagtgttagtgaagattatgagaaattggaactattcttgtgcactgttgggactgtaaaatggtgcaactgtgatggaaaacagcatggcagttcctcaaaaaattaaaaatagaattactatgtaatccatcaaactcatttctggatatgtatccagaagtattcaatgcaggacctcagagagatatttgcacacctatgctcatagcacattcaggatagctaagaggtgaaaacaacgcagatgtccttgatgaataaataaaatatggtatatacacacaatggaatattatttagctttaaaaaggaaataaatcctgtcatatgcgacagtgtgggtgaaccttgaggatattgtgttaagtgaaataagccagtcaaagacgaatactgtatgctttcacttatattaggtattattactgaaacaccagggatgtgttctaggttatgctgcttgctgcacagaaagccagttgctgagacgatgagttttgccagagaaggaggttttaattgggtgctgtagctgaggagagggtaactcagtctcaaatccatctccctggctgactacaattaagggcttatatagcagggaagaactgtaactacatgcaggaaaataggaattagggagagataaggaagagaagttggtcaacaggaagcaggaggtcacttaggcaatcatgatgggttgaggggtttgaggtttcattgtttagatgcagtgatctggtacgtttcagttccttgatatcatctgggagacctgatggttggtttcctgagaaaggaactcagataagacaaatgtaactttttcaagttttaagactgggagggtcaatttctatctttattcaaaagaaactataatggtcagttctatgggacagttaggttgttggtgtcagtatcaaaaattataaattcatagaaacagaggtagaatggtggttaccagggaatgaaggggagaaatgggttgttgttgtttaatgggtatagagtttcagttttgcaagatgagaaggttctggagatgtttcacagcagtgtgaatatacttaacacttctgaactgtacacttaaaaatggttaatatgggctgagtgtggtggctcatgcctgtaatcctagtattttgggaggctgaggcaggcagattgcttgagcttaggagttcaagaccagcctgggcaacgtggtgaagcctcatgtctacaaaaaatacaaaaattagccaggtgcagtggcatgcacctgtagtctcaggaggcggaagttacaatgagttgagatcatgccactgcgctccagcttgggtgacagagggagaccctgtctcagaaaaaaaaaaaaagttaagatgggaaatttttatgtattttctaccacaaaatgtgtagacagaataatacaacaaatctacatgtatacagcttcaacaattatcaacttataaacaatcttattttatttctgtcctcatctaacaccttgtctcttgattagttggaagcaattgatagagtttttgagctcttagagtgaaggggtggacccttaacatagctggaaatcatgggaaagctagtgacttgtgtgaatccagaagaaaagtggtactagtaagtggagtgatatgaagtctttataaggaaaatctagaaacaggaaatataataactttagagtatcattttggggtttccaagtatctaagaggcagattaaagaaatggaagtgagatagttttttgagaccagactttgttctgaaatcagacttaagatacaaatgtgcattttttactttgataattagagaatgaagatcttgtgtattctaaaaagttctctgtttttcctgtaatgttgattgcaggaggatagtccagggctgtgtggtttgttttataagtagctacttttatcaagaataattagcagagcatttgggaagagttttggcttttcttccctgaaatcaaaatataactatttagaaagcttttattgtcgcttataaatggaaggagtacttgtcacttccaaatgacaggaagaaccatagagcacttctacagtttgatttatatctcttaagtgtcatgttcctgtgcgggagctgtagtggttgacagcctggttcctagaactgagaggtgaagcccgctgagcttctggattgggtggggacttggagaacttttgtgtctagctaaagcattgtaaatgcaccaatcagtgccctgtgtctagctaaaggattgtaaacacactaatcagcactctgtaaaaatgtaccaatcagcactctgtaaaatggaccaatcagcgctctgtaaaatggaccaatcaagcaggacgtgggcggggacaaataagggaataaaagctggccgtaccagccagcagcagcaagcagcttgggtcccttccgcgctgtggaagctttgttcttggctcttctcagtaaaacttgctgctgctcactctttgggtctgcactacttttatgagctgtaacactcacctggagggtctgtggcttcattcctgaagtcagtgagaccgtgaacccaccgggaggatcaaacaattccggacgtgccaactttaagagctgtaacactccctgcgaaggtctgcggcttcactcctgaagtcagcgagaccacgaaccaaccagaatgaagaaaccccagacacatctgaacatctgaaggaacaaactccggacacactatctttttttttttttttttttttgaaatggagtctcgctctgtcacccaggctggagtgcggtggcgcgatctaggctcacggcaagctccgcctcccgggttcacaccattctcctgcttcagccttcccagtagctgggactacaggcgcccgccaccacgcacggctaattttttgtatttttagtagagacagggtttcaccgtgttagccaggatagtctcaatctcctgactttgtgatccaccctcctcggcctcccaaagtgctagaattacaggcgtgagctactgcgcctggtcaggacacaccatctttaagaagtgtaacactcaccgggagggtccgcgcttcatttttgaagtcagtgagaccaagaacccacgggaaggaataaattccggacacagaaccgtgactgggaccatgtgaagtggggacttcacatgatcccaataggagatcgcaccactgcactccagcctgtgtgtcagagtgagactctgtctcaaaaaaaaaaaaaaaaaaaaaaaaaaagaaagagattagatgccccttgccatgcagaaagttagggaaatagtgttctagttacaggaagcttttaggcagtgctgagcttgatgagttcaaagaatcaaaagaagtccagtgtgtggctggaacacactgaaggaggggaggggtgacaatgagattgtcaagttgagcacagaccagccttgtaaatcatgttaaagaatttaactttaagtgtttttgtaaataattgaaatattttaagctgggtaatgacatggtctgttttatgctttaaaaaagatggttcttttttgatttcagattggaaaggactaaaagagaagcaggacacgacttaagagggaagatattcgggctgggcgtggtggctcacgcctgtaattccagcactttgggaggctgaggcaggcggatcactcgaggtcaggagttcgagaccagcctggccatcgtggcgaaacaccgtctctactagaaatacaaaaattagccaggtgtggtggcacatgcctgtaatcccagccactctggaggctgaggtgggagaattgcttgaacccaggaggcagaggttgcagtgagccaagattgtgccattgcactccagcctgagtgacagagcgagacttcgtctcaaaaaaaaaaaaaaaaaaaagaaagagggtaagatatttagtgctcagaaccagtgctggcttgggttaaggtagcagcagcggcacaaggagtatgtagatgtgggaaatgtgtttgtgtttggagtaccaggacttagtggtgggaggtgaaagagaggcgttatgaatgacccctgggtttctagtatgagcaaactgatatgccacctctcgagggtgtgtgtgtgtgtgtgagaaaaagcatgtgagagagcatacatataagagtaattgagtctggaattcagaagactggcctgggatagagatacacatttggggggagttggcatgtagagagatttaaagcaataggaatgagtgagagagggagagagaagaaagagggcctagcactgtgatttcatttttctattgactctgttttttgaatttaattttagacattagaatagataaggttagctttccaaaatcagtctcatttgtattcggcattcagataaactcatatatttgcatatattattgttattattttttgatacagggtctcgctgtgttacccagactgcagtgcagttgcaccatcacagcttactgcagcctcaacttcctgggctcaagtgatcctttggcctcagcctccaagtagctgggactacaggcatgcgccaccatacctggctaatttttaaatttttgtagagacaaggtctcactatgttgcccaggctgatctcaaactcctgagctctagcaatcttcctgcctcagcctcccaaagtattaagattataggcgtgagccaccacgcctgaccagataaattttcagaatgggaaagggatggagttgcagctttctgggagggtaggggatgaaggagtagaggaggactcagggatttatgtggtctccagattacttcatttctggagtagtttacagtatgcccattatgaatgtgtctcatcctttatgtgtgtagtggagaaaaaaggttgagtttctgatcctcaaggtaaagtcgatattaatagttaactaaagtttcctacattctggcccctatctgcctgtctgcatatccacattcataccattcccttccaacctccatgcatgctgttttctatcatcatggtcctagacctagaatttcctttttcattggacaaatattttaggtctctgtttcagtcagagctttccctagttcccccaggcaaactctgtatttgtttctgtttctagtgttcattggttatagcaattattgtattaaatttgctgtttcttggtttgactgtctcctcaagaaactaatctttttgacatgagggattttttttttcttttaaaaaagcacttgagggccaggcatggtgggttttgcctgtaatcccagcactttgggaggatgacttgagcacaggagttcgaggctgccttgagccgtgattgtgccactgcactccagtctaggtgacagaatgagaccccatctctttagaaaaaaagtgtttcagtgtttgaattaccatcctgtctttctttgaagagccaaatacagcttacatcatcttcaggtaaaacaaaatttagggttcagaaactatatggcataagaaaatagttgaactgggcacagtgtttcatgcctgtaattccagcactttgggaggccaaggtgggcagattgcttgagctcaggagttctttcagaccagccagggcaacgtggcaagaccttatctctaccaaaaatacaaatagctggtcatggtatgtgcctgtggtcccagctgaggccggcaggattgcctgagccctggaggtcaaggctacagtgagccaaaactgtgccactgcactccagcctgggcaacagagtgagatcctgtctcaaaaaaataaataaataaaataaaataaaaaataaaaaagaaacaaaatggttgaaaatgtctttcccatgcctttggagtctaggatgaggtttaaaaaaaaatgtgtttctcaggtctattttaataggtagttaaaatatactttaaaaaattattataaggcagtctctaaagtgtattcttatccccaaagcttgatattacttaaaagaaagatgtattactgaaggaaatagaaattgaattaatggaattgttttggttatttgaattgccatttctgtagggtatttgagaattgttaggtcttgtttggaaccattgataaacagaagatagaatagaaatattgtactgcctcattgttcctagtctacaaattgatttatgctgttattcagtttatgtctctctttctctttttttttttttttgagatggagtttcgctcttgttgcccaggctggagtgcaatggcatgatcttggctcactccaaccttgacctcctgggttcaagcgattctcctgccttagcctctcgagtagctgggattacaggcatgtgccaccatggctaatttttttttttttttttaagtagagatggggtttctccatgttggtcaggctgatctcgaattcccgacctcaggtgatctgcctgcctggcctccgaaagtgctgggattacaggcatgagccaccacacctggcccagtttatgtcttttgtatgtacacagtaaaaagtagtagtctctttctttacatagtaaaaagtagcagtttcttactttttttttttgagacagagtctcgatctgtcgcccaggctgaagtgcaatggcactatctgggctcactgcgacctctgcctcctgggttcaagcagttctcctgcctcagcctcccaagtaactgggactacaggcacacgccaccacaccccagctaattttacatttttagtagagatggagtttcaccatgttggcaagggtggtcttgaactcctgacctcaagtgatctgcccaccttggcctcccaaagtgttaggattgcaggcgtgagccaccgcgcccagactaaaaagtagcagtttctatacccatcattattataatgttttactgcgttgatatgtatatagtggagcttttttgttagatttgaagaaaaaattggacgatgaattcattctaattaaaaaaataggccaggcacggtggctcacacctgtaatcccaccactttaggaggccaaggcaggcagatcacctgaggtcaggagttcgagaccagcctgaccaacatggtaaaaccccgtctctactaaaaatacaaaattagctgggcatggtggcaggtgcctataatcccagctacttgggaggctgaggcaggagaatggcttgagcctgggaagcagagattgcagtgagccaagaccgtgccattgcactccagcttgggcagcaagagcgaaactctgtcttaaaaaaaaaaggccgggcgcagtggctcatgcctataatcccagtactttgggaggctgaggcagggggatcacctgaggtcgggagttcaagaccagcctgaccaacatggagaaaccccgtctctaataaaaatacaaaattagccaggcgtggtgttgcatgcctgtaatcccagctactcgggagactgaggcaggagaatctcttgaacctgggaggcagaggttgtggtgagccaagatcgcaccattgcactccagcctgggcaacaagagtgaaactccgtctctaaataaacaaataaataacctaaattttaaaataaaaaaatctttgacactctacctttcagctgtcagtggaaaccacttaggtagctatgaagcaattctgcaaatattttatggaattctatatttgccagagtataatagaaaaaactaggccgggactgggcgtggtggctcgtgcctgtaatcccagcactttcggaggccgaggcgggtggatcgcctgaggtcaggagtttgagaccagcctgaccaacatggtgaaaccctgtctctactaaaaatacaaaaattagccaggggcttgtaatcccacctacctgggaggctgaggcaggagaatcacttaaacccaggaggtggaggttgcagtgagctgagatcacaccattgcactctagctcctgggcaagagagcgagactccatctcaaaaaaaaaaaaaaaaaaaaaaaaagaagtccgggtgtggtggctcacacctgtaatcccagcactttgggaggctgaggcaggtagttcagctgaggtcgggagttcgagactagcctgaccaacatggaaaaacctcgtctctcctaaaaatacaaaattagccaggcgtgttgtcgcatgcctgtaatcctagctacttgggaggctgaggcaggagaatcatttgaacccaggaggtggaggttgccgtgagccgagatcatgccattgcactccagcctgggcaacaaaaagaaaaacaaaaaaaaaagaaaaaaaactaggctgggctcagtggcttatgcctgtaattccagcactttgggaggctgaggcaggaagatcacttcagttcaggagtttgagatcagcttgggcaacatagcaagacctcatcctctacaaaaaataaaaaaaattaggtatgttggcatgtgcctgtggtcctagctactctgaaggctaaggcaggaggatctcttgagcctgggagatggaggctgcagtgagccatgatcataccactgcagtccagcctgggtgacagagtgagaccctgtctcacaaaagaaaaaaaaaaacaaaaactacttgagtcagcgagtacatagaacatttcagagcctcagcttgtatactgcatgttattctgaaactacagataccacgtagctttctaatgaaaaagttttatttgtttcttcctttcttttataggaatatatatgtcccagatgtgaatcaggctttattgaagaagtgacagatgattccaggtattgtacaagctcatgaataaatcagacattctattatcaaaactattttctctcagcatggactgagtaagttgaatttgttttacaacttacactctacagagagagcgagagtgagagagagagagtgagtgcatgagcttgcacaagagagggcagaagaatgggagaggaaaaagaaagaaaaatgggaaaatttggaaagtgatatcatagcagatgtggtgatacgcactgctcctgattgtatgtggcattccatgtacatctgtacgcatgtcagagtaaatctggtaagttttcatttattatctgagacttggggcttctcttagattattagttggtttttagtgaccactctgctgtctgaaggtaaactgctgttatacctctttggcgggttagggagtgacttctgacaaagatacctaatcaggtaaacaggctgttctagccaggaaaaccgattgttactctgctttgaggaggccttgaatctcttgttcttattaaggttatttggccagtgtggtggctcacgcctgtaatcccaacactttgggaggctgaggtgggtggatcacctgaggtcaggagctcaagaccagcgtggtcaacatggtgaaaccccgtctccattaaaaacacaaaaattagctgggtatagtggcgggcgcctgtaattccagttacttgggaggctgaggcaggagaatcacttgaaaccgggaggtggaggttgcagtgagccaagactccagcctgggcaacaagagtgaaactgtgtctcaaaaaaaagaaaaaagaaaagattattgctgtcaaacttaggccatctttccagggtgatattaatatatgggtttgtaatgcttggaatttgttcttattggccttcataaaggtatacagctgataaaaaggggaaatatttctgaaagtgactattacatattccttttttgtttatgtgaacaaaactataaaatcttttttcttttttcttttttttttgagacagagtcttgctctgttgccagattggagtgcagtggttcgatctcggctcactgcaacctctgcctcccaggttcaaatgattcttgggcctcagcttgcccagtagctgggactacaggtgtctgacactatgccctgctaatttttgtgtatttttagtagagatggggttttgccgtgttggccaggctggtcttgaactcctgacctcaagtgatccgcctgccttggcctcccaaagtgctgggattacaggcatgagccaccgtgcccaacctaaaatctttttcttttttttttttttttttgtgacggagtctcactcttttgcccaggctggagtgcaagggcacgatcttggctcactgcaatctctgcctcccaggttcaagtgattctcctgcctcagcctcccaagtagctgagattacaggcatgcaccaccacgcttggctaatttttgtattcttagtagagatggggtttcaccgtgtttgccaggctggtcttgaagtcctgacctcgtgatccgcccatcttggcctcccaaagtgttgggattacaagcgtgagccactgcacctggcctaacttaaaattttaataaattttagaatagcattgataggatggcctcttttggctaaacaaaatggcacatttgttcttttggggctatttggttaaacattcgtctgaaaattgaagaagtaccgactggtcaaaaagaatctgtaatctgaagcctcttaatcttggagtgactttggagattttaatggcagtaggtaattcctttactgttactgttggcagaatctaaagttgaaggtcccttccacaaccaggaaaaactacacattttacagtatgtactattagttttactttactaatgattggtgattatatgtgtaaataagctggagcttctggggcaatatgtggcatgggatctattttgatacagttaaatgtcatcttggttttaaatagtacaataccaacactaaacgtgtaagattagcatgactgcaaaattagcaattttgtgtggatggcatgctaacttgggatagctttttgtttgtgccattataattgcatcaaataacttatttcaggcacttatgctctgcatgtgctaattaaaagatatattggttgtgggagaacaattaatgggcttatcttttgccaacttttcaagtagtaaccctggtttctttaggcagatagtacttttatgcaaatacagttataaatgagaatgattaactgtaggatgaatctttgtctagcagggaactgtggattctgtggtttttgttcttaattcttttatgtgtctttgtagatcaaaggttgtcttatataggtgctattggtagcaatttactcaaatacaaagactctgtggtttgaaagagattagtgttttaaatgaaagaagaaatctttttcttagaatccttgtcttagaggcagtatgatatttccttctataaagttcataaacatttgctgatttaaatacttagcaattgcagtggtaagtagtggagggtaaaaaccagtaagaggagggccttgcatgtaaatattagataatgggctccatctgctcttaaacttccatgtagaggagcaccttgtaagttttcttaagctttgtaacatttctcagaacaatgtggtggtttttattatcccttctctatgattagctctattattctttaaaggaattttaaggaaagggaacggtgaggtagcttcagggagagcagaaccccagaaaataagagttgcggtttcaattaccaaggatgtttgaatccctgaaactgtgtagtaaaggcaggaaggaagagtcttggaagcctgtctgggcttgagcaatcaaatggatacatagccactcaatgtagttttttatggtatgtggtagttcaattagctgtttatttagcatagatgtacaagtacttttgggcttgttatacatttggagtgatttttacaaaagcgtttttctgaaattaatgcaggtattaaatggtttcttatcagggaataaggcttgagaatggttgcataaagagtggcattagctttgctttttcacttttggtttcagactaactagggtgtgtttgtttcctcagtgagctcagcacaatgcctggattggtattgtaatcctacaaatgaaaactatttgtagtagtttgtgaacttaccattggggtgagtgtttgtatgtttgtgtgcttaagtgtgtctcttgaagtaaaagtggtatccagcagttcctgtgattctttccatcccctcttcccggatgtgttaacttgttttctttgttctttgcaaatttcatggggacaatgggatttaatatttctctccactcttcagggtctttgggaatagatagttattttatcattttcacatgtgattaattcaacaacttttgagtgtcaatataggatattgacattgcaggattttaaaaggtgatagtactgtgtaatgtctgacacttaaacactctacatgtatttgaggcattaataaattgcagtctttgccttctgaatttatattaatgaaggagggaaatgggttgaaatggatgtggcaaatcctagatatttataatacaaggtaggttttagaatcaaagtgagagtgcagaagggtgtggaagagtcttatttggttggtgagttcagaagggcttgatggaggaggtagcatttgagatgggtcctgaaaggtgggtagggggagaaatatttattgaatccttttataatgttttaaatacagtaccaggccccttacattactacatttaatcattcctaagaaatattaactattgtagcctcaaatgttgtgttcatctggtggttgaatggttttttagtgaaacattttgttttgttagcgttcttgaggataaatatttgtcttttgataggtcaaatccgaattgcattgctgcctgtgggtcctccttccttctctatggtggcttctccaatttttcactggatttagccttgaaaaccacttgattttgtggtttatgatacttttcatagattaattcacatgccagttattcataatttcctttaataggtgttgtgttgggatgagttatttttccttattgggctttgttctcattatgccattctatatttagcttctgggaggggagcttgttcctgggaatagaatcaccactcattccttttctctttagttttttaggtggtggcggcagtcggatagacaataccacaacaacacattttgcagaggtaagttttcctttagctgtaggaattctttaagaagtggttaggtgttaaaatcatggcagatactaactttccagtgtggcacaacatcagagtttaactgaatgtataagaaaaaatgtgggccgtagtaacccttgggaagatttgtgttttcagtagctggggcttgggcgtgttacctttgataaacccttgattaggagaaagtaatagcctcaaactgtattcttttaaactggtagtgtttttaattcttgttttctactttgttattgtatatacagtgtgagaataagaagcttttgctgtttttgaaataacagtgttgcagactctgctttagtggtgtgacaaccaggtaaagtgcaggccaggataagttgtcgaagtcacaatgaaatagtcttcaaccttgtacagaggtactgatttccagggcttacctctagtcaacacagtagtttggtgtagattaaggatgtttacttgcctttcagatcccaagatggggtctgtaaataatttctatatcttcttataatgtggcgtccatattttttgggaaaaacaaatcttaactgtgatttgaaaacagggcattagtcttcattcttgaataccattttatattgaatccagagtaattttcttttttcacttcgtccattggcctaaagtctctttagttgtgttttttttttttaaaaaaagaaaccattgtaactgttcttaagtgtataattcagtggcattaatactctttgtttttaatcatttagagactacaacccagaaggtaccagtcagcctataaaaaacactgacgtttttcttttgcttgtttgtatgtgtaccctatattgccgtacaacttgttcagctctagaaagctgacagatgctaaaaggaagaaataagttaaatcccataatcaggatttctttatgttttaggatcacattagccttttccagagatagccgaagtgcctagagagatagcaaaatatttcactgttttgtatgtaaattgaaattgtactagtagtatatttgaaaagtgatatttaataagaagcctgtaaaaccctaagcttctctcccttattatttgaaaattattttaagacctgtagcccccacattttgatgttgttagatttatcaacattgtctgggtaatggtcctgttctatttagggtggtttttctgcttatggtctgtgctacttcttaatatacagtattaagagttttggttaactctgaactgcccgggttgattagagtgattccagacagatcgtgttttgaacttgcatttttattttcccattttaatggattgaaaaacattatttaatatgtgttctgggccaggcacagtggctcacgcctgtaatcgcaacactttgggaggccgaggtgagcagatcacctgaggtctggagttcgagaccagcctagccaacatggtgaaaccccatctctactaaaaatacaataaattagctgggcatggtggcatgagcctgtaatcctagctacatggtaggctgagacacgagaatcgcttgaacccgggaggcagaggttgaagtgagtcgagatcgcactactgcactccagcctgggtgacagagcgagactccatctcaaaaaagtaaaatacaataaaatgtattctgtttgccagtcctggaagcctttatgatttcagtattctttcctcttgtgtgtgctatttgtgataacacagattgtcacttactgattaggcatatgcagaagaagaaatttcatttgatttttctttagtgttctcttttaggtaatggaaatagatcggtctgccaattttgtaggtatgactcaccagaaagagatgcattgagtaagaagaaaaacaaatatatgtagtcagtttcctaactttagtaatgctaaatccaacactgatggcatgagttatccttcaggtgttaaagtatttttgctgattcatagcttgtaacttcgtgttctttagatgttgccagggatttttaataaattagctaagaagtgtgtgtgtgtgtgtttttaagagatggggccttattgcccaggctggactcgaacttctgagcttaagtgatcctcccacctcaggttccctagtagctgggattacaggcaggtgtcactgtgcctggctgaaagtatatactgaatgtttcatacatagcactctcctagaaataggggcaggaagtaaatgtcatggttgccttgcctgaaaggaacttaattttgttgtggagcaagtgcaaacacttaagaaaacaaggaaggctgggcgtggtggcttacgcttgtaatcccagcactttgggaggccgaggcaggtggatcacgggaggttgggagttcaagaccagcctggccaacatggtgaaaccccatctctactaaaaaatacaaaaaattagccaggcatggtggtgggcgcctgtaattccagctacttgggaggctgaggcaggagaattgcttgaacccagaaggcggaggttgcagtgagcggagattgcaccactggactccagcctgggcaataagagtgaaactcttatctccaaaaaaaaaaaaaaaaaggaaaagtgtacagagtataataaatttattctggggtatatgtaacaagtatagtagaaggaagagttaaggtgggccagggtcttgaggagaggtcatataacagtgattaagaacacagcctctggaaccagattgcctgagctcaaatcctgtgtctgccacttattggctgtgtaatctgggcaaagttacttagaatctctcagtgcctctcttgtccttgtctgtaaattgggaaataatcatccttccctcatagggatgttacgaggattaaatgagttaatacatgctaggtgtgtagaccgcaatgtgcctaccatctagtgagtgcttgatacattttagccattattaagacttcatagtgaagttagaacttgcactggagccttgaagagtaggtggaatttagataagcaaagatgtgaaaattatctcaaaatagtattcataagctataaggttttatgctcatgtccctgaagaaaaaacttagaaataaaattatatatagaaactaaagttgtttttcttttccctgctttagttggtaatttcggcaaagacttatgctcagttttgctctatttttctttagctggagctgcttgtacaatgaagtggttattttctataagtaacatttactgatagctgaattcttaaaatactgtctatattagaagaggcttattccaagaaaatttctgtcaaaatcagtattgacttttttttaaaaaaatgagactggggtaggagataagagactaatgggatagagagaaggtaggggagggttgccagttacatgggagcagtgtttgaataatgtgtgagggccggtggagagtgaatctgaaaatattgctagcagtttgtagagagaagacattgctatactaagcttcctggtggtaatctagaaagtgagccccatagctacctgaaggtttcattgattacttgcaaacttctgaccacgacctggtgccagtgggtcatctgatcttagagtctcagcttacctgaatggattgcttcagtgcaagagtggctctggctgctgcctcagattgggagaaaataagatacatggctttctggaaaaaagagctctcaggtatgcacaagagggcagggtgctctgagctgatttatatgtatttaaataaaatttgttatttgtttttgttacataagcagcattatagtggcagtaaaaaatttaaaaatatgtatcttgagtttcacttttttttttttttttttttttttagacggagtctcactctgttgcccaggctggggtgcagtggcgcaatctcggctcactgcaacctccgccttctgggttcaagcgattatcctgcctcagcctcctgagtagctgggaccacaggcgcgtgccaccacgcctggctaattttttatatttttagtagagacggggtttcaccgtgttagccaggatggtctcgatctcctgacctcgtgatctgcccgccttggtctcccaaagtgctgggattacaggtgtgagccactgcgcccggccgagtttcactattctaagagctcccttttccatacatttcctttcagattttgtcctaaggcatagttactgaaaaataacaaccttaagctcttttttgtttgtttttttgagacggggtctcgctctgttgcccaggctggagtgcaatggcacgatctcggcttactgcaacctctgcctcctgggttctagtgattctctcacctcagcctcccgagtagcttggattacaggcccccgccgccaaacctggctaatttttgtatttttggtagagatggggttttaccacgttggccaggctggtctggaactcctgacctcaggtcatcctctcgtcttggcctcccagagtgctgggattacgggcttgagtcaccgtgcctgggcctaagcttttttaaaaatgagaaatattggccgggcatgcagatcacttgaggtcaggagttccagaccagcctgtccaatgtgatgaaaccctgtctttactaaaaatacaaaaattagccgggtgtggtggcgggcacctgtaatcccagctattcgggaggctgaggcaggagaatcgcttgaacccaggaggcggaggttgcagtgggctgagattgtgccactgcactctagcctgagcaacagagcgagactccgtttcaaaaaataaagaaatatcccatattgtcattacttgattatagctttatgcattttttagcaaaatacttctcatttctcatgtgcatacctcataactgtttagagttgctgtcataagagtatattgtatttctgcctctaaaaatttacttggtattatgtcataaaccttttacttgtctctctatagttattagaattatagctggacgtggtggctcatgcctgtaatcctagcactttgggagggcggaggcaggcggattgtttgagcccaggagttcaagaccagcctgggcaacatggtaaaaccctgtgtctacaaaaataaaaataaaaagccaggtgtagtggcatatgtgtgtagtcccagctactcgagaagcggaggtgggagaatctcttgagcctgggaggcagaggttgcagtgagctgagctcgtgccactgcaccccagcctgggtgtcagagtgagaccctgtctccaaaaaaaaaaaaaaaattaggacttcatattctttaatggctacattatatttattaaactattatcctgtgttaggcatgtctagttatatatgatggttgatcatcgatcatacttcctttacctgagtctagaacatactgagaaaacatagaacaccagacagatggatataaaaatttaatttttattcagctgaattggaacacaaagttgaactgtggtcaaatggacatcctaagtttatacaggatgacctacctgagaattagaggctgcaaagcaggcacacataatcagaacaatgtactttgcatttgtgcaacttcctaatacatgaactccacttgctggagaaatgcgaaatcactagagattagactttgctattcactaatcagctacatcattcctctgttgaaaagtacatacaatatgatgccctttacataaaattctagaaaatgcaaaccacagaaagatcaggggttgcttggggatgggaaggggcaggagggaaggattacaaaggcacacgaggaaacatttcggggtgatgagtatcttccttactttgctttaatgttttcacaaaatcgcctgtgaactttttcaagattacatttctaaggttaataattataaaattatttacccttaattgactcatctttatacactctaatgttattttttgagatataattcatatactacgtaattcaccctgttaaagtgtacagctaagtggttttagtatattcacagagttatacaactattaccactgatttagaactttttcatcatccccaaaagaatccccatacacattagtagtcactacatatttctccacagttctctcagccctaggcaaccaccaatctattttctgtctctatggatttgcctatataggatatttgttataaatgaaatcatgcaatatgtgaacctttgtgactgactcttttctaattagaatactgttttcaaggttcatccatgctgtagcatgtatcagtacttcatttttatggctggataatactacatggtatggatattccacattttatttattcatcagttgatggacatttaggttgtttacactttttgcctgttatggataataatgctgctgtaaatatttttgtacaagtttttgtgtgatcatatgtttttaattttcttggttatataactaggagtgaaattgctgcgtcatatggtaactgttcaactcattgaggaacagaccataatattttaagaagtgctgatgtgatcatggttagtgtagagcaagttctgccaaatggaagatattgtccatcctgttttttattttgaatgtgtaaatagttcaccccaaatattttcagaaatactgtcattatacttacattcagagtaatgttttcagtttttcaaggcaaaacttgtcaaactgtctctgtgattctttagactgttttagcaaaactctatgatagtgttccctattagtttttacttatgtaagctgtgtcctgaatacccagttttgttgtatgagctattttttttttcttttatgcttatctaagtctactcagagacaaatgacctgaagctatttttatccttagtgctgatttggtataaatttgtgaggtgtgcttttccatcctgtgttctttggtcagggtacactattattttgagattaaaataggccacaaatacattgactgttactattaatttgcactaatttgcactttgtatactagtaggaaaatgcctcatgctgatgttgaagctgtttttaagcatggatcctttagaaattttgtatattattaggtgtggtaacaatttatagtcatctaaagtatgttagtatcaaagcagagtattatgaacttggtgcttgacttttctgccagtcaagattttaaatatttcatttttatattataatgaaactaatggttactttgagagttgtcttctgtgagcaaatgttgtggaattgtatatagtaagggaatcatagatttcttataattcaccttagtgagatagatgattgagaacatggaggagtctgctcgtactttttcacttattgaagacaagtatagttttaggtttttaaatgtcgtgtttactttggaattttgggtcaagagaattcttgtgttctagaccgtttttcagactagaaaccagtgatctctaatagatgaagactataattagaaagtaaagggaaataaggcagatttgataagaagcgcaaatggcagttaaaatgaaaaggtgttttatgtcaccagtatttagagaaatctttttgtttggagacagagtttcactcttgttgcccaggctggagtgcaatggcgcgatcttagatcactgcaacctctgcctcccgggttcaagcaattctcctgcctcagcttcccgagtagctgggattacaggcatgctccaccacgcccagctaactttttgtatttttagtagagacggggtttcaccatgctaggctggtcttgaactcctcacctcaggtgatccacccgcctcagcctcccagagtgctgggattacagatgtgagccactgtgcctggctgagaaatctaattgatgtttttactctgcatattactctttgttcttcagcttatatattagaatttttaaaactttaaaaaaatgttggtcaggctgggtgcagtggctaatgcctgtaattgcagcattctgggaggccgaggcaggtggatctcctgaggtcaggagttcaagaccagtctggccaacatggtgaaaccccatctctactgaaaataaaaaattagtcgggcatggtggcagacacctgtaatcccagctactctggaggctgaggcagcagaatggcttgaacctgggaggcggagtatgcggtgagccaggatggtgccactgcactccagcctgggtgacagagcgagactccttctcaaaaaaaaaaaaaaaaaaaatgttggtcagagtaggggtaaatgtaagcatttatactctggtaggagtctgaattggtacagtagcccccccccttaccctgtggtcaaccatggcctgaaaacaggtgagtatagtacaataagatattttattttatttatttttatttttatttttttgagacagggtcttgctctgttgcccaggctgaagtgccatggagtgatctcggctcactgcaacctctgcctcctgggtttgagtgattctcatgcctcagcctcctgagtagctgggactacaggcatatgccaccatgcccggctaattttttaatttttttagtagagacaaggtttcaccatgttggccaggctgatctcgaacttctggcctcagtgatcccccccaccgccttagcctctcaaagggctgggattataggcttgagctactgcgcccggttacaataagatattttaaagtggggcacagaggctcatggttcaatcccagtactttgggaggccgaggcaggaggattactttaagccagatgtttgagaccagccacaaaattagaccttatctctaaaaagaattttttttttaattagctgagtgtgatggtacatccctgtagtcctagctacttgggagattgaggtgggaggatcacttgagcctaggagattgaggctgcagtgaaccatgatcacggcgttgcactccagcctgagcgaccgagttgagaccttgtctcaaaaaaaaaaaaaaaaggccacattcacaaaacttttattattatatattgttataactgttctattttattattagttattgttgttaatttcttactatgtctaagttataaattaagttataagttataaattaaactttactgtaggtatgtgtgtataggaaaaaacatagcatataattagggttctgtatagctcactgtaaccttgacctcatgagcttgagctcaagatcctgggttcaagtgatcctccccactcagcctcccgagtagctggaacatcaggtgcttgctaccacacttagctaatgtttaaattttttgtagagacaggatctcactctgttgcccagactggtcttgaactcctgggctcaagcgatcctcctgccttggcctcccaaagtgctaggattacaggcataagccactgtgcccagcctgtttttgggttttctaggtacacaaattattaagagttcagcaaattttctgtatactaaggtcaatatacaaaaatcagttgcgtttctgttagcaggaattaactattaaaatatagaattttaaaaaaaagatactaaggcaattagaaagtcagttcaataggaaaatggacaaaagacatgaaacaagataagacataaaagagaaagaatagagatttaaaactgatttaattgaaacaactgatgagtactgaaaaagtaaactcagtgtgatttaacactgagtttaaatttaagaaataaatgtggctgggcgccatggctcacgcctgtaatcccagcactttgggaggccgaggtgggcggatcacttgaggtcaggagtttgagaccagcctggccaacatggtgaaaccccatctctactgcaaatataaaaaattagcggggcgtggtgtcacatgcctgtaatcccagcttctcgggaggctgaggcaggagaatggcttgaacccaggaggtggaggttgcagtgagccgagatcgtgccactgcaccccagcctgggcaacagagcaagactccatctcaaaaaggaaaaaaagaaaaaaaaagaaagaaatgtctggatttctaaaacaccaaaaaaaaaaaaaaaatgttgggggaaagagaagacatatgaatggctggtaaatattacatgacaagatgtttagccttattggtatattcgtatcagggaaagcaaactaaaaccacaatgacagggtgatgtcagcgaaaatggtagagtaggacttctgtgggtcatccctctgcagaaacaccaaacaccttgacagaaaagtcagaatttagcttatcaaaactctggaaaggtaatcaaaggtttacagcagccaagcaaatacttcgccagaagaaagggcactgaaacaaggtaagagatctttgtggcattttagcttaccctagcctcacctcccttcctggtatggctgcagtcttgaagatgacagcctgtgttccccatgctggtgcctgattccagagagtggacactcttcctcctgagggattctgtgttctgttttgtcctttctccaaaggactgccaccaggggcaaaaaacaaacaaaaaaaccaaaaaaagaaaaaaaaaaaaacagggcaaacaataagatattgaaagcctgagaggaaaagctgtagagtgagtttttgtagaggaataggagctttgaaaagctattgtggatgagaaactagaaagccaagtgcacagctcagggcagtatgtgtgctcagaaaagacctgagaaagccattagctttcacctctggcttgtctttaggttcaacacaaacaggaagtgaatattaaggtagatttataaaggccctgggtaagttttgaaggagtgccccaacagctaatcagtagagacctggcgagcattttacttttctttttctttcttttttttttctttttggtttatttgttttgaaatgtggtcttgccttgctcaggctaatcttgaactcgttggttcaagcgatccttccacttcagcttcctgagtagctggaattacaggcacacaccactgtacccatctatttttgtttttattttttacacattataaatgttcagtttttttaaaaaaaattacgaagcatgtgaagaatctagaaaatatgcttcattcacaagaaaaaagaaatgaacagaaactaccccgaggaagcactaatactagaattactagacaaaaactttaaatcagctgtcttaagtatactcaaagagctaaaggacaccatggacaaagaagtaaaggaattcaagataataatgtctcaacaaatagagaatatcaataaagagaaatttttaaaagtaggcaaagagaaattttggagctgaaggttacaataattgaaatgaaaattcactaggggagctcaacaaaagatatgagcagacagaagaatcagcaaacttggagataggtccactgaaattatatagtttgaagagcacacatttaaaagactgaagaaaaatgaacagagtccaggagatgtgtgggataccaacatatatatcatggtaaggagagggagaaaggtgcagaaaacatgtttaagaagtaattgccaaaaccatttcaaatttgacaagacatgaatatacacatcaagaagctcagctaacacccaagaaggataaactcaaagacatccatacaagacacattataattaaaatttccgaagccagagataaagagagaatcttggaagcagcaagagagaagcaacttgtaaaatataagggatcttaaataagatgaatttctgttgatttcttagcggaaaccatggaggctagaaggcagtgggataacatatttaaagtgatgaaagacagacctgccaaccaagaattctaaatctggcaaaactatccttcaggaattaagaagaaatcatgacatacccagataaacaatagctgagggggcttcattgttaatagacctgccctgtaagaaatgctaaaaggagtcttcaggctcaccacagatctattaaattttctttttggcataggaccgaaacatgcattttaattaaacattcgtaatttttcttacacagcaaaaccaaaagccccacaatggaaaatcattttctgttcactgattgttaaaaactttttttaaaaaaagtcctgtgacatcaagtgcttgccaggatgtggcacagtagaaactcttaaacacttggtgggtgtttaaattgctacaaccagtttggaaaacaatttgtcattacccagtaaagttgaagatgtatagatcatgtaatagttttacagaccaaaaatatagaaactctggtacctctgcagaagaagacatacagtaatattcacagtggccatttgtaatataaaaaactgtaaacaatccaggtgtttattgattgatttttctaacatgtgacttatttctggtctttactagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaagggtgagttgttttattttaagttctttttaaggtagtttcaatgaaggacaaattggtataatctaatctttataagggtctcatacttattacctttgtggacaagatggacatatgtagaaaggatgaaagtgaagctaaattgaatgttagtactcacccgatgataaaccagagagtgagaaatgctatgtctctgattaacatttttattaatggctcagattaatttatagatgatatgtgtctcagtccattttgtgcagctatagcagaatacctgagactgggtgatttataaagaacagagattcatttcttatatttctggaggctgggaagtccaaggttgagggatccacatctggcgagggccttcttgctgtgtcattccatgttggaaggcagaagggcaagagagcatgcatgagcaagaaagaaaggtgccaaactcatccttttattaggaactcactcaacaataactaatccacttccaggataaaggcatttaatccactcacaggagattcatctcttaaagtctccacctttcaacactgctccactggggattaagtttccaacacatgaatttttgaggagggcacattcaaactatagcagtatatttatcaaaatttcaaaagggtatcaaatatattaggcattaggattaaatatttcaacagattggaacagtggacttaacatgaaatttaatcaagtatctgctttttgtgaagaaaggaaaaaaatttaataggataaatatgaagtcttgtgactgtaaaaacattcatgtaataaatgtttgttgagtgtcttttgtatgggacactgtactagacactaggaacacaatgatgagtcaaatagatggttttgctcatggatctcatttagttggaataataaacgttaattttaagtgtttaccatatgcagaggactgtgcttcatgctttatctgctttatgttgtttaatttgtgtgaagtaataggtgctattgctgttttcattttataaaataattaactgagtctcagagaaataaagtaacagccattggtggatctaagacttgaatctagggctatatgaatctagtgcgacattgtcttatatggtagctgctagccacatgtagctatatgtttacatttaagttaaccaaaagttaataaaactcaaaattcaaagtacctcaatcccaaatagctatattttgagtgctcattggccacatgtagctaatacttatcatatttgacagaacatattatagaaaatttccattatcttagttctattgaacagtgctgttctagagcctacactccccctttcccccaacacacaccttctaggctttattaacattttactatacttgcgttattacatatctatccattagtgtttctttgttaaacttgtttgcttttggttcctaatatatgcactatcatactaagaaagtttaattttattcataatttattaggggcttttaattaagaatgactaatgattttgtcacatgccctttgcagtcctatcaaaatgaccttagagtttttctcccttaaacagttaatgcattttattaacaagtaggttttctaatgttttctagtgtttttattcaagctgctttgtcaaggagcactaaaacctcttttttaggggtcggggttggggaaacagggtctcactttgtttcccaggctagaatgcagtagcaagatcatgtttcactacaacctcaaactcggtgggctcaagcaatcctcccacttcagcctatgaactaggtaggactacaagcatgtgccaccacgcctggctaatttttcaatttttggtagagactaggttgcccaagctggagtctcttaacacattattggagttgatttgttccttatctttttttttttttttttttaaggatttttacatttattcaaaagaggatgagtctctttatcaagttttggtgtcaggattatattagtttcataaaaggaactgggaaaacttgctgtattcttatgcttggaaatagtttacataacacaggaattacctattatttaaaggtttaatgcaagttacctgtaattccatctggacctggtatctttttgggaactagatctattacagtcttttcagttacttctgtggttgatagtatagggtagtgttttatttatctctgtattctcagcttctagtgcagtatcggttttatagtggctactaaacatgtttgttttgaataagtggataattgtaattatgtctctaaaaagtataaaaaacatatgaattaatagtaataatagctaagagtatgtgccagaaactagtctaaatgctttacaggtattcatttgtttaatcctcactataaccatgtgaagaaggtattgtgaatatctccattttactggagaaactgaggcacagagagtttaggtaaattgtctaagagtataaaggcagttaaatattggagccaggatagtgcaaaaatcaaagtatttgtatttggtgagatttttaactgttcacttatactaaaaaattttagtataactatttagtataagtcaaaaatttaaaattaagtagccttctcacttattttttaaccaaagatttaagcatttccctaattttctcagaaactttccttccaaggcaccagtatatcagtaaatagaacttgaaagtttttaattcagtttcttttctcttttctttcatagaagtataaataaacacagtatatctttggggcctattactatacccagctagcaggcctgcctagattgttccatatggttgttactttacagtaattgtcattatgatgtcactgtatgttttgaaagtacaatttcatgttttatacatttttaaaaattgattgaattttagcatggcttcttcctgataacagttttgtcctcttgctttgagaaggagcatatgggcattccacttatggtttccatgggctgcatctcagattcctgttcattctacgggtttcactgtagacagagtactttgtatttaatggccgggtgcggtggctcacacctgtaatcagcactttgggaggccgaggcaggtggatcacttgaggtcaggagttccagatcagcctggccaacatgatgaaatcccatctctactaaaaatccaaaaattaaccaggcatggtggcggttgcctgttatcgcagctactcaggaagctgaggcaggagaatcacttgaacctgggaggtggaggttgcagtgagccgagattgcgccactgtactccagcctgggcgacagagcaagacctcatttcaagaaaaagagtactttggctggcgccaacagggtccaggtctgtgcctgccattggagaggatgccacagccacaggggtgggcgctggcctggaggcctccaaggggcatctcctgtgagcccaggggatgggcaggatctgagcggagaagagtgaaagtggaggagtgaggccagaacaaaggctttgccgtgaaagaggtggtttcccgcctaggctctgaccttcactcactgtgtggcccaggccaagggcaagcgtctgacctcgctgggcctttgtttctcaggggtaagatgaaacaatggctccctctccctctccctctccctctccccacggtctccctctccctctcttgccatggtctctctctgatgccgagccgaagctggactgtgctgctgccatctcggctcactgcaacctccctgcctgattctcctgcctcagcctgccgagtgcctgcgattgcgggcgcgcgccgccacgcctgactggtttttgtatttttatggtggagacggggtttcgctgtgttggccgggctggtctccagctgctaaccgcgagtgatccgccagcctcggcctcccgaggtgccgggatggcagacggagttgcgttcactcagtgctcaatggtgcccaggctggagtgcagtggcgtgatctcggctcgctacaacctccacctcccagctgcctgccttggccccccaaagtgccgagattgcagcctctgcccggccaccaccccttctgggaagtgaggagcgtctctgcctggccgcccatcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccaccccgtctgggatgtgaggagcgtctctgcccggccgccccgtctgggaagtgaggagaccctctgcctggcaactgccctgtctgagaagtgagaagctcctccgccgggcagccacaccgtctgagaagtgaggagcccctccgcccggcagccaccccgtctgggaagtgaggagcgtctccgcccggcagccaccccgtccgggaggtgaggagcccctccgcccggcagccgccctgtctgagaagtgaggagcccctctgccgggccagccgccccgtccgggaaggaggtgggggggtcagccccctgccctgccagccgccccgtccgggaggtgaggggcgcctctgcccggccacccctactgggaagtgaggagcccctctgcccggccagccaccccgaccgggagggaggtgggggggtcaggtcagccccccgcccggccagccgccccgtccgggaggtgaggggcgcctctgcctggccgcccctactgggaagtgaggagcccctctgcccggacagccgccccgtccgggagggaggtgggggggtcagccccccccggccagccaccctgtccgggaggtgaggggcgcctctgcccggccgcccctactgggaagtgaggagcccctctgcccggacagccgccccgtccgggagggaggtgggggggtcagccccccgcccggccagccgccccatccgggagggaggtgggggggtcagccccccgcccggccagccgccccgtccgggaggtgaggggcgcctctgcccggccgcccctactgggaagtgaggagcccctctgcccggccaccaccccgtctgggaggtgtactcaacagctcattgagaacaggccatgatgacaatggcggttttgtggaatagaaagcggggaaaggtgaggaaaagattgagaaatcagatggttgccgtgtctgtgtagaaagaggtagacatgggagacttttcattttgttctgtactaagaaaaattcttctgctttaggatcctgttgatctgtgaccttacccccaaccctgtgctctctgaaacatgtgctgtgtccactcagggttaaatggattaagggcggtgcaagatgtgctgtgttaaacagatgcttgaaggcagcatgcttgttaagagtcatcgccactccctaatttcaagtacccagggacacaaacactgcggaaggccgcagggtcctctgcctaggaaaaccagagacctttgttcacttatctgctgaccttccctccactattgtcctatgaccctgccaaatctccctctgcgagaaacacccaagaatgatcaattaaaaaaaaaaaaaagaaaaagagtactttgtatttgtatttaagaaatcagatgtcagagattagcctttgtgggattattagtgtgttcctcacaccaacttaataagtttccctgaaatgaggtccattttctttgactttttcattggcatgagtaaaacttttttactaacacagagacagggaactctcacattgttcattcattctgcaaatatttattcagtgtccctaaagtatgtgctttatcctctaatctgcagcttttgaatgatagttaattaggtcttgaatagactagctcatcttatctgactttaagtgcatctgacctgtgccagcagattaatttataaatttataactgagggtattctgtttcagtgactataaaactcatttgtttgttagcatactcttgtctttgaatttctcaagtatcaagaaatcaaaagcaatcagatggttgtttagtacatatagaatcagcaaggaaattgcatgatctttaagagaaattccatccagattgtgataaatgctaaggaattactcatatttcacttcaaataatttttttttaattttttttttttttattgatcattcttgggtgtttctcgcagagggggatttggcagggtcataggacaatagtggagggaaggtcagcagataagcaagtgaacaaaggtctctggttttcctaggcagagggccctgcggccttccacagtgtttgtgtccctgggtacttgagattagggagtggtgatgactcttaacaagcatgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaatttttcttagtacagaacaaaatgaagtctcccatgtctacttctttctacacagacacaacaacaatccgatttctctatcccttccccacctttcccccttctctgttccacaaaaccgccatcgtcatcatggcccgttctcaatgagctgttgggtacacctcctagacggggtggtggccgggcagaggggctcatcacttcccagaaggggcggccgggcagaggcaccccccacctcccggacggggcggctggccgggcggaggcaccccccatctccctcccggatggggcggctggctgggcgggggctggcccccacctccctcctggatggggcagctggccgggcgggggctgaccccccacctccctcccggaccgagtggctgctgggcagagacgctcctcacttcccagacggggcggctgccgggtggaggggctcctcacttcccagacggggcggctgccgggcggaggggatcctcacttctcagacggggcggctgccgggcggaggggctcctcacttctcagacggggcggctgccgggcggaggggctcctcacctcccagacggggtcgcggccgggcagaggcgctcctcacatcccagacagggcggtggggccgaggcgctccccacatctcagacgatgggcggccggcagagacgctcctcacttcctagatgggatggcggccgggcagagacgctcctcacttcccagacggggtgtcggccaggcagaggctgcaatctcagcactttaggaggccaaggcaggcggctgggaggtggaggttgtagcgagccgagatcaagccactgcactccagcctgggcaacattgagcactgagtgaacaagactccgtctgcaatcccggcacctcgggaggccgaggctggcggatcactcgcggttaggagctggagaccagcccggccaacacagcgaaacccagtctccaccaaaaaaatacgaaaaccagtcaggcgtggtggcgcgcgcctgcaatagcaggcacttggcaggctgaggcaggagaatcaggcagggaggttgcagtgagccgagatggcagcagtacagtccagcttcggctcggcatcagagggagaccatggaaagagagggagagggagaccatggggagagggagagggggagggggagggggagggccaaatatttttttaagacggtaaaatattaatgcttgttaggttttttcctttgtgttaggtcaacaccagcacattcatgttttccagacaagtaatagagattaccacccattagtctgcacttactacattaaaacccatctttattttattttgttgtttttgttttgttttgtttttttgagagggagtctcactctgtcacccaggctgcagtgcagtggtgtgatctcggctcactgcaacctctgcttcccaggttcaagcaattctcctgcctcagcctcccaagtagctgggactacaggcatgagccaccatgcctggaaaattttttgtatttttagtagagatggggttttgccatgttggccaggctggtctcgaactcctgatctcaagtgatctgcctgctttggcctcccaaggtgttgggattacaggcgtgagccactgcgcccagccccatttttattttattgtgctttactcttttgtttttttgttacactttagcttggtagtttagtctccttcctggttatataaaggaagcctctttgattttagcagtaagctgtttctgattcgctttgtagggtacattacttctaagaaggtgtcccacctaaataatacgttcttttaaaaatttattatttttattttagattcgggggtacgtgtacaggtttggtttttattttttaatttttaaaaatttgctttcctggtaactcacaaaacagcaggtttattacacgggtatattgtgtgatgctggggtttgggcttctaatgatcccatggcctaagcagtgaacatagtacctataggtagtttctcaacctttgcccttctccctccctctcccttttgtgatctccagtgtttattattccttactttgtgtccttgtgtacccaatgtttagttcccatgtataagtgagaacatgtggtatttctgttttctgtgttaagttgcttaggctaatgacctccagctatattcatgttgctgcaaaggacatgatttcgttcttttttatggctatgtaaagaatatgttttaagatttcccacctagagaatatgttcttctgaaattaaccctaggttcttggaccatagatttctgaccactgatcacatctcagattttgagaactgactttttttggttaacttttttttttcttattaaaaaaaatttgttttggtatggaataaaaagacagccttatccagaaatagccatagttacaccttgatgtataatcttgtagacctttttaaatacatatatatgataattacatctatataattgaaattgaattgattatactacacatattttataatcttttttatcttaatagattgtatatatctttcaagataacatttgattggggcctgtattagtctgttttcacactactgataaagacatacctgagactgggaagaaaaagaggtttaattggatttaatagttccacatggctgagaaggcctcagaatcatggtgggaggctaaggcacttctaacatggcagcagccaaaccatgtcattctgcccctggcccctccaaatctcatgtcttcacatttcaaaaccagtcatgcattcccagcagtcccccaaagtcttaattcatttaggcattaacccaaaagtctgaagtccaaagtctcatctgagataaggcaagtcccttctgcctgtgagcctgtaaaatcaaaagcaagctagttacttcctagatacaatggaggtacaggtatttcgtaaatacggccattccaaatgggagaaattggccagaacaaaggggttacaggtcccatgcatgtccaaaatccagcaggacagtcaaattttgaagctccaaaatcatctcctttgagtccaagtctcacatccaggtcatgctgatgcaaaaggtgggttcccgtggtcttgggcagctccacccctgtagctttgcggggtccaacctccctcccggctgctttcactggctggtgttgagtgtctgtggcttttccaggcgcattggtgcaagctgtcagtggatctaccattctgggatctggaagatggtggcccacttctcacagatccgctaggcagttccccagtagggactctgtgtgggggctcccaccccacattttccttccgcaccgccctagcagaggttctccatgagggctccgcccctgcagcaaacttttgcctgggcatccgggtgtttccatacatcttctgaaatctaggcggaggttcccaaacctcagttcttgtcttcagtgcactcgcaggctcagcaccacatggacgctgccaaggctttgggcttgcactctctgaagccacaacccaagctctatgttggcccctttcagccatggctggagcaactgggacacagggcaccaagtccctaggctgcacacagcacggggaccctgggcccagcccacaaaaccactttttcctcttgggtctctgggcctgtgatgggaggggctgctgtgaaggtctctaacagggcctggagacattttgcctgtggtcttggggattaacattaggctccttgctacttatgcaaatttctgcagctggcttgaatttcccctcaaaaaatgggtttttcttttttgtcacataggctacaaattttccaaatttttatgctctgcttcccttataaaactggttaacagcacccaagttacctcctgaatgctttgctgcttagaagtttcttccaccagatattctgaatcatctctctcaagttcaaagttccacaaatctgtagggcaggggcaaaatgctgccagtctctttgttaaaacataacaagagtcttctttgctccagttcccaacaagtttcttatctccatctgagaccacctcagcctggaccttattgtccatatcactattagcattttgggcaaagccattgaacaagtctctaggaagttccaaattttcccacattttcttgtcttcttctgagcccttcaaactgttccaacttctgcctgttccttagttccaaagtcaattccacatttttggtatctcttcagcaatgccccactcctggcaccaatttactatattagtccattttcacgctgctgataaagacatacccaagactgggaagaaaaagagctttaattggacttacagttccacatgactggggaggcctcttaatcatggtgggaggtgaaaggcacttcttacatggcggcggcaagagaaatgaggaagaagcaaaagcagaaacccctgataaacccatcagatctcatgagacttactgtcatgagaatagcatgggaaagatcggcctccatgattcaattacctcccccagggtccctctcacagcatgtgggaattctgggagatacaattcaagctgagatttgggtggagacacagccaaaccatatcagagcccatctaggggaggtttcttaattaattttttcctgggctcaagtgatcttcccatctcagcttcctaagcatctaggaccacaggtgtgcagcactaggcccagctaatttttaaattttttttgtagagatggggtctccttatgttgtccaggctagtcttgtattcctgtcttggcctcccaatgtgctgggattacaggtgtgagccactctgcctggccccataagaggtctcttaatttattcagcagacattgtgtattactgtgtgccagatgttgggcatacagtagtcaataaatagtcaagaatgactgccctcgtggagcttaagtactaatggagaaagatagatgatcaaaataaatagaattttaagcagtagtaagtgctatggtggaagaaaagcagggatgggagatagggaatatggttgaagtgaagtttcaaaaagagcatagtcagcaaatgtcttattgagaaagtatctgaatagacaccaaggaagtgtagggatggacaaacaaggagagaccaatgtagggcagagaaggtgaggggaatggtaggagaagttgatgggagtgggaatggggaggtgggtattagattatatgaagcctagttggcaattataagagcttctgttccaatggagagttaggtgtcatttatatcttgaaatgattgctctaactgctgtgctgaaaatagaatggggggctgcgaggtgtgcgaggcaaagacacagcagagaaaccatttaagaggctattgcattaatataagctagagatgccagtggtttgggtgagagcagtgaaaaatggtttggtttcagatgcagtttggcaatattcatgataggagttactgacagattggatgtggggtgtaacagaaagaagagttatgacaccaaggtttttggcctgaaaacaagaagaatggagccaccatccactgacatggggaacattaggaggagtaagtttggaggaaaatatttaagagttcattcagtttgggacataataagtttgaggtgcttattatacaagtggaaatgttgaataggcagaggtcttggctggagataatatttggaagttgtggcctatatatgatatttaaaattataaagctggataaagtggtcaaagaagtcaagataggaaatagcagagctcagagaattgaggcctgggccctcgatggttagaagtttggaagataaggaagaataagcaaaggagactgagaagaaacagccagggaagtacaaggaaaacctagagaggctacagctctggaaactatgtgaagactcttacctggttttagcatgtgacttcccttccagacccagtgggttgatttttctcgtctgtgagtttctaaaattaaatgtatacactatcttccttccctccacatcttccccagacatttagctttaacaagaaaagatttttttttaataaacaaaattcattgtaaatactctgtcaactattgttctccgagcaacagctcttatgcattggggccaccctcagcagtctctgttactgctacaaaaacatgggactaacatctgacttccagagagtaagtagccaagaaagagaaatcatcagctgatcagctgctggtgagttgtccctcgtaattccaagcattcatataggattgacttttacagcttcaagaactaggctatctctcaaacttgattattaccatttacttattggtcagtgtaagcataagataatttgcccttcttgtcactgacaaataggtgggtatatattagttacctattgctgtgtaacactttaccccagaatttaacagcttatgacaatatttattatctcaatatttttgagggtcaggaatttgggagcaatttagctagatggttctggtgaagggcttcatgaggttataatcaacatgtcagctgtggctacagtcaaccgaacacttaactggacctggaacatccacttccaagatggctcactcacatgactgttggcaggaggccttagttcctcaccatctgggcctctccatagggctccttgaatgtccatattacttggcagctagcttctcttggagttagtgatccaagagaatgatagaggaagcaggaaaaaaacccataatatctttttatatcctaattttggaagtcacacactgtcattcctgctacattttgtctgtaagaggtgaatcactaaatctagcctacattcaaggagaagagaattagctccacctctagagaatttatggatgtattttaaaatcaccacagtttgccctctagccacaaattatttacacttcttctatgtgcaaaatgcactcacttcctcccgaaatctatcaaaaaagtctccttcttctatagcatcagcttgaaatataggtagctgtccttttaactaggtccaagtgtgggtgtggctccttgggtatagttcctcaggtatagttccttttgttgtgaagacctgtaaactaaagagacaggttaactacctatcacacacccaacatacagtgatatggacaggcagtgattctgaacaggtatagagatttcctgttccaaaagggaaaatgatggcacaaagaagttgctggttcacagcaattctgatagttgtctagacaaatgtcagaagttccttgactaggacttctacttctgcccaggagttcttctctgtgactctggaatccaccctgttagtcatcctttcttttccattaaaagtagttcatatttgtagctgcatagctttcttagcttgcttcttgccagtagaaatttcagggcccagagaccggttttcattttgtactatttttccacctttcagtttaagctggcagtgtttctttttaaaacttcgagtatcctgtgaatctcactgggattcatgccattaggcaaaagccacatccaccaatctcttctaaataggctttttccaccttgggtttctgctgggattgctgagagataccacttgtaatgggtagaattgtgtcccccaaaaagctgtgttcaagtcctaaccctgataaggtcaccgtgaatatgaccttatttggaaatagggtcattacagatgtagtcaagttatagtaagatcacactggatcaggaagggccctaatccaacggttgatagtcttataaggagagaaatttggctgggtgcggtggcttactcctgtaatctcagcactttgggaggccaaggtgggaggatcacctgaggtcagaagttcgagaccagcctggccaatgtggtaaaaccccgtgtctactaaaaatacaaaaattagccaggcgtggtggcccatgcctgtaatcccagctactcaggaggccgaggcgtgagaattgcttaaacctggaggcagaggttgcagtgagctgagatcgcaccactgcactctggcctgggcgagagtgagactctgcctcaaaaaaaaaaaaaaaaaaaaaaaaaagaagctagaaatttggacatgaacacatgaacacagaagacagaagaaagccatgtgatgacagaggcagaggttgtggggggcatacatctacaaatcaaggaatggcaaagattgctgtcaaacatcaccagaagccagagagaatcatggaattgatctccctcagaacttcctgaaggaactaaccctactgacacccacatcagtgaacgaataaattccttttgttttaagctacccagtttgtggtagtttgttatagcagccctaggaaactaacataacacccttaagcttcttagtccgattttctaattgaatgattctttaggtaccattctagatctttgtgaggttgtgttttttttgtttttttttttgagacagtctcagtctgtcacccaggctggagtgcagtggtgcaatctcggctcagtgcaacgtccgtgtcctgggttcaagtgattctcatgtttcagcctcccgagcagctggcattacaggtgtgtgccaccatgcccggctaatttttgtatttttagtagagacaggtttctccatcttggccaggctggtctcaaattcctggcctcaagtgatcctcctgccttgacctcccaaagtgctgggattataggcgtgagctaccgtgcctggccctttctgaggtcttaacaaagaagtgttatagtctgatccttggcttcatctgaaatcagtcttttggcagtgccttggattcgatctttgcttgaaatctcttaattttagtgtcatttactaatctggagatgctgggaattctcagaattatataattctgtcctttttgtttaactgttcttcctttaattcatccctcttttgcattttaaagtaagcagcaagaagccaggaggtactttcaaaagtgaaatcactttagctagattatcaaccagtttttggaccacaacatctactttccatgttatggtaaggccacagctttgccattatataacaaggatccttttccctccagtttctaatcagattttttctgccttttcttaatctctcacctttaacttcctcaaaggccatagtgcttctgtttttttttaaggctcttcaaacttcactgatgctctcctcaaagtccttttaacttctgccccactgctgggttccaaagatactctcaagttttgggtctttattgtggcggcaccggtatccagatatcgaaatctgtatattatctattgccatataacaaattatctcagagcttagtggcttaaaacaacaaatatttattatctcacagattcactgggtcaggaacaggttcagttgggagtagcatggctgagtggttctggcccaggatttcatgagcttatagtcaagatgttggccattgctgcagtataggattgactaggctttacacatattctggcaggtttgttctggctgttggcagtactcagttcctcatcacatggacctttctataggactgcttgatatggcactctcccagagcaagtgattgatccgacagaagtacaaggagaaagcactgccccccgccccccacctttttttttttgaggcaaagtctctgtcacccaggctggagtgtaatggcacaatcttggctcactgcaacctcctcctcctgggttcaagtgattctcctgccttatcctcctgagtagctgagactataggcacgtgccactaatgcctggttaatttttgtatttttagtagagatggggtcatgttggccaggctggtctcgaactcctgacctcaagtgatccacccacctcagcctcccaaagttctgggattataggcaagagccaccacacccggccatttcccccacttttttttaccttgtcttggaagtcacagattatcaattctgccatattctattgttaagtgagtcactaagtccagcccacactgaagggaagattatcaaataatttttggacatatttttaaaacaacacgaagcattctaaaaaaaagaaaacacaatgaattcatagaagcagagaatagaatggtagttactaggagctgtggggcagagggggtggattagagagatgttgaaggatacaaaattttagttaaaagttcaagagatctgttgtacaacgtgggtgacagtagttaataacaatgttttcagccaggtggggtggctcatgcctataatcccagcactttgggaggccaaggcgggcggattacttgacagcccggccaacatggtgaaaccccatctctactaaaaatacaaaaattagccaggcgtggtggtgtgcatctgtaatcccagctacttgggaggctgaagcacaagaattgcttgaacctgggatatagaggttgcagtgagctgagatggtgcctctgcactccatcctaggtgacagagcaagacttcatctcaaaaaaagaaaaaaaaaaacaaccagtgttttgtacatctgaaaattgctgagagagtagattttaagggttattgttgcaaataagtttgtgaggtaatgcatatgttgatagtttgatgtagtcattccacaatgcatacatatttcaaaatatgttatataccataatatatgcaatttttgtcagttaaaaataaataatgaaaaataatacaaaaaagcaagcaaacaaacggaatagtgtagttagctgctgttgaactttagtagcagggaaagtctaatgttggctattgccattgttatattaattggcctaataagtaaagtgggaaccagggacttaaaattgcatatcattgctgggcgtggtggctcacacctgtaatcccagcactttgggaggctgaggtcaggaggtcaagatcagctttgtcaacatggtgaaaccccatctctactaaatctactaagtatacaaaaaattagccgggtgtggtggcaggtgcctataatcccagctactcgggaggctaaggcaggagaattgcctgaacctgggaggcagaggttgcagtgagccgagatcgctccactgcactccagcctgggcggcagagcgagactctgtctcaaaaaagaaaaaaaattgcatatcatccagaacacagaagatccagtgaaacaatttcttcaggtttttcttttgctgaggcatcactccagtatctctttgggtaacaaagactcattcgtgtaaagaactgtgtacctgtgccatcttaagtattcagagtgacaaatgctaagcatgtgtgtgtttatatgtgtttgtgttataatcatctgaaacaaccttaacatagaattattgcttaaacttttttttaaaggactctttaaatgatatcttattcagaaacccaatgtgtacaacatacaaaaatggaactacccttgttaaagggaggtgggtccagagttccactggctcggcatcccttttaacccttccttatgttgatgtcagatattcagggaacatagtttgaaaaactataccataccatcagatccctttccagcttaattcacaaaaatctattaatctgtaagatagcagagctcaggaagatagccataatagcaaaatagcacaccgctgtgtggcaggctgatttctgatgctgtctcttgtgtactagccaatgaaaagccattttggtttagggaattagttggtgattaggcagccatggatatctgtagagtacttttcattagtctgttgtcttatctaattttttcttctgtaacagaatactacaacacatctttgcaggattctttgcaaattctgccattcctggatctccacaccctttttcctggtaagtaactaattgttttctatcttactctattggagtgacatattttaggtgctgtcatttctgtgcagtagagaaaaagagctgcataggccgggtgcggtggctcatgcctctaatcccagcactttgggaggccgaggctggcggatcacgaggtcaggagatcgaggccatcctggctaacatggtgaaaccccgtctctactaaaaatataaaaaattagccaggcgtggtggcatgcttctgtagtcccagctactcggaggctgaggcaggagaatcacttgaacccgggaggtggaggttgcagtgagccgagatcgcgccactgtactccagcttgggcgacagaaagagaccctgtctcaaaaaaaaaaaaaaaaaaaaaaaaaaaaaaaaaagagctgcataggtgagtatgtagatgtaactggaggctgctacactgccattatctgctaagcccaaacttaatcagaacttttttttttattattattcaggctcaggaaggccgtcctggtcccccaggatgtttgggtgctagaaatgtcttgattccttttatattcaggtctgagagttgtattgaggtagagaatgagatggtccctgccaggcttggtatctgatttgtgggtttccccagtagactacacaggaatattttactccttaagaatttctgaaattgaaaacattatgctgaacttcatttttttcaaagtaagaggatttgtcagaagaaacaataggctgtaattcagtatcagagtgacacttatgtatgatgggattaaagatggaatttcttcttgtctgagaaattatttgctgcttctaactgtggcccagaaggtttctttgctcaaaggaacctcagtccttttaggacctctgtcatccagtagtctggacctctgctggtagtgtaccagcagctctgagggaaaataaaaaaaaacggtgttgccaagtcccttttataattgctctaagttgtgattcagagagactgctatggctgcttctctacttgaaagctcctcattgtccagaactgtgggcggcctcttataatgagggatgtttgctgtagattttgaccagtcatgaagggaaaactctccttaaaaagcagctccatctgtgtttaatatcagtgggcacagaaaacacaaatttttgaaaccaacaggcaatgagtcactctttttgttctggcgtgtcatgtggtactttaggtagcttcacattttatgttctagttaagtaaaattcttagagaatgaggtactatctctggatagtctgtttgatcttgaaaatgtacagaattctttgcctcttgatcctggaggactagtgactttccagctctgagagagaacaggatccctctgccaatttttttctgtggtgtaaggcagagcctggtcactccatctaatgctgtctatctcatctcacgtataggagcgggatgctgcactccaaccctggggactatgcctggggtcagacagggcttgatgccattgtaacccaggtgaggagctgccttttgagggtgtctgttcagtgtgtctcatggttccacaggcttcctgctttccttctgctactttctgaaatggcagtcactctgctttctctaatattttgagctttggggtttccattttactaaagggatgaatgatttatggggttagctcagcatccatgcacttcctaggtctgagggaatttctagaagatggtttcacctccataggaagaaaagacttctataacaaatagtattttgtatttttgtctctcttgctcagttctataaggattctattaacaaatatttcacaaaaaaaggagggtttcctcacatgttgaagcagggatttctgctagatggagcaaagtaggggaaggaagcagagaaaaaagtattcccatgccatgtataattgcttccacttgtttatgttcattttaatttgattggtttttcatttccgttgtggatttctgagactagaaagcatgtcctttatattcagtcgtcttataggcagtaatttacctatttcttggctcacgttatgctacttttcatactctcgcttttttcttcttccagaagatgaagcttttggaccagttacattttactttttattaagctatagttttactcgtgacaccacaacccttttgctgcctctgaagttgctttatgcctagaggtgggccttgcaatcatgggtttgtctgtaggcttatacgaacgtcactctgaaattgtaaagcaattatgagtgttctggcagcaggaaaggggaaacccaagcctctcagagccttgcagaagtaagagtaactaacatacctaatgtctgcactgtttgttctcagctggagcagttccctctccagggatattgcgatgtctgccacttcgtctttttctttctctttttttgtagcttttaggacaactggaaaacacaggccctcccccagctgacaaggaaaagatcacatctcttccaacagtgacagtaactcaggaacaagttggtaggttcatttttatacttattctgtcatcttctgatctcggttcaaaatcccggtatcttctgacaggtgaaaagtttaaaaagtgaacaaaataaaaagacaaaaaaataagaaaaaaaatcccaataccttcctatattaaggacctttaagtgaagctatagccctctaaaattcctatctgggtgccaaatctggaaagttcctacccctttattaggttagtcagttggtatttcctgagcaattatgtctcttttttaggtgccattgggaataaagaggtacaaagatagataagaattgattgtaacaagttgaagaaaaactgatcaaatgattaaaaactgtgttggacacatgatactgacattggggaaaggagaagaaaaaaataggctgggagtttgtttcaaatctactttgtgtcaggtacagttaggtatcttagtcatagatactattttatttgtaagcactggaggaatttagtgacaagggacagcattttggtctgggagtttctgttcccatcagttcgggtttagagttagagattttaaagacaaggtgggccatcttaggtcattctatttaaggaaaagtatgaactaatatacgtggtgtgtgagtcaggtaaagtggtctttagggaagattagtctaggggcagtgtgtgaaacattggaagtgagagagagcagaaacagggattttagagtgttgcagcagtccagatgaggttcagttgatggtgacaatgctaacagaaaggaaaggattcagaagatcattttggagaaatgctttcctcactcattgcataatgggatgaagaaggggaaagagtcaaagagaattctgagatttcacagctttgtaactataaacatggtgctgccatcttaagggacagggaaatagtgaatggaccctggtttgggtaaggagatgaggtgatgttttacattttttaatttgttgatttttgaggtgccagctgagaatccaagtgaagaggagctggggattgctgtggagctggtttgagggaaaactaagttgtagcaaagtataggatatatttggagggttaagaccgtggaatttgggatactagctgggaggctgttgcagcagactaggcatgagaagtaaaagaattagggctaaggtgataggaatggagagtaaggagtgaatctattaagtagtagtactgctccaaatgccttatctgctgttagttcatggagcatatcccagccactaggcgtatagactagctgacagtattagccaaatttgggaaactcaaaacttgctgcttggagctcccagtatagttcatgactgtttcttctcagagaagagggctttctgtctcttgatttcgtgacctgagctagacttcgactttgcagttctgcagcaccacttctggtatagcttttctggtatggcttctggtattttcttcttttctggtatagcttttattaataatttttttttttttttgagacagagtcttgctctgtcatccaggctggagtgcagtggcgcaatcttggctctctgcaacctccgcctcccgggttcaagcaattctctgcctcagcctcctgagtaggtgggtttacaggcgctcaccatcacacccagctaatctttgtatttttagtagagacagggtttttaccatcttggccaggctggtcttgaactcctgacctcgtgatccacccgccttcaccctcattaacagtttttacagaggactttaggacagccacactgaaataggatgcttcatcccatgctgaaaagagcatggtgaaagtggcaagtggcttgagacgctgcactgataagattgctgagatgaatcccttggctatggtggacagattcacagtagcaactgactgccagagggctgtcacacattgggaagatgtttttcctgttttactgagcagatcatctaagccccagtttatttcttccaactctttacatcaaaaaataggccttatatagttcctatataggcctttttggagtaggccccattcatcattccttcttttcatgtctctgtctactaccacctttaccctcattttgaaatacaagtcatgcctcttagctgcctgctacttgggtgtacattttcttttgtctcttgtgtcttttctttatgcattcgtagggttggtagagacattgggttagttttttcttctttccttttgcctgtttactttaaaaggcatttccttcttcaacagatatgggtttagagtgtccagtatgcaaagaagattacacagttgaagaggaagtccggcagttaccttgcaatcacttctttcacagcagttgtattgtgccgtggctagaactggtgagtacagcaagtcatggcttctttgggggatgattcagagtaaaggtatagttaacagttcctcgagatccaagtagatcagattttatcccataaatccctggcttactctgatactgttatttgtttggaacttttctgaccaagggttgcaaactatgttctacaggtcattgtgtcctgccacctgttattgtaaataaaattttattggaacacagctatgttcatttggttatagattgtggctacttttgtgctacgtcagcagagttgattagttgtaacagctgtggtgtggcctgcaaagcctaaaatacttattttctgtcccttatgtatttgttttgagacagagtctcactctgtcacccagactggagtgcagtggcgtgatctcagctcactgaaacctctacctcctggtttcaagtgattcttgtgtctcagtctccagagtagctaggattacaggcgtgcaccaccatgcccagccaatttttgtgtttttagtagagacagggtttcgccatgctgatctcaaactcctgacctcaggtgatccacctgcctcggcctcccaaagtattgggatcacaggtgtgagccactgcactcggccaattttcctgtccctttaaacaaaaagtttgctgacctctgctctagaccatattgggaagtaatgggcagttaccctcctgtcatagatcactcactgtttctggttcgttctgtttggtggtatgtattagctgttattaacttgctggcctagaattattcctgtcagttctgcttaaagttctgtttgggagatatcctggtatcacaccttagagccagtgcatgctctatgaggatgcattctctattgtttttctgttccatgtcataatttttgatgtgacaattctcagggttatttaagtgtacaatactcccagcttctcaggccaggatcttcacatagactaatatttttctgtttcagcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaactactcttgatcacattagctatgaggcgaggtcaaattcaggtatctaagactaatgattttgttttgtcttgatccccagagagcaaatcaaagaaaaattacagcaagaagagaaaagtggtttatcattgtgtgctttggttttcttattttaattttttttgttttttttttttgagatggagtctcgctctgtcgcctaggctggagtgcagtggcacgatcttggctcattgcaaactctgcctcctgagttcaagcgattctcctacctcagcctccagagtagctgggaccacaggcatttgttaccatgcccagctaattttttgtatatttagtagagatggggtttcaccgtgttagccaggatggtctcaatctcctgaccttgtgctccgcctgcctcagcctcccaaagtgctgggattacaggcgtgagccactgcgcctggcctcttattttaatttttaaagactacttcagttgatgcagtttcccaagaaacctacataacatatattgggagccttatgttgataggaatctgattcccattcctttttgggaatgagttgggcagcatacaggcacagaaagacagatgtttgagacctttgcttctgagattttaaaaaatgattaccgctgggcgcggtggctcacgcctgtaatcccagcactttgggaggccgaggcaggcggatcacaaggtcaagagatcaagaccagcctggccaacaaggtaaaaccttgtctctactaaaaatataaaattagctgggcctggtggtgcatgcctgtaatcccagctactcatgaggctgaggtgggagaatcgcttgaacccaggaggtggaggttgcggtgagccggatcataccaatgcactccagtctgggcaacaagagcgaaactccatctcaaaaaaaaaaaaaaaatccccaactcactgctttttttgtttgtttctgtcgcctaggctggagtgcagtggcacgatctcagctcaccacagcctcgacctcccaggctcaagtgatcctcccacctcagcctaccaagtggctgggactacaggcgtgtgccaccatgcctgggtaatttttgtatttttgtagagatagggttttgccgtgttgcccaggctggtctcaaactcctgggctcaagtgatctgcctgcctcaacctctcaaagtgctcaactcattgtttactgtcttttttcctagtaatcttaaaataatttgcctcacagaaatagagacagtaagtgtctgcagccagttcactgtttttggtaattcattggtcttcaggagttaagattttacattgtcacattttaatttttaagcctatttttcatctctgaaactttccttttctccttggttctggctatacttggactcaaactgatcagtgtgatcatgtccaaaacagcttggcctggaagaggtaggccttattttttcagcctagtagtgtcccatgcacatgctctttgtagcattcaagtgtttaacattggataaattaagaaggtcaagaatgttgttgaaacttcaaggtctcaaaaggaaatgatggggacatagaacaactgttggtgtaccaaaaaaaggtacagaggggcaccatttgtattgtcacacaacaatgatcagaatgatcagtttagaatgatcagaacaaaaacaccactctttaatgggtctttttcttggctagaagtctttcctcagtttttgttgactatcatacgctgatttgtgggtgacggaagggggctagagataacgtttctctgtactttggtaaaggatgaaggagtcagagagggaacagaaaaagtgagagagtggcctgctgaaataatagcctgcctctaaaagttgtgaccagaaagtatgattcatttgggcccagagggaataaaatatgttttttcatatacctcccatattacacctctgtagtgattgtttatttggggaatgagatctacttactgtgcgttgcccctgaaatgtagcttgagaatacacactggttttgaattggggaggaggatggaaggaaattagaggtgtattatgaatatttggccactacttagatggaggaaggctatgttgaacttgggacacattgcagttttcaagtacacaatatcagttgtctcagaaaaatcatgacagcctggacatatttgcttgtcagtgtctggagatgccaggacaggcagttgtagttttacgtacagatagagaaccaatgcctagagaactagaaaggatctgagtagctttaaaaagggtggaaacaaagtactggataggggtctgcctttttatacacagtatagcaaacagcatcagacaaagttacatgaagttttcttcactttttttgctctgatggatagaggatgtgagactcattttactgtttcccagacctgtcccacttaatggatctgttgtgtttcttcttataatggcaggcacctcagatgtccaggttaatttatgttgaggagttaggattcttcagggatttattattattattattattatttatttatttatttatttatttatttattttttgagatggaggcttgctctgtcgcctaggctggagtgcagtggcgcaatctcagctcactgcaacctccacctcctgggttccagcgattcttctgccttagcctcccaagcagctgggattacaggcacctgccaccatgcccagctaattttttatatgtttagtagagacaaggttttaccttgttggccaggctggtcttgaactctagacctcaggtgatctgccagtcgtggcctcccaaagtgctgggattacagacgggagccaccatgcccagcctgagatttattataaggaattggttcacacaataatggagtttgagaaatcccaagatctgcagtgggccagctagagatccaggagagctgatggtgtagttccagtctgaaggccagcttggataccctagaagagctgatgtttctgttccagttcagaggcaggaaaagactgaggtcttagttcaagcagtcaggcaggaggacttctcccttacttgttctattcagaccttcaactgattggatgagggccacttacattagggagggccatgtgctgtattcagtctactgactgaaatgttagtctcttccaaaaacaccctcacagacacacccagaatactgtatgaccaaatatctgggcatcatgtggcctagtcaagttgacacataagattaaccatcacaatgaggaaaaacagaaatgatacatgtatacagagtgctcctcatcccaattaagtttcaccaagttaataatgtgtctctatgagaagtggttcaccatgttggtcaggctgttttcaaactcctgacctcaggtgaccacccgcctcggcctcccaaagtgctgggattacaggtgtgagctagcactcccagccgacaggtgcttcttaaatgttttctttgagcaggaattggtccaggaattggttctcaagttagaaggaaaatttgaggggaagaacttgttttttctccaatcagtctctgattaaatagttattaggaaaaactccttgcttatgtctttgtattgcacatttttatatatgtatatatgtgtaaatagagatatttatatattcacagacaaacacgtgtatgcacatttcacaatggaggaagaagggatatggtgtgcactgaggtaaagtgagcagggatacagaagagagctggagcctcacagtctgattctctcattgtacataacctttagggtctttgtttccctgagttctctggtatggggcactgttggcttgggctggtaccctgttattctctgtgatgaagggattcactggaggtaaaaacgtaatcatttccaaaggttgagaataaatgactttgaggaaagggtgttcattatccgttgcttctatattataatcagttgaactacaatacggttatctattgattttttttaatttttctgacaaattattgacaccaaattgaataattcatgacctgcatgcttcagcttctttctccctggtttccaggtgctattccctcaagaaatgcaaattaaatatgtcggtcttaataaatcaggagggaagcatagtctgtgtctgttttaaatgacaacaacaacaaaacagctttggggtttaagaagtggaagacacatttttatttttttgagacacaatctcactctttcgcccaggctggagtgcagtggcgtgatctcaggtcactgcaacctcccgctcctgggttcaagcgattctcttgcctcagcctcccaagtagctgggattacaggcacgtgccaccatgcccagctaatttttgtatttttagtagagatggggttttgccatgttgcccaggctggtctcgaactcctgatgtcaagtgatcaccgacctcagcatcccaaagtgctgggattacaggcattagccaccacgcccaggtgagaagacagattttaagagaaggagcagggctggtatctgaataggtatttggatgttaggggaaaaccctttttggcctctgtggtagagcgatcggaaggtaaaagtgctgtttacaagaataatccattggagatctggggattggggacgacttataggatagagtcctcttgttgagaatttcccgaatgaatctcatgtaggttctgtcacagtaagatggaggaaaactttgatggggtaagtatcacaagtggctgtcctatagggggaaatcctagcctgcagtaatgtcagtgtctcagtattcagccagcgagccactgagctgctccaggggtttaaaatagaatgcatagaatacaatgtatacagctggtgatgctttccaggatcaaaatagagcccttgtctgatcccattgacattgtaaggtttcgatctctcatacctgccacagacaagtacattgtaggcattcaacttttaaggttttatacatgcaaactttatgttttcctgccacactacacttggtgtccacagaagtgtagtttgtatgttgcctcttcttcctctttcaaccagaacacttagatctgtgatcataggatgtaagcctgtgattctttactttttctaataagaaatacaattttcaagatccaaaaattattagattcttggctgggcattgtggctcatgcctgtaatctcagcattttggaaggctgaggcaggcagatcacttgaggtcaggagtttgagaccagcctgggcagcacaataaaacaccatgtctactaaaaatacaaaaattagccaggtgtggtggcatgcacctgtagtcccagctacttgggaggctgaggagggagaatcgtttgaaccaaggaggcagaggttgtagtgagccaagattgtgccactgcactccagggcaacagagagagaccctgtctcaaaacaaaaacccccaaattattagattcccttccaacaacttgatagccatattattagtatttttgattaaagaatacataacaaaaagctgctatgatttcagtaatgcttttaagttaatttattagtcacaccagaatctacatccaattgaaatatatacaaatatttgaaagatatttattcaggctgaagattatggtatatagattccttctgataacctcatggcctcacaggttcaaaacccgtgtttgtgaatcactcatacagattggggctaagatgcgtgtccagaaaaccacctattatgcatgaaaatttgtaggcttatttgaaggcaattgtatcaacacattttgaaagccaagacacaagtattttaagtttctgtttaaccaagtctcgagataagcagagtaaataaactctttagaagcaagactcagttggtatgtacaaagtgggattgctttgtatatattccgcttagtttgagtcagagctagtaatctgatgctcttaaatgtcttcataaacttgggcagtgatgtttcctttctgtgattatgtgtcacagatttttatatgtggactataattagtatagtacaatggctgaaacttttcctatagttggatatatcttctgagacttccagtgattgtataatgttgagtagctccagaagattatttgaatagtaaaaacaaaagacatctctacctatgtgagtttattatttagttagaaacacagaactaactatttaaaacaggtagagaaagattaagatgaatgtgatgtagtggagaaagctttggagactttggagtcagaactcaaatggctctaggtcccaaatccagactctcattttgattctcagaacaattctgtggaaagagaagatacaataggcaatatccctttttacagataggtaaacagaaatagcatctcaaaacctcatttgcactgggtgaggtggctcacgcctgtaatcccagcactttgggaggctgaggcgggtggatcacttgaggtcaggagtttgagaccagcctggccaacatggtgaaaccccgtctctaccaaaaacacaaaaattagccaggcatggtggtgcatgcctgtaatcccagctacttgggagactgaggcaggagaattgcttgaacccgggaggtggaggttgcagtgagctgagatcatgccactgcactccagcctgggcaacagagtgagactccgtctcaaaaaaaaaaaaaaaaattcatttgcccaatgacaaatagctggtatgttgcagagccagaatttgaatccaggtctttttgcctccatggctagtccttttatctccatgggatacagtctaaaatccttagtttgaggttcaagactatcactaataagagtcttactcatctacttcagccatatctctttccgttcccacaaaccttagctcccacatttggcaggtccttgccaaggagcacaggtaaagtgtctctttccttttaatggctcaccatggagctgtagctaaatttctgtgctcttacccctttattcatgtagttcctcctatcaggaatatcctgcccactctctgcttaactatgacaagaggtcatctgtccaaagagaaagaagagagtttgtggatttaggagaaaagaaaatactccaaatactgctatgggcatttatttaaaaagagaaatgaccaaagaggttaacaagtatttagatgaagctgggcagttgtagtctgtggtgctcttggtctgcacaaatcttcctcttcctccagcagtgctgtatggatgttgttgaatgttgaggtctgtctgcattttctcattttcatgccaagtcaatcactggatctggctgtcttcctttctgtcctacctatctttgcttgttttctctctctttcctttgcagtgttaaataaaaatttattcccccaaaatttggtgttctcattttgtttgacttattttactatgttgatgaagagggaggaaaagtttttctggggtacaaaaacgcatatatttatccgatatttgaggactatactacccactttggtgaaagctgttctgtttatttactggagcttaggagggaagaaggcaagtttgccctgatggtgaggagcaaagtcaaggattacactgatttgccccagcttatatttccacagattcttggtatatttagcatctcttcccctgtgccctgttgcattcttctctgtgcctattgtaatgagaaagatactaagccatagtcagactcatcttgctgtagctgttttaaaagtttcttttggcacaaggcttacaaagctgtggaaagaaagtttgtattactgccttataacttagaatagcaacaaaatacctgatataatgaagtctcacctgtcctgagatgcgtgcgtgataggccctcatgactgtaaagggattggaaaaggaaagtgggaactattttatgtattgcatcttattactaaattagggttgtaatcttgagcaaatctgattctggtgggagtgggaagggggctagcctttgatcgctccttgctggaaggaacaatcaaagaagcaatagatgccactcaaaaagttgaaggtaggttttccacgtatagctctgaattgttggcacagtggtaagacaaggatattcactgaaactagttcatgagctgagagaggcacagaggtccaggaaactccctcctccttttccccacatgtaagcatgataacttgacctatgtggtgtttctggacctgaaaaagcatgtgtactattctactgaatactacctctttcaataattctactaagccttgagttggggaagaaggataaagaaaagaaagcttctaagtagtgtatattttctcgtttaatcaaatattgagctttggttttttcctttggttaactttaaagctacttgaattgaatataggagaaaacaaaaaattggattcaaaagctcattctcttcacctgagtggaaaaggaaaaaaaggccagagatgattttttttttttttttttttgctctaggatgacttgggaatcaaagatagtaactagtagtaggttgtatggctagactcaatttcccctttataatttttattctaaaataaaatttattttactggttacagtggcctaaccaagggaatttaaagtcaacaaaaaattatgtctaaaggtcagactgtttcatattcatgtttcctcctgaaaactggcataggcttaaatttggaagatccttaccaaggattacagataaggtctctgttttctttttgaaatctctgttttcttttgatgacttgcaaataagggactggaatagggaatgtttaggtggtcctgtttctggaaaggggaggagtcaatctcagaatgaatggggtggtgaaggatgtaagaggtgctttgcatatagtagatcattactgagtgtaaggttttagagtgagaaggatctgtattaattgctgtgacaggcaacaattaactctttttttttttttttttcctttgagaaagtgtctcaccctgtcacccaggctggagtacagtggcatgatcatggctcactgcaacctcaaccagcctgggctcaggtgatcctcatgccttagcttgggactacagttgtgtgccaccatgcctaatttttgtatttttttgtatagttggggttttgccatgttgcccagactggcctcaaactcctaggctcaaaggatctgcctgccttggcctcccaaagtgctgggattacaggcgtgagccaccgcaccaggccctatttaacttccttgtgtctgtttcctgatgagtaaccaggggatgtttgcttgcaagggttgtataaggttagaatcatcatgtgtaaagcatctgattcatcatacaggttttttaacaaatttattaagagcctgccatatgtgtgggacttttcgttggggtaaagaagacaaagtccttacatatatatagagcttacattctgatgccattcaaaacagtggtagttattgatttgaggaatgcctaaataaaatggagttaagaatgccaaggccaggcaaaaacctgaatcagttgcttgttatgcaaaaacgttatgacaaattattggaagtttcactttttgttatctaatagggaaaacgctaatctatattggtaaatggttttcagaggactcagctacatgtgtttaatatactcaatctggccatcagcctttgctgaggagccgcattgttcaaaacccatctccaaaccaagtctgtctcttgccttttcttcctctaatagctgaaaatctgttgcttcaacttgtagccctctgttcatgcagtgagtagaggtagttgtactaacttgcctctctcacaggccttcattcctaatgagtcttacctcctacccattgaaaagtctgatttatctgtcttcctccttagtgcctttggatcagtgaaactggtttgaactttcctgtggatagccagggcttgagtaacatttttctctccccctggacatcctttccaaccttctcctcctggagaataaccaaggtggcagaaatataatagcaccctcattgcttggggtgcttacggctcttttggacataccttgaagggccacaaggctggtgaccagcattacccagaccttttcttgtaggaagcctgaactgagagtgccttcattatggctgaactcaaggtgttgtctttgtttcaatcccgtcactgtgtagttccctgtctctggttcaaaagagaatcatggatcaggggagggtttcagaaatcatcagtatctccttttgcatcatctcataacatctcttttatgatctccaaggattcctccctctgtaattcgttgcccaaataagtatttttaacattgtgggtaatgatgatgtacttaggcagccataaataagtatagaatctcctgtgtgtcagacactagggatgcagatagatcttaaagtaattctaaagttttgccacagagatagctgaaacagcttagtcgccttggacttgggtatccccaaatagccccattttctagagtggttcaagcaatctagcataagttaaaatcttgcccttttggaatagatctgggttttttttgtttgtttgtttgttttgtttttgtttttttgagacagggtcttgctctgtcatccaggctagagtacagtggcatgatcatgggtcactgcagcctcatgccccgagcccaatcgatcctcccacctcagcttccctagtagctgggactacaggcatgtgccaccacgcccagccaatttttgtattttttgtagagacaggttttcactgtgttgcccaggctggtctcgaactcctgggttcaagtgatgcacctgccttggcctccctaagtgctggggttacaggcatgagacactgcacctggactagatctggatttttatccatcatttactgttggatgaacataaattatcttcaagcttgagttatcacaggacaatagctcaaaagaccatggagattaaataatataatatcacttagcacaatgcctggcccacagtaagcactcagtaaatggcagacattgttttttattttattttattatttctttttttgagacagagtctggctctgtcgcccaggctcgagtgcagtggcgcaatctcggctcactgcaacctctgcttcccgggttcaagtgattctcctgcctcagcctcccaagtagctgggattacaggtgcgtgctaccacactcggctattttttgtatttttagtagagacagggtttcaccatgttggccaggcttgtctcgaactcctgatctcaaatgatctgccagcctcagcctcctgaagtgctgggattacaggcgtgagccaccacccaccctgacattgtttattacctgtctcttcttaactagttttaccttccaaaatgcacctaatttccacacttggggaaccatctagatgtgctgactctaatacttaaatatgctgagaagatgagaaaagcattcttccttagggagaatcttcacaactaaaacaatatattaggagaacaggatttaggttataaggagcaaggactgtgttatacctcattctgttctccaaggcatagcgctgggcctgggatgcacaatacatatttgttagatgaatgaaagaggagtatccactagtgcagtttaactgaagcaatgtattcacataaatagaatgaaatgctatagagtctctagtgccaggctaatgtaatttagactttattccatagacagtgagaagccattaaaactttgagtgatgtggcatgtacaaattagcattttggaaagacaagctggtggtagtatgtagaatggattggaggcagaaacagtatttagagttgctggaccattaggcaacagctcagtgctaggccctgtggtaggtgtgggagatacaaaggtgactagggcacagttgctgaactcaagggactcactagttaggagactataggaatatgttaagtgtgaggtgatgaagacctgaaaaacacctttggaaggaaaggaataacaaagtactgctattcttccccactaagtactgctgtgcggaagaacagcagtacttagtaactctctgaattgggggttaagaaaaaaggaggaaccaaagttgactccgtcatgaacagaaatagggtctcaggaggatagctttgatactgagtttgaggaaatggtgggacatccaggagctaggagtacagtttttagtttaaacgtttaattaaaacttaggaaaggtgttcaagctggagaagttgatttgctggtcagttgcagggagatgctggtttaaatcgtgggtagatgagaactagggagagagagtaaagagaaaaggttgaaggggtgagaagtgagtcttggggaatactcatgtttgagaggtgggaggaggaaatagagaagacaaaagaacagccaggtgggtagaacagccaggggagtacagtcacagaagccactggagatgacagtttgatgaaggagggaatagtcagaagtgctgaatgctatagctaggtcagacaggaagacaccaggaagcaaggaacaaagtcagtcaaactaaacaagttgaaaatttgaattaactaggaaccataggaggtgattagaaacatttgttcaaaggctctgggccagtttttcatggggggagggtggtgagtgggtaatttatacttgtttttcttaaaaagtaagataggccaggcacggtggctcacacctgtaatcccagcactttggctaggctgaggcggatagatcacctgaggtcaggagtttgagaccagcctggccgtcatggcaaaaccccgtctcaactaaaaatacaaaaaaaattagttggatgggtggtggcgtgtgcctgtagtcccagctatttgggcggctgaggcaggagaatcacttgaaccttggaggtggaggttgcagtgagcagagatcacgccactgctctccagcccggaccacagagtgagagtctgtctcaaaaaatcaaagaaaaagaaaaaaaaaagtaagatagttgtaagttcatggagaagtaagatagttgtaaaagttcatagagaataatagcagtgcccttttgtcctcctaggcttattgtctgagacaaccactgtcaactcttcgagatgtcttattatattcctaaataatatgctcatattgctgcttcctagtgataaaatttagacattttctattggctttctgctacagtagatgaagatgtgctagaatatagtagatgaggattatactttcacccattttccttctctgcattcttctaaaaataattgtaccacaaattttatttaaattagtcatgtttacataatttggattctgtgttattttttgcaaaatcaagttgtgcgctatgtttcttttgtaaaatttagttttttctagagcctgattttatttttttactggcagagttttccatatccatttctttaatctttttattgggtctttaatgggcctttagaaagatgatatgtcgattccatttttacctcctagagatctcccttccagagtcgtctttctcttgctctcttctggactaactgcccttttttaattctagaatttccttttttttttcttttccactagagatggtgtctccctgtgttgcccaggcttatctctaactcctgggctcaagtgatcctcccaccttggcctccaaaagtgctggcatgagccactgtgtccagcctagaacttccttgttagactccttgtttcctgtatgtcattttatcccctttatggattcactttcttgttttactgaagcacatcctctggtagcttctttgaaaagatcacatggaaggcaaatttttttgagtcattgcatctcatgatagtgtcttttttctttccttacatttggtttatagtttggctgaatatataattctaggtaaattttttttttcccacagaattttgaaggcttgctctattgtctaggaatatagttacacagagagacactttctgttgggcacaatttgacttaaggaagccacttaaagctggggctggagtggccatatttaggatatgccaaagtagtaatggagcagggggagcatgcatagagtgaaagacagatgcagaagccagaggccttgctgcttcacagtttgaaacggtaactgttttgcgtcctgtcccctttctagtttctgattccaggagctagaactcatgagggccagctgtacttttttattttttcctcctttaatctatggtactttgaattggtttctgtttcctccaactaaatgctccttaagacagacacccatattatctcaaacctaatctcgttgtctgcctgaatttagaaatatagccacatttctgggagagttctgaattgggaatcaggaggcctaatttctttcttttcttttcttgttttttatttttttgagacacagtttcgctctagttgcccaagatagagtgcaatggcacaatctcggctcactgcaacctccgcctcccaggttcaagcgattctcttgccttagcctcctgagtagctgggattacaggcatgcgccaccacacccggctaattttgtatttttagtagagacagggtttctccatgttggctaggctgatctttaactcctgacctcgggtgatctgcctacctcagcctcccaaaatgctgggattacaggcatgagccaccatgcctggccaggaagcctaatttctatctgtttttactttcaccagtgagtagcactggacaagtctcttcaacccctgtgtcaccatctccctgtcagtaaaaatgcaatggccaccccaagtaagagttctaaaattaaagacaaaatgagattatgtttgtgtgtgcgctttgaagaaaggcagcatctgccaatggggatgttggaaaaggattgaggaagaaggaaactgcctttccaggacctgaactatctggttacatctccactgtcaaccctgctcactgtcccacctggtggcattaggagtatttgagcactcacctgtgaatagaatggagaaaaaatggccctgaaggcggatacctgacttctggcttctggcacaacactggtaggtcccactgtgcaacggtgtgacttggcttatggtgaacatcaactgagatgatatttcaccaacaccatctatcccaggatcccttttaagtctcagctgttttaaactggtctcaggagaacagtctccagacctgtccttgcacaaaaacactacaaacccctcagcctcttctttcttatgccatacagtacagattaagtttagtcgcgttccttcctgggaagctgagctggtgatgttaatgcatcctggaatggaaagggaagaattacccagaggtcaggtagcattctgtgaatttcaccgtaactgctccttatcactagaagtcttcaaggaaggactgaagcagaacctggcagtagtgctggcagacaggaaatacaaattccagctctatcgatggctgtgtgactgtaagcaagttacctaactccttgggcagtagtttattcatctggaaaatgaaaattaagggactaaataatatgctcaaagcatccattaattcataggtttatttgttcctccacttaacaaatatgtttaggtattcactctgccaagccctgctggggctgtgaggactaggacgtgagccctactgtcagaacttttttttcccctaaccattagatgaccggggatttttaatttaaaaaatttttttttaaaacaaggtcttgctgtgtcacccaggctggagggcagtggcacaatcgtaactcactgcacctttgaactcctgggctcaagcaatcctcctgcttccgccttccgaatagctaacactacaggtatgcaccactatgcctggctaattttttattttgtagagacagattctcactatgttgtccaggctagtcttgaactctaggcatcaagcaaccctcctgcctctgcctcccaaactgctgggattacaggcatgaaccactgtgcctggccactctcagagtttaaagcctaatgtaaaaacaaattagcaaaaagttacaatttaattccacagttattataattgaggaatcttagagattcctgagtctgaagcatcagggaaacttcacagtgaagttagtgctggagctgacttgaaggatgagtaaaagtttttctaagaaatataggatgagagagaccacagaaataccagagatgattaaaaacagccactgtgtggaaatggagtgagaatggactggagaaacagactaattattgagggaccattgatatccaaagaccatgactctgatggtgccagtctgcccacttgattttccctgtaagtaatctgtaacctggatacagaagtggagaaaatagttgggttaacccaggatgttttggctcgatgggtgtctctgacctaattttgcaatgcattggccctgccaactttgtactgcccctcactctcctcaaacttcacttccttctgtagtttatattttgtagtccattattaataatctctcccttatatccaccctcagctcccttagctttactcctactgtgatggatcctcgcaaaaccccaacctcggttaaatccagctctctgctgaaaactcatccggcagatgctgaggctgccagccccctcccccactcccttggcagcttgatccgctatgacttgcttttccttttaagactccccttggtatacatagtaaactaaattcactctcatgaaaacggtgaagaggcagagatggaggctgccccctgcatattgaatgccattctcctacaagagtaagagatatgggtcttccaagacccatatctgagggagacctgcaatcccagccattgattaactccaaaatggtttatattttatttctactttccagctggaacttctatagggtctctgttagagtgcttttctgtatatcaaatcctcagtatagccatagagggcaggtattactcttcccattttataaatacacaaattgaggcacagagtggttaaactagctgctgaagttaatgaagattgcagtatctggatctcaaacctggatttcataaatttatagtatataagagcctaaaggaatcttaggttgaggcgcagattgccaggctctttgaaacatatagcagagacagagtgtctgatagagaggcaatagtatcagttctaatgaaaaagaaaaagacaatatattcttcaccctttccttaatgtcaaggagagtgagtcagccgggcgcctgaggatcacctgaggtcaggcagagttcgaggccagcctgaccaatatggtgaaaccccgtctctactaaaaatacaaaaattagccggcggtggcggcataagcctgtagtcccagctactcgggaagctgagccagcagaattgcttgaacatgggaggcggaggttgcagtgagccgagatcgcgccactgcactccagcctgggtgacagagcgagactccctcaaaaaaaaaaaaaaaaaaaagagtcctttgtttccccactagagaaaatcacgggatccagcccttcccacaagcccaggatcctccccatggccgtctctgctctagggtctatcctcaccaccagactggatgtccacaattgccagcaggatggccagggcacagcagcctctgccgggttccaacagcatcctgcacgctgtcagcaggcccaggaacttgaagcaaatgttggctctgctggtatccttggcttcagtctcctaaaagcacagggggacccactagacaaagccttccagggttccaagaccatttccccatcccaggctctagctttgattggctagagtatgatggaggtagaggagggcttgggcatgagagtccagctggctgggaagtgaggcggtaaaccaagtgagatacactgggagccggggagggaggggcatagggagacactaaaggctattttctcatatatatatttttaagttaaattggattgctgcgtcaaagaatatgatgattaaaactttttttctactataatcagattgctctccaaaaaggctgttgataatcagatgttcaccaagaatgcttgatagtgtacatttcctcgtgcccttgctagctctgggtattatctgtactttaacatttttgccaatctgatggatgaaaaattagacctgctttatgttgcatttccatgattagtgaagttgaggatcttttcatatgcttattggtcattagtattcccttgtctgtgaattgtgtgttcatattcttcacatttcttaacttttaggcactttctccgtattagagatattaacccatctgccatttttttaggcaaatactttctcccaatttgttgtttgtctcttcactttttttatgaggcttttttttcacaaggaaagtttacattgtatgtaattaaatacaacatatctatcttttcctttaagttgtctgggtttcctgcattgtttaggaaagtttccctccaattgaggctataattttctttcaatatttttattgttttactttttatagttacatcttctaatcctggctaagaaaaattactcctgtttcaaaataaacaaactgaagaaaaacaaacacttgaatttcatcaatagggaaatggtttaataagtttcaattaatctatgtgacaaaatattatatattattaaaagaatgagatacttctataaatatgggcctggagggatgttcatgatatagcattaggtcaaaaagggcaaattgcaattatgtatataaaataaatacatttttattttaaaaaatcctctctatgtgtgtatgtgttttaaaaatatatttaaggttttgtagtttataacttttgaagtggtaattacattcacagcatttaaaattcaaaaggggaaaacaagaatttttctataaatttatttttctgatttttataatcagcttgtctagtcttgcccttcctactgtgtgtaccatcaagaaaaagtcctattggtattttaaaattgggatatgttcaatttatattttaacttagggagaactgaatttgttgtgacattgattcttttgatccgagaatgtgatattcatttttcaaatatgtgtgtctcaggtatgtatagaagttttcttcataaagtcctcgtccatttcttagctaagtttgtttcttgagtaattcatattttttcactattgaaaatgtcatcttttacccattatatcttttttttaatatactttaagttctagggtacatgtgcacaatgtgcaggtttgttacatagttgtacatgtttcatgttggtttgctgcacccatcaacttgtcatttacattaggtatttctcctaatgctatccctcccccgggcccccacccgtggaacgtcatcggtgtgtgatgttccccaccctgggttcatgtgttctcattgttcaactcctacttatgagcgagaacatgcagtgtttggtttcctgtccttgtgacagtttgcttagaatgatggtttccagcttcatctatgtccctgcaaaggacatgaactcatccttttttatggctgcatagtattccatggtgtatatgtgccacattttcttaatccagtctatcattgatggacatttgggttggttcccaggctttgctattgtgaatagtaccacaataaacatacttgtgcatctttatcgtagaatgatttataatcctttgggtatatgcccagtaatgagattgctgggtcaaatggtatttctagttctagatccttgaggaatccccacactgtcttccacagtggttgaactaatttacactcccatcaacagtgtaaaagcattcctatttctccacatcttctccagcatctgttgtttccactcgttgtatcttttaacttattttttcagtctctttatatcattcattatatcttttaatttttcattattgttcatatatgaaaggctatttgttttactagatattaatttcatacccagctcccctcccttaattctatcatttttcagttgattctcttggattttccagttatgcaatcatattatgtgtacataatgataattacttccttttctattttatatctctgatttctttcttctaattgtgttggttaatatctccagaaaaatattaaataataatggtaataatgaatctctgtcttttttctaagtttaatgggggatgcttaaatgtttccttattaagtattatagtagctttgagaatgagatgtattttattatgttaaggaatatacatttatttctattttattaagagttttaaaatgtcaaggatggatgtgaatgttttattaattgcctttaaatatcaactaaaatgatattatttttctttaagatatattaagatggcgatctacattaatagatttcctaaaattgatacatctttgcagtcccagacaaacaaacaaaaactgaagccatttggtcatagtatgttgttattttcttttgagacagagtctcactctgtcgcccaggctggagtgcagtggcacgatcttggcttactgcaacttccacctcctgggttcaagcgattctcctgcctcagcctgccgagtatctgggattacaggcgcctgccgagtatctgggattacaggcgcctgccactgcgctcggctaatttttgtatttttagtagagacggggtttcaccatcttggccagggtgatcttgaactcctaaccttgtgatccacccaccttggcctcccaaagtgctgggattacaggcgtgaaccaccacgcccggcctagtatgttattcttttcatgtgctgctgtattctgttttataatattttatttaaatttttaaaaattgaaaggcccagttgcggtggctcacgcctgtaatcccaagcctttgggaggccgaggtgggaggatcacttgagcccaggagtttgagaccagcctgggcagcaaagtgagaccatgtctttacaaaaaatacaaaaattagccacgtgtggtggtgcgtacctgaagtcccagctactcaagagacttaggtgggaggagcccgggagttcacggatgtagtgaggtatgatcttcactgcactctggcctggttgacagtgagaccctgtctcaagaaaaccaaaatcaaaaattacacacacacacaaattaaccaatcatacaagatattaaaaatataatacaccatgacaaatggaataaggtttcatttttagaaattcttggatgatttaatattaggaaatctattaattaacatactactggataaaaaagaaagtcaatattaccttctgataacatcttacattaattcccactaaaatcctaagtaaaatggtaatggatgaatactattcaatataatggagaaatgtatatctcagataaaattgcagcatcatatttaatggtaaaatatgggataatttctattaatattaggagcaaggcagagatgcttcctattatttctgttatttcacattgttctgaaagtgtttgccattatatttagacaagaaaataaagcaaagggtataaatattggaaatcttaaggcaaatttattactatttatatgtgatataacttacatctagaaaacccaagaaacttaattgagaattattagaaacaataaaagagtatctgaataggcagttcacaaaagacgaaatgcaataaaaagtttttcagttttacaagtattcagggaagtacaaattaaaaattcagagttcagaatttcagaattaccacctgttaagtgaacaaaaatttaaaagataaatcaaattttggtaagggtaagaagaaatatgtgcaatcattcactctaggtagaactatacattgttacggagctttgggggaatactcattatatattaacatttcaaatgcacataccctgtccctttggctatagcttacagaaataaaagcatgagtgtgctagtatagatgtacaaggatattcactgcagcattttttataataccaaaaaaatagaaacaggtgaaggccaggtgtggtggctcacacctgtaatcccagcactttgggaggcgtgcggatcacctgaggtcaggagttcgagaccagcctggcccacatggtgaaaccctggctctactaaaaatgcaaaaattagctgggtgttgtagcaggtgcctgtgatcccacctactcaggaggctgaggcaggataattgcttgaacctgggaggcagagattgcagtgagccaagatcacgccactgcactccagcctgggcaacagagcaaaactttgtcgccttcctgcccccataaaaaaaggaaacaggtgaagacccactggtgagaatggttgaataaattattgcagatccacagaatagaatgttatgtaattatagtttgtataaaacaataaactaaattagtgtatatacatacaatttaataaggtacttattaatacataagattaaaaattttcctggatctaattattagtcagaaaatatggtagaaggaaaagttccattcattatagcaaccaaaaaacccatcaaatgtccagaaaaatgtaacaacattccgaataggacctataggatacaaactatacagtactattaaggaacataaaagaaaatctaagtagagacgattgttaaattcttctgtacttatctatacatttgtcacaatcctaataaaacatcccagcagcagctcatggtatggccccaatgtcctttcctagccttgacctctccttgttccttctcctgtgttatcataccttcatgctacaccagaatgtcctggtgactcttgaaacatggaatattaagtgacaaagaggataaatgaataaaatgacaaatcattttattcaaagaggaagacaaagaaggattgcaattattcattcagcccagaattatggttaaaaagcgtagactctagagccagagtgtttgtgttcaaatcctggtcctaaaacttaatagtggcgccgggcgcggtgtctcacgcctgtaatcccagcactttgggaggccgaggtgggcagatcacgaggtcaggagatcgagaccatcctggctaacacggtgaaaccccatctctactaaaaaaaatacaaaaaattagccgggcgtggtggcgggcgcctgtagtcccagctactcgggaggctgaggcaggagaatggcgtgagcccgagaggcggagcttgcagtgagctgagatcgcgctactgcactccagcctgggcgacagagcaagattctgtctcgaaaaaacaaaaataaaaacaaaaaaaacttaatagttgcatgactcggtcaagtttcttaggctcctgggccaggcgctatgctcagcctttaataaatagacatatttcagaaacacggagcatctataatgtgtcagacaccatggggcacagagagatcactaacacagcagaggcggacgttttagtggttaaatggtctctagagtcagaccaggatgtttcagatctggctttgaaacttaactatctgtgtaatattgggcaagtttcttaatctcttaatgacctataaaatggtgacaaaatattctcttccttgggttgtgagggtcaaatgaggtcacctatgtaaattacttagcacagtgcctggcagagagtaagggctcaataaatgatagctatgattagttttatgctttcttatattggaatcaatggacagtgttccaggcacatctacctgcaagactgtgtttagtccttataaaacactaagccattattattttctaaaatttattatttgtacgaagcatatagaggcttggaggggacttgtgacttgcttaaaatcacagctcctaagttggggagcaggactctaacccaagttatgagagtctttctcttggagtcccctttgtccctctcctcacagccgctcatccattcacgaacagctgttaacacaagaacgactgtactaagtaataaggtcataaagtgtcaaggggcagcacaggagaaattctggatgagggatgtggaaaggctgcaagatggcaatgaagttaggccttcatagttgtttgtgggctctggggagctggtgactaaagaatacggtgggtgaattaaggtggggaatgggctgaggagatctggcttccagtcctggctccgcactaggtagctgtggaatgttgacaaggtcgtgtcccttctctaggcgtgtttcctaagggactggtgcagcgggatgggaggggcgcagggtagggaccgcttccaaggagagagaggacaggcgggaggggctgatgcagctggtcactccgctggagtggccagacttcgcggtgcctagggccgagttgaagaagagcatgtaagtctgttgtgggcccctcaccagcgctggggggcagcgaggtcactgggcaaggatgctctgggaagtgaccttggtgcccgggaggggagcaccctgttgtgatgcaggcggggcagcgcggagccggcggcgctgatttcgcactctggccgctagagggcgctgcctttcagccaaagccgagtgaccccctacctgccccgcgttggcccgcgtcactccagccatgggccatccagcgagcatgggggctagccagggaaagtctaaactaggaggggagatgagggggtgcaaagttgggcctggtgggtcctggggacgcagcatgtactagagcggcacctggccctcaacagaggggagagcgggtggtcgtgagaagtctgggaattttccgggcccactacacgccaggggcgggtctcccctcttaaaacgttgtgagccccagcgcgggcaggggggagggtgcccgtggagttggcatcctcatctttgatggtccccggggctcctgagctgcgctggtggccccagggctcggtgcctctctcaggcgacagctcacagacggcgggaaactcttccctcccgcaccttcggaggcggtcctggagtcttgtggactcctgggttcaaatccaagctttgtgtgaccagcacattgctggacctcactcagcctcacattcctcttgtgtttaaaactacctcataggaatgtggtgacggttagatgacacataaagctttgccagaggttttctggggagggtggggacaagagggcaaggaagagtctccatttcctctgccaccggagcccggatctaacctctcagaggagctggaaggtcagctctgagctccacaaatacctctgtatacagatctcccacgacactgaaaaagatgcccagaaagatctcatttgcagctgtgaaggggcttctttttcaatctccacaaccccaactgccttaaagtagaaccagacttgttagtagacagaggtttgggctggggggcccttgaagctcttgtctgagatctcaggcttcctgctcaacacaccaaagcaggtgcctgacataaaggcgccatggacctctttggtggtctgggaaggcatatggagtcccttctcagaacaacatttaaaaattaataagatacatgggataataaagggaacaaattatgacaagacagttgtcaaaacattagaagaatgtgtggtagagcagtacacatgcttctttagatttgacatcagcctaataactgttgtaattctgtagtagtgctgagcgttaaggacatttggagaaatctataaaaactgtaatgagatttgaaaatatttgtgttttctattgatggcaaattctattgtggttcattgtctacattcataactgaagcaagtgctgactttcaattaaagattagtgaaaataaagatgtatttttccccccaattcacaaatcccatgaataaatctattcacggacctccaagaggtccatgacgtgaaccacctaggacatgaacttcccccggaggtgcctcacagggccagctccaagccccgtggcacctcccggcttgtctcaggccaatccttgaagagctccagcagatctaaactttggtaactttcctctggtaatttgaggaattcctccatttgaggaatgtcagaatggggccaggattcctgaatgcccatggaagaaaagcgagcatgctggtctggcgggcagaaataaccttctccccaggctccagagggcagaggacatttccctccaaaaggcaagtttctcagggacctcatgagaagcctgtcctcacctgagcagttctgtcaaccatcccatcccttcacctggaccccaggtccccagcaggcctttttacctcgagacagaagttcttctttcttgttctcagactgggggctcacgttgaaatggctctcagtcctcagattgtccttgcatcttgttaaaaccctatctctccagtttcgtcattgctcacactttcatagctgttattatattcgctctttgaaaaccacagaatgggttgttagaagtcatagatcttccgccacccccactgtggatttttttctcctttctctcctgcaactggtcctccatctccttctcctttcctctcccttgttttgtctttttggtgttagaaatagactagggtgctgagggggctaagaaaaaccacttcttaaaattcttttctttaccctggggaacaaagattttgtatttgctaattcataataaggaaaggactgatgatagaataactagaagataaaaggacagaatgtcctctcaagtataaagaaaggtaccaagtcttctcctgagagtaggttttggttagaagtaggacagagaacacagctgctccaggctgaaagggaagaaggtcagggagctgtcaagaaggcttgggtgagggtggtggtgagcaggggaggcaacgagtgggggcaccaaaatggtcctgatgtggtggggggaggatgaatgactgaccttatcttcccacccacccattttttttctttttcttttttctttctttccttttttttttttttttttttgagacagggtcttgctctgtcaccaaggctggagtgcagtggggcaatcatggctcactgcaaccttgacctcctggggtcgagtgatcttcccacctcagcccctcaagcagctaggaccacaggtgtacgccaccacacctggataactttttatttattatttatttatttatttatttatttagagatggagtttcgctgtgtcacacaggctggagtacagtggcgtgatctcagctcactgtaacctctgcctcctgggctcaagtgatgctcctgcctcaaccttctgagtagctgggattacgagagcctgccaccatgctggactaattcttgtatttttagtagagacagtttcatcatgttggccaggctggtctcaaactcctgacctcaagtgatctgcctgccttggcctcccaaagtgctgggattacaggcgtgagccaccacgctcggttgataatttaaaaaatgatttgtatggatgaggtctccctatgctgccccgcctgctctggaactcctgggctcaaacaatcctctggccttggcctcccaaagtgctgggattacaggcctgaaccaccactcccagcttcccatccatttctattctgttctgttcttccttggtcagtgatggcttgggagattacaattgttcctaaattctagggttgtgcccttagatggcaggaacattagtctgagaattagaagcattgggctctaagtcctgcaaggctgggccaggccctgtgccaaagggcacagcacaccaggaagccccacggttctggaggaacacctgtcatgattgccacccagtgccaggctacccaggaattcaagggtggagggagggtgggggaaaatttttcataactagtctagagactctcttttccttcttattcctgttattgtagtactctgtggtcctaaaaacagtagggtgctctggggtttgagaactcccagatggctccactgaagccatcgtcaaatgagacagatattagaaatatttcttcactccaagccaggcgcagtggctcacacctgtaatcccagcactttgggaggccgaggcaggtggatcacgaggtcaggagattgagaccatcctggctaacacagtgaaacctgtctctactaaaaatacaaaaattagtcgggcctggtggtgggtgcctgtagtcccagctactggggaggctgaggcaggagaatggtgtgaccccccgggaggcggagcttgcagtgaaccgtgattgcgccactgcactccagcctggatgccagagtgagactgtgtctctaaaaaaaaaaaaaaaagaaaaaagaaaagaaatacttcttcactccatcaaagtgttagctttcactgcagaatgagtccattctgggagcctgggggttgggaacccatgttgggaagaggagtgtctcaccatcatcctggtcacaggaccagtccaccacagcccacaggatactgggtcccactggcataaactgctaaactgggcctggtctctgctctcccagtatccttatttgctgtctctatgatagtgttcaaacagatgacctctctgctctctaaaatggagacttctccctccttgggtctatgagaacctttcaaaggttggctctgagagcactcagcattccttatcatccaggagctgtaaaacagtgattattagcaacatgaagagaagttaaaggcaaccagagttgtgggtgagtgaggttggggccacttaagtactagctgacacacatgtattcatactggttattgcaaaaaacctcaaagttctgcaaagacctcagggctcaaaagtgaatcgcagcgcgcttccttttcaccagccatgtagtgtctgtccatcctgcaaacggttgcatgcacagttttctgcaaatgttgcttttggtcgcttctcacaaggttattgtgtgccaggccctgcggggttgacgatgactgaatggggcctgctgtcaaggcgagcacactgctgagagaggcctgcattcccgtgagatgaagcagaagcagaatgcaccaagagctctaagtaccccagaagtgagagagaacccaggaagcaggggaggttgggaggaagaaaaggagactgccctgtgggcgcagacagtgttaggcactctgtgtggacaatgtgacatttaaattgagctttgaaagaaggcaggatttcaaaaggcaggggtagaggaacagtatgaaccagcaaggagcagggacatatggggctggtttggaagtcagtgaagcaatgaggtggctgaaatataggctgcctcctggtcatccacagcctcccaaatatgtatcctgtgggcctttcaatgtctaaggtgtatgagtccagttacacaatttagcaactgatagattgttttcaagatactaatagtaagtgctcgacattaagacaaagaaaaactgagtggacattgaattgtatttccatcttacttctgtagaattatggggttttggaagcagaagagactgcagcagtcttccagtccctggaagtgtgcagacacttgcatgccagtgtttcccaaacttgagcgtgtattaacatcaccagcagggcatctttgaacaattcggatggctgggcccagctgcagagtttctaattcagggactcagggcaggggtgggggtggtccaagaagttgtattcctaacaagttccctggtgctattgttgctgtaatgctccttgcgaactgttcagggtaatacctcttgcatcctctgcttgaatctgtctactgttctgcagctcactaccacccaaagtatccacacaatatcccttgtggaatacttccagtaaaattcttccttgtgctgctgtcagtcctgcctgcctttaactttcaatgaagtctgctgagggccccacatgggaaatgtctatggatggcaggcaagtctcaggcacatgaggcagactgcctggatttacgtcctgactccacttactacgtgaccttggataagtcattcaacctttctgtgttttcctcaactgtggaatggggataataattgcagttatatcacagaactgctgtttagagtaaatgagaaagtgtgtaaaacaattggcatggtgcttggcatataaaagtactcaggtgtgggctagtatcattacctagtgttctttttctttttcttttttcttttttttttttttttgagacagagtcccactctgttgctcaggctggagtgcagtggcacaatcttggctcactgcaacctctgtctcctgggttcaagtgattcttgtgcctcagcctcctgagcagctgggattgcagccaccgctcccacgcccagctaattttttgtattttttagtagagaaggggtttcaccatgttggtcaggctggtctcaaactcctgactttaggcgatccacctgcctcggcctcccaaagtgctgggattacaggcgtgagccaccgcgcctggccagcattacctagttttcctttctactcaggagtctatcaactctctgaagaaagttaatcattctaaagtttctcctttctgggctaaatatccccagctcctgcaattatttcttacaattattttagtgctttcacggttccaatattttgtttgtcctttctcctcttctctgaacagagtccagtttgtcagtctcccttgttagatacatggctcagacctgctacctgcctcggcttagtccaagtctcgtgtgttcactgcagccaaaggtcactttagctttgtagctatttctacatttcactggactgtgttagacttccaggccacgaaggtgccagaggctacacccgcatgtaaagagtagagctcattctcctgtcacatttccccttgttgcttagcatgtgtgagtttggggagtgtgggtgagggagagtaactctgaccttggcccagttcagggcctactgtgatggttggtgagcagccccagtggctgtgagggagcacatttgaggctccaggggctggtgcgaggcccagcttctcccctggagaagggtgaactgacacctagcacagccaacagttttctggaaggaaaccaagcctcagagccagaggcacatacagcaaagctgtgcaggcatctcagcccctgtcccagccactgtcactgctggcctttagcccagggtcgttggtaatagaataatgataaaatatggagagggagtcagggctgggtttttttggttttgctttttttttttttttttttgagacagagtctcgctttgtcacccaggctggagtgcagtggcacaatctcagctcactgcaacctctgcctcccgggttcaagcgattctcctgcctctgcctcctgagtagctgggacaacaggcgcgtgccaccatgcctggctaatttttgtatttttagcagagacggggttttgccatgttagccagtcttgtcttaaactcctgacctcaggtaatccacctgcctcggcctcccaaagtgctaggattacaggcacgagccaccacacctgacctcagggctgttttattgtggagacagaggtggcagcttcaggggtttgggtatcaagatgacagggcaggcctggaaaaaaatgtctctctcagcctctattctaatttccagtctgtagtgaatggctcaccaggtactctcaagttatgtcttttaaaacagaaggcatagaaaaatgtgcccaaattactttggtgtcctatagagcctgtcttgtccctctccggtcatagaggacaccaagttcctttgcggccaggcctcctcctaagggagaccaggcctgtggggctgctccgagagctgcctgcaagccacactatgtgaatcccagtgcagggctcctctgaaaggcacctgcgaagctgtctttggctgaagaagttggggaaactggtctcccacacttggcaatggccattctttctcaaccttccctcaggcacgaagagtcccaggtcttgatgcctcattcttccatcaaagatttaacatttaccctccctggtattttcaattgatccagaggaaatgaataggtagtacttagcaaagggtgcttagcaaaaaaatactctgctgagtggaattgcaggcacttctacagttgtctggaggcacagaggctgcactctaccctaaggcaaactggatggtgccatcctcatgctgacttgggctttagaggagaaaatgtactttcttcagtggataataaagacaatcattggtcaggtgtggtggctcatgcctgcaatcccagtactctgggaggttgaggtgggtggatcacttgaggtcaggagttcaaattcagcctggccaacatagtgaaaccctgtcgctactaaaaatacaaaaattagctaggcgtggtagagcacacttggaatcctggttgggaggctgaggcaggaggatcacttgaacccaggaggcagaggttgcagtgagctgagatcatgccactgcactccagcctgggtgacagaacgagactacatttccaaaaaaaaaaaaaaaagacaagcattgctttttccttggcaagaattctttctcttttttttttttttttttgaaacagagtttcgctctttcactctgttgcccaggctggagtgcagtggcgcaacctcggcttattgcaacctctgcctcctgggttcaagtgattctcctgcctcagcctcccaagtagctgggactacaggtgcccaccaccacgcccagcccattttttgtatttttagtagagacggggtttcaccatgttagccaggctggtctcgaactcctgacctcaagtgatccacctgcctcggcctcccacagtgcagggattacaggtgtgagccaccgcgcccagcatcctggcaagaattctaagcaacagagtaaacaggatgggcacaattagtttactttccaagctagaatgtcagggggcactggaaccattctggggaaggtaatactttgaggtggaatgtcttttttttttctgagacagagtctcgttctcttgcccaggctggagtgcaatggcatgatctcagcttattgcaacctccacctcccgggttcaagcaattcttctgcctcagcctcccaagtagctgggattacaggcacctgccaccacgcccggaagattttttttttttttttttttgtatctttagcagagacagcgttttgccattttggccaggttagtctcgatctcctgacctcaggtgatctacccaccttggcctcccaaagtgctgggattatagacatgagccaccgcgcctggcagggatgtcttttctttttttgagacagagtcttgctctgtcgcccaggctggaatgcagtggcgcaatctcagctcacagcaacctctgcctcccaggttcaagcgattcttctgcctcagcctccctagtagttgggattacaggcatgcaccatcatgcctggctaattttgtatttttagtagagacagggtttttccatgttggccaggctgatcttgaactcccgacctcaggtgatccgcccaccacggcctcccaaagtgctgggattacaggcgtgagccaccgtgcccggccgagggatgtcttttaaatcaagctacagacttgggccactaggctgttcatggttcctgattctttctcactgaccctttacctctgcatgggatggtccccagagggatgaggtcaggctgaggctgtagccttgatatacctgacactttccttgctcttctcctgttccccattctggacctttgggggcccttgagggtctggctttttaaggcagaatccaaactgcccaagaaccactgattgtttctgtatctctcagaaaggggcaaccaaatacccttttaaccaacactccaagagtgccaagaccagaccttggtacatgcaggaacccagaacatggcatgttcttgttctgtgcctttttcttatggtggaaaaggattgtgtattctgacccctcatctgggaaaaggaagaacgagtgaattactactcggatatccttggcagccagcttgcaagtgttaataattcatagctctccaaggatcctcaggcctcccctgtcctgacacttggttactgaaaagaactagaaagttccagtcagcagtcatgtggggccacagtgtgtgctgcagccaagtggcattgccccgtctccagcctgtcacccacactgctatagaacatttatctcagtcttgcatctggactctggcctaataaattcctccaaaggtatgcagagtacacagtcgcctcttaaggtgggatgaggccagagtaacagagagagtggaaagggagactgtcataaatattgactctagacagggagagaaaaccactggagcttaaaattccaggctcagagtaagttaatgagctactaaaaagacaaggtagtaggacatgcatactaggacaatcagacctgaagttggaggaaaaatgtgaggatacccactgagccaggcagactggtatagtagaaagggcattggccacaaaagcaaaagcacagagtttttagccatgtttctgcctgagggggctttggctaagtcacttcacctctctgagtctttgttttataataaagaaaaattgagatgatacaattcaataacaacaaaaacaacttgattttaaaaatgggcaagcaaattgaatagacatttatctaaagaagatacaaatggccagtaagcacgtgaaaagatgcccaacatcatgaatcattaaggaaatgcaaatcaaaaccacaatgagatgtcacctcaaacccattaaaatggccatcaattaaaaaacaaacaaacaaaaaacagaaaagaacaagtgttcatgggaatgtggtgaaattggaacctttctatgttgctggtgagaaagcaaaatggtgcagccaccgtggaaaacagtatggtgtatggtggttccttaaaaaattaaatgtatgatccagcaattccttttctgggcaaatacccaaaagatttgaaaacagggacttgaacaaatatttgtacatccattttcatggcagcattattgactgcagcctaaaggtggtagcaatccattccttgatggacgaataaataaaatgtgatgtatgtacacagtggaatattattcacccttcaaaaggaaggaaattctgacatgtgctacaacatgaatgaactttgaagacatttgctaagtgaaataagccagtcacaaaaggacaaatagcatatgattccacacatagaaggtgcttagagtagtcaaatttgtagaaacaaagtagaaaggtagttgccaggggctggggaggaaggaatagaaaatcgtgtttaacggctacacagtttcactttgggaagatgaaaaagttctggagatggatggtggtgatggttgcccaatagtgtgaaagtacttaatgccactgaattgtataatcaaaatgattaaaatgataatttttttgttatgaatattttaccacaatttaattttttttttttttgagacagggtctcgctctgtagcccaggctggcgtgcagtggcatgatcgtgactcactgcagccttgacctcacaggctcaatcaatcctcctgcctcagtctcctgagtagctgggactacaggtgcacaccaccacacccagctaatttttgtattttctgtagagatggggtttcaccatgttgcccaggctggtctcaaactcctggactcaagcattcctcccgcctcaacctcccaaagtgctgagattataggcatgagctaccgtgcccagccaatttttaaaaattggagagatcaaagcttcctgaccagattgctcaggtgtgccacatgtaggttattggcatgccaagatattgatccctttcatttttgaatagatcatgcagagctgagcacagctgaaatcctcaggcaggtcactggaagagcttcttcttactccagtatgctatacacatattgtaatgtttaaaatttcaatataatttaattattatttatacagaataagtgcatgaaacaaaaatgcatagctcggtaattaatcttaaacacctgtgtaaccttcacttagctcaagaactagaatattgccagcataccagaagttagggtcgtgtgttaccacctaagcaggaatcccccaaagttctgccctatatttggacatcatgtaaatggaatcctagtatgaaaatgaatgaactacagctactcacagcaacgtgagtgaacctcacaaacatcatattgaatgaaataaaccagagacaaaaggaatacaccaggcctgtaatcccagtactttgggaggccaaggcgggaggatcacttgaggtcaggagttcgagaccagcctggccaacatggtgaaaccctgtctctactgaaaatacaaaaaattagccaggcatggtggcgggcacttgtaatcccagccactcgggaggctgaggcaggagaatcacttgaactcaggaagcggatgttgcagtgagctgagattgcaccactgcatttcagcctgggctgtaacagagtgagactccatctcaaacaacaacaacaacaacagcaatttttaaaaatttctaaaaaccatacaataacaactatttatacatgatgaaggtgagacccagagagttaaaaatgaattactctggatcaaacacctgggaaatgggaaatggtggcgtcagaattgaactcaggtgttctttctttcttttttgttttgttgttttttttttggagacagggtctcgctctgtcattgaggctggagtgcagtggcatgatcacggctcactgcaacctctgcctctcaatcaagtgatcctcccacctcagcctccagagtagctgggactacaggcatgcaccaccatgcctggctttttgtaccttttgtagagacaaggttttgccatgtggcccaggctggtttcgaactcttgagctcaggcaatctgcccgctttggcctcacaaattgctgggattgcgatgaactcaggtgttctgatcctaaatccagattttcccattctaccttctgctttgaaagatatagaggaggccaggagggcttagccccgaggtggaggaagataagctggtatgaggaagctgctcaatgtcattttaaaccgtttatccatgggctcaggtcatgtctttgttgggggccaagccaaggcccagcaaagacaaatggctcttccagtgtgggtggaagaggggtgaggtcacccagtcctcagcctgtggtttgctttgcctcagtgccgggagcaatctcttgccctgatttgcattgtgggctgaggattcaggtcagtgagaaggccagtgatagaattgtctgtgtgggtgctgctgatagggatcagctgctgatcatggctagggctagcggctgagcacacgggcaccagcctactgctcgggcagcaaggcagcaggatggaggggtttgtaaaaatgccttccacctaccctgctgggcttgcccgagaggctctgagtgtgtgaaggggaagacaattatcgctaggctggagaatagaaagagcaccatcaggtgagaaagagaagaaaaaaagagaggggagagagtggataagaagaaggaagcctgggacacaagaacaagggctttgcttgctctagggctttgcttgctaaactcctagggagcacacaagtgagaatccagggcagagggaagcaggatgggtgccctgagtgcttggccccatttcctggggcttactggcctcgtgggtgggagttttataggctactgctccttggggaggcctcagtgattgaggatactcctgtatgagcctcggccctgaccccaggatgggggactggaggatcctaacaggattgggggttggttgggtgtaaccaaggtatctgccaaagggagagtaccaaggaaagcggaggcacctcctccctggctgtccttcaccccctctcccctccttgttctctgggagtggctggcgagcagcggcctccccgcagggccaggcaggtgggccagagcttttggtttgctgaggtttgtcagattttccagctcagggcccagccagctggcaggaagcaggacagaggtcacttgaattcagaccacatgtccctgttaaatacattagcttttaaatcaatctttgttcaaagtccagtgagttgcaagcctaatgctcacctgcagagacagaattcctgagtgaacgaacagagcagctcctcttccatctccaggtaagaactgctcgtgtcctccttgagggtgctggccaccggggcctgaactaccttctttcttttccttttccctttttctttttccaagccagtagctggctgtctagggcagagaagagtcccatggggaggcagccaggcccctttggcggtggttgggggtgagagatgatccacgctctgagattctttctgctggagatgcccctcacctttgtaggctagggtctgcttcacaaagaaattggtaaaccgacctcagaaaaagccttcccggggttgtgtgggggtttgatgtgcagccaaagggagtgagacaactgacttcacaggtaaccaggcggatatgcccgggaccttcctactgatacaggggccttgggtagcagagaagactcttctggaagcagcctttaaaggatgcagcctaacttagcttgcccactagataataaaagcaggcatctttcctctctgtatcacactgcagcactaagacatgagaaaaaccagtggatttccaggctggctgaattttaaaacatacattccccaggctctcacctttggcatttctaagtctccaggccttgtgtgaattgaaagatctttatttgaaaactctcccagaatcattctgatcagtgcaggtaggtttgggaaccactagtagtttatttcttaagcagaagactcatgagacttaagtatgacacttacctaagggttcactcgctatgaagactcctggtctgggttgggtccagctatgaagatttgggcgttggctctgagaaacacattcttctttatttactaaaatctctgcaatgtgtcaccagggcagctttcagtcttgtatctagaaggcaagagggggtagcagggactgcctcaggccatgattgtccagtcatctgaagtctgcagcaaattactcagggtctttgaatttctgtgttatgatagtaacttgtgcttatctttgacttttgtatgttctctgcaccatagggtgtgaagttgctggtaatgatgtcttatattcatagaccactggctaggcagctacttctcccccaggggaaagaacataggactggaatacaaatcatcagagttttgattcagttgctagtgacaggccattagacaaactacttagccaactggagcctcaatttcattattgatcaagtgaaggtctgtcatcttttccccaagagtgtactgaaaataaaattataagtacaaatgtgtggtcctgcatggtggctcatgcctgtaatcccagcactttgggatgcccaagcgggaggatcacttgaggccaggagttcgagaccagcctgggcaatgaagtgagacccccgtctctacaaaaaataataataaattaatcctgcatggtggcatgtgtctgtggtgtcagctacttgggaggctgaaatggaagggttgcttgagcccagggggtcgaggctacagtgagccgtgattgcatcactgcactccagcctgggtgacagactgagatcctgtctaaaaaacaaaaaaccatgaatatgttaaaaacacgatgtaagatgcctagatttcaaatgtgtatatcgaaagtctctgtagaatagtaagaagaaacaaattgcagtcacttgggaaaccttgtcctagtcttttaatctcattgagcctctgtttgctcacttacaaataagaagttgagaccagatcatcattaatgtctttttcagttggccaagtataaggtagatcctggagccttgaagggtagctccttgtcattggggtatgaattaaaatgtcacctcccaggaaggactttctaaatcagcctcccacctccatgccaccagtatctctatcattcacagcgtgtaccatcagaaatcatctcatttgggctgggtgcagtggctcacatctgtaatcccagcactttgggaggctgaggcaggtggatcacctgaggtcaggagttcaagaccagcttggccaacatggtgaaaccccatctctactaaaaatacaaaaattagccgggcgtggtactgcctgtctgtagtattagctacttgggaggctgaggcaggagaattgcttgaacctgggaggtggaggttgcagtgagccaagattgtgccattgcaccctagcctgggtgacaaagtgagactccatctcgagaaaaaaaaaatcatctcttttacttgtcacctttgccagatgttaagcttcaagactgcagggatcttgtcatttgtgttacttgctgtattaccagccccttgagcactacctggcatagaacatatttgcataaatggaattagtgtggcagggaaggagctagaagaatagatgcagatggcgatggctttgatgaagtgttcctcaggaaaggaggttgaaggactccaatcctctctcagggcatctgaagtccagggtctaatcatatgggaatgggtttctctggtcacttcttagtgaaatgattcttgcattcgttgcatagggatgcaatgagagtggcaagctggagctagacgtgttttcctcaagatctcagcaacttctttctttggtccttcatgagggactgcccagatttccttaatctctttgcctgatgggtatcatggctaagtgattaagaaaatgagcactgggattggaaacctgcactctagatcaggctctctaagcttctatttccttgtcagtcaaatgggcatattagaacctagttccggaagttatgagggttaaatgaatgcacatagtgtctagcacatcttaagtgctattgagataatcttcagacagctttgctattacatgacccccggaaatgaaggaacccagggaatggcaggagttttggaaagtagaaaagatagccctagcccacttagtggcaactagagaaggtttgcttttggtctgaggtggtcactggtttctgaggtgccaagcctggttggaggcacagatagtcagcattcataaagctgcgtagaaccatggggtcccaatggggacatgaaactaaatgatccagaaaagcccgtggactttccaccagttgtattgaatacatacctgatggtgtgagaatacagaaaggggctgtggtgcctgctcttaagaaagcttatcttggctgggcatgatggccacgcctgtaatcccagcactttgggaggctgaggagggtggatcacttgaggtcaggagtttgagaccagcctggccaacatagtgaaaccccatctctactaaaaatacaaaaagtagccgggtgtggtggcgggtgccttcaatcccagcttctcaggaggctgaggcagaagaattgcttgaatccaagtggcagaggttgcagtgagccgagatcgcaccactgcactctagcctggaccacaagagcaagattccatccctcctggccaaaaaaaaaaagcttatcttgttggggacacacgacatggatcctgaagctcctctatagtctactggactgagtccagtgctcacagtctaacctacttctttttttcaacatataactgtgctctgatctttctgaaccattcaccattctgggaatgcatctcctgctgttccttctgcctgggatgacttcctcttcctagtctgactacttgtatttccagaatacattctacacctcaggcctgggaggcagggtagatggtggaaggaatccagactcaactgggtttgaatccagactctgcttatccaaatagtcaggggaaaccaagttaacttttcagagtctcttttctttttccttgtaaaatggcccatcaggattgaatcagaacccataaaaagtacctaggctggttcctaatcctagtagggagctcaataaatatatataacaataagaaagcttttgtatttaaatattccagcacccacaacgttgttcagcagttaaacttcataactctccccactggactccaggctctttcagggcaggacggtagctattctgggttgagccctgatacctgcctcgcagtaggtattacatagaacttgttaagtacatgagcgataactgaaattcagaagatgaaatgataccttcagactgtggtggtcatggaaggattcgtatataatctaaaatttgaactgagccttgaaaatggtaggtcttaaattcgttcacttggaacaaatgtttacttagcacgtactatgagtaagtgctcatggggcatgagcaaagggcaggctcgtgtgggtgaccatgcatagaccaattggggcttgctgaggagctgggggcctgaggtagggctggattatgctgagcctcagtgcctgagcaagaagcttgaacttctttttttttgagacggagtcttgctctgttgcccaggctggggtgcagtggcacgatcttggctcactgcaagctccgcctcttgggttcacaccattcccctacctcagcctcccgagtagcttggactacaggcgtccgccaccacacccagctaattttttgtatttttagtagagatggggtttcactgtgttagccaggatggtctcgatctcctgacctcgtgatccgcctgccttggcctcccaaagtgctgggattacaggcgtgagccactgcacccggccgagcttctttttcttgaattattattattattatttttgagatggtagtataataaaaccagggttagaaagtttgtctcgaggcaagactcttgtagtagtttaaacataccaaaaaaaaagtgggggggtagaaatgcaagttcaaaaagtcacaaaatgtcgatttggggaaagcacttgtctcagctggcactcaaggcggttgagctgtctatcagcagcatgagggtgtcctctctctgtgggtgcctctgtttccacacaatattggctctatccctctcccaactcatagaactcttagataagcaatcaaactgtgaaaggccttgaactccagcccagagtcttgccatataggacaaagtattgtttatggtggctggaggtagggaaggtacttagtatcagcaggccaaatgaactttgggataagtagattccattcttgatcataaatgagaaataaaaactactcagtgggtctgggatcactcttctccagataattctcaatggaatggatttcattgatttctcatatttgaaatttatccctggctaagaccaaacagtaactatcacaatgggaaagtacactaggcaaatacatattttagaatcttgcttctccttctatttttgatattaattatttaaagtaaatatacttgagtatttgaatttccatatgctttgcttttcagaggagaaatccaggcagccttaaatatgatctgcataaaaatataggatctgttctaggtaaaatatatttgaagaagggtgaaattgagttgtctttatctcttccttgctagagacatctgtcagtagcagctcagatacagcaggatttttttgcttatgctgttggaaggaacagcatgtgccaaggctctgtggcaggctctgaaggaggccagccatggctggtgtgaggcatgaagccttggagtcagggctgatgcctgtagggaattctcagcctgtctatagttgctggcttaatgttgcacagtctccaccaactgtattttcctaacaaaagtctagtgggtttgttttcttctttcttgttacacagatgcacacaagtgctgcaagaacagcattcctcaaagtgcacactgtggtcaagcgtcctgagaatgtggcttttttcttgctaaagttcagagtgttttataggcaagcatggagttcagtggaaagcaagtaatgtctaggtttaatgttgccggagagaccctgccctttcttttccttatgcctcaacaaaacagaagtaacttactctatggtttcatactagattatacaatcagatacccttccacagtcagagtaactagggttaaacattcctcaccagcagtcctgctaagtgtttgttttttttttgagatggagtctcgctctgttgcccaggttggagtgcagtggtactatcttggctcactgcaacctccacctcctgggttcaagcaattctcctgtctcagcctcccgagtagctgggactacaggcatgtgccaccacacccagctgatttttgtatttttagtagagacggggtttcaccatattggtcaggctggtctcaaactgctgacctcaggtgatcctcctgtctcagcctcccaaactgctgggattacaggcatgagcccccgcgcccagcccctgctaagtttttagtgtttagtgttttcatggattgagtgttggttatgtaagtgccttgtggggagaggctctgttgtcttcgtggtgtgatactgacggcataattgattcctagttactattagataaggtgatggtgggttcaggtgtagatgactatatttatggaataatcctgccacttctaagtcccagaccttggaagatgagcagagatgacagtacctgggctgtttctttcctgatggtatttcattgcatctggccatcgctggtgacagcccccttctgtctttctccctccaagcagaatgctgtttatcccatgccctctctctgatcttttggcatttcagtgatgctgtctggtgagtgagcctattcactagctactccttggctatgaaggtccctctctgggccaggtatctatagctaaggtaatgcttcactcactccatcttctccactgctgtctgttccttgggtccctatgttcacttctgttagagcttatccactccaggcggtggaactctctggccagcttagtcttgaaattctgttaaagctccctggactcttttacctccttgatacacagcatttggttctattttgtaattccctggcttttagacttacaggatacttttgagtccagagtttattatttgagctttctttcatggggaacaaaatctccagccctgacttttcagcagctaaaattagcttcgcagaagtgatctggactgagtagatagagaatcccttgcctgatcattgaggtgcctgcccattcttagtctgtaatttcttcctgtcttctgcaaaaagaaaatcaggaaaaatttcaaatattctcacagaaaatgggattcccattgcatcaggcgtttcatcagaggacaggaaagagtaacttggatggagtggacttctatgctccagaaactgtgctgagaggccttgcatgctctactgtgagccatcttcacggcatccacatgtgcttcctattctaggggtattctatcttcagctcaaaattaaggaactcacccatgttcttacagttaacaagcggtgaagccaggattaaaaactaggtttggctctaaaacccttgctctttctactctaccttactcagaatcgatcctgggggaagatggaaacaaaaatacagattcccttttgtatacacatctggctcctttagaattgcatcatggggaactattctgctctaaagatcttttcagataacttttcctgtgtcaacccactaacttttgaaactgcttccacagtcccttcttctttcttcccaactcatgctgctaagctagtccctgaaacatttcatcttcccaatcccaaactcctagctcctcttatctgccaattcatgttggccccacagtctgacattccagctctgtgccccttgtaaatctagaaatcctcacatcctactcttatgggcttgttagtttgagatggagtcttgctgtgtcactgaggctggagtgagtggtacaatcttggctcactgcaacctccacctcccgggttcaagcgattcctgtgcctcagcctcctgagtagctgggattacaggcacgcacaaccacgcccagctaatttttaaatttattttatttttttttaaatttgagatggagtttcactcgttgcccaggctggagtgtaatggcgtgatctcagctcactgcaacctttgcctcctgggttcaagtgattctcctgcctcagactcctgagtagctgggattacagatgcccaccaccaagcctggctaatttttgtatttttagtagagacagggtttcgccaagttggccacgctggtctcaaactcctgacctcaggtgatccgcctgcctcggcctccaaaagtgctgggattacaggcatgaaccactgtacctggcctttattttttattttttgaggcagactctcgttctgtcgcccaggctggagtgcagtggtgcaatcttggcttactgcagcctccgcctcccgcctcccgggttcaagcaattctcctgtctcagcctccggagtatatggggttataggtgcctgccaccacacctggctaatgttttttgtgtttttaggagagatgaggtttcaccatgttggccaagctggtctcgaactcctgacctcaagtaattcacccgtctcggcctcccaaagtgctgggattataggtgtgagccactgcgcctggcctacccttatgttttaaaaatatgttagccccaacttagggtaaaagttaccactttccttttctattcttgatgtatattactgtaagaaaaatccatgggaacccatgctgctgcaagtttattatatatatatattttaacctaagttgtttcttagacattttaattcaattcattgactctttgtagtgagctaatgctgtggccattagttcactgtcttagttcaccgccagctcgggggctccattctcttttggtttacatagaatttcttttaagtttgaaatagctgtcagtttttttaaatggggacattttatgtaaatctagatttccagagtctcttgaaaattgaaaggtggcatgctggcctcctcttcctcaggcagttgtcttctcatgaaaagcagcagcttttcctccgtcccctctcggccaccttcgctgatttacctgtttgaccctagagattatttttctgtggtacttttgctccatattctccaagttcctgatttttgtcagctacttcgtaggagagattgaggctgaggtaagtgaccttgttttcttctttatcatatttttttctacttctcttctgcccctggagaagaggtatttcctctcaccaaggctaaccccagtttccatgttctccatatcatctcttgatacagaaacatgctgatcgtttccttaatgttaaaaataaaaacatccaggctgggtgcagtggctcatgcctgtaatcccagcactttgggaggctgaggcgggcggaccacaaggtcaggagtttgagaccagcctgaccaacatggtgaaatcctgtctctactaaaaaaaaaaaaaaaaaaaaaaaaaaaaaaaaaaaaattagctgggcatggtggcgggtgcctgaaatcccaactactcaggaggctgagcaggagacttgcttgaatctgggaggcagaggttgcagtgagctgagatcgcaccactgcactccagcctgggtgacagagcgagactgtctcaaaaaataaaatatcaatattcgttgcttctgttacttggtatccacttgcttcttagtgttttatcaggcccagacttccattttctgaatgtcagtggcattttctgttttcattctctctacctcttagcattatttggcattgttaactatcccatcttaaaattcttcttttagttttgatgacactaaaattttggcattttgttttctgattattcctttttgcttcctctttcttttctctctttctctttctctctttcccttccttccttccttccctcctttctgtctcactcactctgttgcccagactagagtgcagtggtgtgatctcggctcaccgcaaccactgcctcccgggttcaagcgattctcctgcctcagcctcccaagtacctgggcttacaggcacgtgcctccatgcccggctaattcttgtatttttagaagagatggggcttcaccagttggccaggctggtcttgaactcctaacctcaaatgatctacccgcctcggcctcccaaagtactggaattacaggtgtgagccaccgcatccagcctcctttttgtttcattttcctatcacttagatacaggtattgcaaaggctttatccttggctcccctctttttgtaatctcattgatgggcttcatgtagtgctgctgtgcagatggtcccaaacctcgactctagtccagcatctcctaagctctaggtgatgttccgtcaagtcctctaattgaaacctacctcaaactgacattgccatctcattcctcatgactacaccatcttttaatggcatcacatttctgccagtcatcaaagcatgaattagtttcctttgacacattccctttcaaacacacagcctgggtgggcagcattcctcagaaggtgctagagctgctgtaatagaagaccacggaaggtgtggcttaaataacatttattttctcatgattctagaggctggaagtccaaggtgtcaacaggtttgggtcctcggaggcccctctcctgtcttctccctgtgtcctcacatggctttattctctgtgcaagtgcctctctgatgtctcttcctcttttcttaagggcatcagtcctgttgaattagggtcccacccttatgacctcatttaacctttgttacttctttaaagttcctgtctccaagtatagtcacattggggattagggcttcaatgtatgaattggaagttgggggcaaaaatcagtctataatagaaggggagttcggggcttgaagtaggaaagctatccaggctggttagtagaaaatactgagccagggttatcagttcagggaaagtatacagctggcccttgcggagaagcaggcagataagtgagtggctacagagctacagtgtccttgcaacccctggactaagaggagcccaaagcacagttgtgttcgaattgagctgtggcctcagaagacttaactgtgcatttgccactctgcgacaggggatctttcctcatgacagtgaaaccagaacaaaataactacatgccaggggagtaagccatcattaggaagagtggcaggagcctgtgggccctgacactgggtgctgcacacctgttgttcctcctggacacttgtcatggtgagtgtaaagaagtgttttggacatctgtgttgtcacagctgttctgtctgagataatctctgcatggagaaatctgagggaacaaggctgaagacttactacaatgtcacttagtcctctctgtagttcctccacctctgtcaccttcattctattctgatggctgctatgtgggtcaggcaggccctttatcacgtgtgagtaggattttgacaacagcctcttacctggcctctctgcagtgtgtctttgcttgaatccagcctacctgcccttcttggaacccaactctgatcctgttattcctctgcttaaaagccttgagtggtgcccctttccaccaagctaaggccagatcccttgggctgatattaaaggcctttatagtctaatttgtcacccatgatttcccttctgttggctgtccttcaaccacattgggttttagctcttccttgacgacacccaagctttccctctttctttctctctctcttgctctcctctttctctctctctctctctcctctttctctctttcgacagtgtctcactctgtcacccgggctggagttcagtgcactgtctcggctcactgcaacctccgcttcctgggttgaagtgattctcctgcctcagcctcctcaatagctgggactacaggtgcccaccaccacgcctggctaatttttgtattttttggtagaggcagggtttcgccatgttggccaggctggtcttgagctcctgacctcaagtgatctgcccacctctgcctctgcctcccaaagtgttgggattacaggtgtgagccaccgcacctggcaaactttcccactttcataacatggtgtccacactgattggtgtctaaaatggtctcgtccttcttctgcacttgttgaaatgtcatccatatgttgttaaggctcaaatcaagtcctgcctaatttttgaaggtttccttaatttgtttcatattgtaggtcttacctcacttatactctgctcacaatgatatttttctttctttctttccttttttttttttttttttttttttgagacagagtcttgctctgtccccaggctggagtgtactggcgcgatctcagcacactgtaacctccacctcccgggttcaagcgattctcctgcctcaacctcctgagtagctgggactacaggcatgcaccaccacacctggctaatttttgtatttttagtagagacagggtttcaccatgttggccaggatggtctagatctcttgacctcatgatccgccctcctcggcctcccaaagtgctgggattacaggtgtgagccactgcacccggcaagttatttttgttctaaaactttttcttaactttattcaactataaaggctcttgagaataggggtggtgtataactttatcctttcaaccacttgacagtgttttgcatataagtgaggggcagatgcctgtggcatgaacaaatgaaatcaggtttgggtagtatgtcttcttgatgctgaaatggaaaatagaaggaactatgttcatgatcccaaacagatttcacctgccccagcatgctaactgaagaaactaattgtttgggaaagggaagagattggtagggagcaaagaactgtggagtaaatctggcaaccatcactcatcctccagggttcacgggatgactggtagggcctcagtcctgaatggattctgcccataggtttggaggaggatgaggaatggcctcagcttttaaggtgtttaggtttgggaggtggggagcaatcccctagacttaattaagagcataaagagtccatgagaacagtgaaaggttgttttatctgcttggttctatgctcccccgactcagaactagaacttggggagggaggcacaaggaacagattgcaggttgtgacacactcctatcctgctggctggggcactgattgtgggtacacaggatcccgaggactgcacggtgtgaccaagggcttctcctaatcaggctgccaccttggcctgtcaagttggataaaggtgagcccagggtggctgtgattagttcattcaatctcaacattcctctgtgacccatgagggagggagttatcctgaggctgaggggagacaggaggagtcgaggcagcctagggtgattttttttttttttggtggagtctcgctctgtcacccaggctggagttcagtggcctgatctcagctcactgcaagctccgccttccgggttcacgccattctcctgcctcagcctcccgagtagctgggaccacaggcgcccgccaccacgcccggctaattttttgtatttttagtagagacggggtttcacggtgttagccaggatggtatcgatctcctgaccttgtgatctgcctgcctcggcctcggcctcccaaagtgctgagattacaggcgtgagccaccgcgcccggcacctagggtgatttttaagctctagttcctttgatctggtttaggtctttaggtctgctttagacctgaggtggggcctaagcatcgatttttctaaatctctacaggtgattctgaggggcagctaggattgagaatcaaacttgtaaggtgattgcgagcattaaatgagataatgtgccatagagagttttcaaatgacatgatttattattgctagcatcacctgacacggtctacagagttacacaatttcaactaaattcttctgctcactcagatgagacagctggagcctttgggcatgggtggacaactaggactgaggagatgaaggaagatcttgtcattctgctgacttcactcctcaaggagttgccatttattttccttcttcagaagaagaatttacttacccctggcccatgttttgtctggtctctagcagcttcagaattccttttcttttctttttcttgagacagagtcttgctctgtcgccaggctggagtgcagtgacgcaatcttggcttactgcaagctccacctcccgggttcaagcgattctcctgcctcacgccgccaccacacccagctaatttttttttttttgaattttaggagacaaggtttcaccatgttggccaggatggttttgatctcctgacctcgttatccgcttgccttggcctcccaaagtgctggaattacaggcgtgagccactgcgcccagtccagaattctttttctttctttcttcttcttcttttttttttttttgagacggaatctcactgttgtcgagctggagtgcactggcacgattttggctcactgcaacctctgccccccaggtccaagcgattccccttccccagcctcccgagtagttgggattacaggtgtgcaccaccatacttggctaatttttgtatttttagtagagacggggtttcaccatgtttgccaggctggtctctaactcctgacctcaggtgatccacccaccttggcatcccaaagtgctgggattacaggcgtgagccaccatgccaggcccagaattccttttcaaaataacacctggaagctcataggagttacacaaagagcactcaggaacagctcccagctcagacttccagctttctgtgcagaggagttggtgagggtggtgctgaggatctcatatatcaatcctgttgatggccgtctggggcctgagagtccttggcctgccttgggctgggaagaagtcccctaggtcccaccagctatttctttcctatggaaaatagaccagtggctttagttctttctactttgccagatccagaggtcataccaccctccttttcattaccaagccttcctaacttctaaagggtatttaatgtttcttcttgaccacggccacattattctctttcctggcagcaataatctaatcattttggaaaaaagcaaaatttaatggtataattagctttttcatcaataaaattggtgaaaaaaaaaatctcattggctctcacccccgagcggttcctgtctgccagccaacactttgttctctttcccacagataaacaactttgttgtcaactattgatttttcccccccgagctcaggaatggttatagctttctttcatctccagtttttttttctttttttgaaacagggtctcattctgttgcccaggctggagtgcagtggtgcgatctcggctcacagcaacctctctgcctccaggttcaagccatcctcccaactaagcctcccgagtagctgggactaaagatgtgtaccaccatgtattttggctgtttgaactggggaacaaagcctgctggatttaatggactccaacttcaaatgattgctgctaatgatattctagaaatccataggccttcatttcttctgtgtctatccaccagaggggtctgatctctagattttttcaggaggcagaagatgaggtggggttaaagaagtaggaaagagtatccttaaatacaaagatccttcctaattaggccctgtgttccagagtcccaggcatccttgtcatggagcaatgacagagtcttgcgaaagagacataccccagctctgaattaggggacagagtaacaccaggatgtggactagacagaacaaggcctggaggtggaccagagcccagctcccttggctcctagatgaatcatctttctgcaagatggcaaaggaaacaaatagttttaggttcccatgtaagaccaggcttttgaggtttaggtctgctttccccattggtgcagctgggggcgttaaatatttaatcagtttggcctgggtacatgcagatcgatggccatagcattaatccattaatggctgtgtggtggggagtacacagtggcagaaggcagttgggggcttgcagcagtagctgtttccccaccagtatggtagcatttcactattggtataaagtggctctaattttctggcttcaaccagacaaaaaagaaactgaccttgaatgcttgagccttcaaagccatagatgcagatctgagcgattaccatctggctgtttgaaaacttcaaacaaaaaagtcaacttgagattctgccaagaaacagtgatttgtgtttctttgtatgtcaggctcacaggtctccagtgagacataggaaaacctttgcctcttcccctctctccaaacacagggctggttctcctagtgaggaggtttcactttctatccttggcctacaaacaaagagattaagagtttgtggttgacactgcagggcgtgagattgttgagtcttgggtgtgagtgccttagaaatgagcattcatatgctgatcacaaacagcctcatctcttgatgaaaacatagtatctgttggccttattctgattataaggacatattttaaattttgtaggatttgaatgaggttctccaataattactcccaactttaagagggctttgcatgttttgtttgacattgttttattttcttcacagcaaatatcattatctgaaatgatcctattcatttatgtaattactgtctgatcctcccagtaaagtacattgagacctcgtctttcttttctgattttttttcttttggggtcttttggccctatgaaatggaaaggtgtagggatctacaggtgagcttggacatagatgtgaactcaagctgaaactgaactgatgctcgcaggttgggatcagcagaaagaggagtgaaaggtgagggagctggaatgggccacaaacaggtgcctggatgtgactcaactctggtgatgccatattttctcctttcatcccagagtggtgttttcctggcagctggtcatggcttttgataaggcagagctgcctagctctcccaaggtgctggtgttgaccactggtgagtggctttgctgttttcttgcctcaatgctcgatggggagtctatttgtttgcttctttcttcgctacttagtcactcgtgccactggtggcgtggggcttcagactttgcggagactgcaggagaggcctggtattgggcagctgggggctctctgtctgatttgtactgtacgtctctgtgggcatgaaggtcagggatggctatcttcaatcaccatgccatggcttctagggtgcctggagcactttgtggcctattcttcaccctcccccatatcctgtgtggtcatccgttcttgtccctccaggagggaagggataggtggtttattctgatttgtaggtagggaactgtgatgagaggaacttgagggcttgccttgcaggtggtgtgaagagcagactccagtgctctgttgtgagccttctgccttctgtatcagcctcttgctgttctggcccctgttcttattctcctataaaagaaaaagctttcagccagcaggtgtcggggcactggcagaagtcttacccttaataataactgtgtgccggagccctagctgtcggttttacacttgtcctgtcttcctcctatggctcaggaccttgcccctgcaatggggcaacaggaggggcaggatgaatggaaatagaagctgcttcaggccaggcatgggggctcattctgtaattccagcactttgggagcctgaagcatgaagatcacttgagcccaggagtttgagaccagcctgggcaacaaagcaagacactgtctctaaaaaaattagttagcagggcatagtgatatgtgcctgtagctccagctattcaggaggctgaggtgggaggatcgcctaagcccaggaattcgaggctgcagtgagctgcgattgcgccactgcactgcagcctgggtgacaaagcgtctgggagggagagccccaacctagccactggaatcccttttctatcgagcatctcttttctgctgtggctagagacttcaggggccagaacagccttttctagtgcatctccaacatattggaccagctctaaggcctggtgtcctttttttttgaggcagagtctcactctattgcccaggctggagtgcagcagtgtgatctcggctcactgcaatctccacctcccaggttaaagcaattatcctgcctcagcctcccgaatagctgggacaacaggtggctgccaccacgcctggctaatttttgtaattttagtagagctggggtttcaccatattggccaggctggtctcaaactcctgaccttgtgatctgcccgcctcggcctcccaaagtgctgggaatacaggggtgagccactgtgcctgccttttttaatggtttaagctcttccttgtcctgtcctacctcaccaagcttctactaatccttcagttcttggaagtgtcattccttcaggaaatgttctttgttcttcccatcccgctccctattcccaagaccctttgttattttcccccttatcactgcattcttccccagcatgacactcaccacgtgtggttataggaatgtaataatgttccccaatagaagaggcaaggtatgggtccatcttgtctacagatttaacctcgattccttgaacttgaaaagctcttcaaatgtttgaatgagagtgggcttgtcataaattttttgggtcatgtatttggacttaatttctttaggtcagaggacaaagaggagtttggttggagatactgaaatggaagcatctgtgtccagtactcagtaaaaaatacgtgggtctgaaactctagtaaaaaggttgtccttggggaaacagatttggaaatcattagcaagttctggaaggtgtcctcctgtgcccccagcattactacccaagcagtctagatttggtgattggaagaacagaattataggagatggaggatggggttctcactccaattagattctcttttccatggttttattaatttatttttttcatcacagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttagg

SEQ ID NO: 135 - DNA, 133474 bp, Homo sapiens
tcacataattactcatttgtttgattcaacatctcatactaaactttcttctaataacaatattaatattagaactataatatgatgactaaaatgattttaaaaactaacttgcagatgctctccttattctctccccacttttttacagttctaccttatactacattgtcagagttcataaccattacatacaatactatttttctaataactttcatttggtcttaattctacaagtaaatatatatcaaatgcttaccaccagtcataatgccagtgtctctaaagttattttggtcatttttaaagacattctcctgtagattcttacaaagagtcttatgggaatagtattcacagagttcttccatgttcatgagagtttatctgtgacctttgtatataaaagtcaatttgattgaacataatccttggatcacattttttcttatttttaaaatgtgttattatattttctcctagcccaaaatgttgttgtcaataagtctgatgatatttttctctcttattagtgatttgtttttttgttttttcctgaatgcccaaaggatattttccactaaagagaatgagttcttaaaaatccattagttcaaatagaccgtatgtttgcattcatcattttgagtgcatcttttctggtaggaaatgtgccctttaaaaacaaaatttcgaattttttttatttcaggaggtgtttctagcatagtagttttgaatatttgttctgttcctttacttcagttttcttctttagggactccagttacatgtatacttgtatcttgtatcttctttgcctatcttttatatttatcactttctctctaattattttaatgttactttttagtttattttttattttagaattttccttcgttttatcttatttttctttaaaggcattatccattatgtatatccacttttaacattttttttttactgattatttctgaaattgatatttcctttatttcttattctcttctgagccccattaccttatttctgagtttttgtactttccattaattgttctttcatatcttgtattattttcctaattattttagctcagtttgaaattgtagtttatagttttcacccataagcatgtctttatgtaatgcttttattttctttattctgctcctgattctatttttatcttaaaatgactttatgtgggtttgaacctcaattattttctgttgtttattttatatattagctttcctcaactttaaagatgtatggttttgagaagcttttttaattcaatcactctgggacaccttctattatttttttcaagtaaatgttcaacactatgatggcttatattcagagagcttcttgctccactgcctttccacactttcatgtgagcttcttttttgttttttctttttttaatctcttaggcctggactgaattagattctgtttccagcagttctcacctgtggggctttgttctagaagggaattttagctggctagttttgagaggcataggacccaaaccgttccagttcctgcagatcttactacagaatcctttgtgtttacacaccattggagtgtgcaaaaaggcctcttgattttagatgctaagctgtcaaaaatttggggtaaaaatatcttggttattttaggttctcatgtccaccagacaccctgttgcttctctttgcttcctcttacacagatgctggtaccatagagatcttatggctcttggactgagagggaacagaaacacagaaaatgctggtggtatgcgggcactgtccagaaagttcttctccaaataggggatgatgtagtgaattggcaaggtgaacatgaatttggatctcttcattcatttattcatccatttctctaataaacatcagtagaacccattaaatttcagacactgctgagaaacagaggacatagagatgaataaaacacagttcctcccctggagaaactcacaaccaagtagcaaggatagacatatctataaataatgacagccattaaataagggctacatccaaatatatacaagtttatgtgtaagcaaggaaggttggtcacgttgacctgagttatgggtgaggggtgataggtgggaggtgggggctgccaggcagacaccaggggaaggctcaccaggcagaggggaatggagagagagagagaaatgaaacaagaaccagcccattgtctcacctggctgaggagttgggtttccaagggagaggaaggtaaggagagaagaaatctggactcagactcagagggctgtgaatgtccagctatgaggtttggaggcccttggaggatgttggcaggagagggcatgatcatcccaacctgaaaaaggaggcacaggactgtgtggcaggggaggagggcaaaaggtgttgagccaagctggatggttaggacaggagagacctgacaggggagggaaagcagtctcagaaggacctggggcttctctcagtgtttgaaatgaggccaggtgctgatgatgttgtacaaagcctgcccaggagacaaggttcgggccacatcactgtggcccaccagcaggtagttgggagtcaggtaccctttgaccatggcacactggatcaggtcttgggctgcctctagtgctgcagcattgggtggtatacctgcaaaacacagcagcccattgtctacaggattacagggcaccctgcaaaatagaacatatccccagaacccaccctcatcaccaagctaatagattccactgttggcagcctccctagagacaggcaaaaaaaacaaggtcaagacttcagatttcttagtgccaaagttttcctgaatcaaaagagccaagcctgggataataaattcttctgaggatatacaaagcttttatccactgcaaaagtttagcctggtagttctttataagggtgcaatttagccccccaaaggacatttggcagtgtcatgagatatttttggttgtgaaaactgggatgcaggggaatactagtcggtagaagccaaggatactgctaaacatcctaggacgggacagcctctgacaacaatgaattatctgagccaaaatatcaattgtactgaggttgagaaacttgatttaatcacaatgtactgcctgtaccctttcatgtctagctcaatgctcagcccagtatcaagtcacagtcctggttcaccccatcccccgacccaatgcccattttagtatgggccatgtcactgaatcagccccagtgacatgacctcatcttttcagaggtttggtgaaaggcccttgagtctaaacaaactgattaagaactttgagttgttctcactttggtaggacatacattaaaattggaatgatacagagaagattagtgtggcccctgaagtaggatgacatgcaaattcgtgaagcattccatatttgtatggagaaataaagtgtttcctaaaggagcaaatgctaagggaatttgtcaccactaggctggtcctataagaaatgctcaaagaagttctacagatggaaactaaagggcaatacacactatcataaaaacatatgaaagtacaaaactcacaggacttataaagcaattactcaatcgagactgcaaagcaactgggtaaccattaacattatgacaggaataaatcctcacatatcaatattcaccttaaacgaaaatgaactaaaggcttcacttaaaaaatataggctgactaatgaataaaaacacaaaatccaactgtatgctgcttacaagaaaccccctaactggtaaataaatttacagactcaaaatcaagggtagagaaagatatttcatgtaaatggaaaccaaaaaggaggaggagttgctacactatatcaagtaaaacagactttaagtcaaaacagttaaaaaaaaagataaggaagttcattatgtaatgataaaaggatcaattcaataagaagctataacaatcctaaatatatatgcacccaactcatatatatataatgcaacattaattcaagatggattaaaaactgaaatttaagatctcattaccagagcacccacattcataaaacaaatactgctagacctaagaaaagagatgaatggcaatataataatagtggagagcttcaacaccccactgacagcactggacagatcatcaaggcagaaaatcaacaaagaaactctagacttaaattggactctagatcaaatagacctagcagacatttacagaactttctagtcaacaatgttagaatatatattcatctcttctgcacacagaacagtctcaaaaatagaccatatgctaggccacaaagcaagcctcaataaattttttaaaaattaaaatcatatcaagtatcttgttggaccacagtggaagaaaactagaaatcaataccaagagtaactctcaaaactatacaaatacatggaaattaaacaacctgctcctgaatggtcattgggtcgatgataaaattaaggccaaaattaaagattttttgaaataaatgaaaatagagacacaacataccaaagcctctgggatacaacaaaaaacagtgataagatggaatgttacagcatcaaatgcctctatcagaaagatagaaaggtctcaaattaacaacctatgtcacaactcaagaaaatagaaaatctagaacaaaaaaaacccaaaactagcagaagaaataataaagatcacagcagaactaaatggtattgtgtagaacttctttgagcatttggtctctatatgagaccaaaaaaaaagaaatagaaaggatcaatgaaacaaaaagttggttatttgaaaagataaacagaacagaactcacagaccactagctagattaaccaagaaaaaaagagataatattagaacacccacaatcagaaataataaaggttgcattacagttgataccacagaaataacaaaagattgtcagagattactatgagcatctctatgcatataaactaaaaaacctagaggaaatggataaattcctggaaacatacaacatcccaagactgaaccaggaagaaatagaaatcattaatagaccaataacaaataattaaattgaatcagtaattaaaaaaagattctcccaacaacaaaaagcccaggaccagatggattcacagccgaattctaccagatgtaaaaggaagaataccaaccctactaaaattgttcccaaaaactgaggaggagggaatcctccccaactcatctacaaagccactcttataccaacgccaggtaaggacacaacaacaacaaccaaaactacaggccaatagccctgattaatatcgatgcaaaagttcacaacaaaaatctagcgaactaaatccaacaacatatcaaaaagttaattcccacaatcaagtgggctttattcctgggaagcagagatggttcaacatatgcaaataaataaatgtgattcaccacataagcagaattaaaacaaaaactatataatagttttgatgcagaaaaagcattcaattaaatccaacattacttcatgataaaaactctcaacaaactaggcatcaaaagaacatacctcagaataaaaaatccgtatatgacaaaatcacaatcaacatcatactgaatggtaagaagttgaaaacattccccctaagaactagaaaaagacaaagatgcccactttcaccactcctattcaacacagtattgaagaaaacaatcatgcaagagagagaaataaaaggcacccaaattggaaaagaggaagtcaaatcatctctgttcactgatgatataatcttatacctacaaaaccctcaagactccttcaaaagactcctatatttaataaataatttcagtagtttcaagatacaaaatcaatgtacaaaaatcagtagcatttctatacaccaataacaatcagctaagaaccaaatcaagaactcaattccatatacaatagctacatatagatagatatagatagataaatacacctgttatatataggtgtgtatatgtttgtatgtatatatatgtattcctagtgtgtatatatatgtattcctgatatatatatatgtattcctagtatgtgtatgtgtgtgtataaatatatatatatttatttatatatatttatatatatatacaccaaggaggtgaaagatctctacaagaagaactacaaaacactgatgaaaaaaattgtagatgacacaaacaaatgagaagacatcccatgctcatggatttgaaggatcagtgtcattaaagtgaccatactgcctaaagcaatctacagattcaacgcagttcctatcaaattacaaacatcatttttcacagaatttgaaaaaactattctataattcatatggaactaagaaagaacccaaatagccaaagcaattctaagtaaaaagaataaagctggaggtatcatattacctgacttcaaattatactacaagactatagtaaccaaattagcatcgtactggtataaaaacagatacatagatcaatggaacacaatagagaacccagaagtaaagccacatagctacacacaactgatctttgacaaagttgacgaaaacatacaccagggaaaggacaccctattgaataaatggtgctgagaaagttggatagtcacatgcagaagaatgaaactagacccactgcatataaacattaactcaagatggattaaagacttaaatttaagatctcaaactataaaaatcttagaagaaaacccagggaaaaactcttctggacatgggcctaggcaaagcatttatgactaagtcctcaaaagcaaatgcaacaaaaacaaaaaagacaaatgggacttaattaaactaaaatatttcttcacagcaaaagaaataatcaacagagtaaacagacaacctacagaatggagaaaatgtttgcaaactatgcatctgacaaagagctaatacccggaatctacaaggaactcaaacaacttttaaggaaaaaagtcagctcattaaaaagtgagcaaaggatgtagacagacatttttcaaaagaagacatgctagcagccaaaaaccatgaaaaaatgctcaacattactaatcatcagagaaatgcaaattaaaatcacaatgagatagcatcttacaccagtcagattgacagagactgagaccatcctagccaacatggtgaaaccctgtctctactaaaaattaaaaaattagctgggtgtggtggcatgcacctgtagtcctagctactcgggaggctgaggcaggagaattgcttgaacccgggtggcggaggttgcagtgagccgaggtcacaccactgcactccagcctggcgacagagcaagactctgtctaaataaataaataaataaataaataaataagtcaaaaaataacagatgttgctgaggatgcagagaaaagggaatgcttacacactattgatgagaatgtaaattagtacaacctctatggagatttatcaaagagctaaaaataaaatagccatttgattcagcaatccaaatagtatcaacccaaagaaaaagaaatcattatatcaaaaagacatttgcactcatatgtttatctcaacactattcataatagcaaaggcgttgaatcacttcaatgtccatcaatggatgactgaataaagaaaaggtagggtgcgtgcgtgtgtgtgtgtgtgtgtgtgtgtgtacaccatagaatactattcagccatcaaaaaatgaaatcgtggcatggtggctcactttgggaggccgagacgggaggatcatgaggtcaggagttcgagacaagtctggccaacatgatgaaagcctgtctctactaaaaatgcaaaaattagccaggtgtggtggcatatgcctgtagtcctagctactcgggaggttgaggccagagaatcgcttgaacccaggaggcggaggtttcagtaagccaaaactgcacattgtgttccagcctgggtgacagagcgagactccatctcaaaaaaaaaaaaaaaaaaaaaaacaaagaaagaaaagaaaagaaatcatgtcttttacagcaacataagtggaaatggaggccatattcctaagtgaaatgactcaaaaacagaaaatgaaaaactacatgttctcacttataagtgaaagctaaacaatgggtacatattggcacacagagtacaataatagacatcagagacttcaaaaggtgggaaggtgagagcaggattagggataagacgttatttaatgggtaccatgtacactactcaggtgatgggtacactgaaagcccagacttcaccactgtgtagtatatccatgtaacacaatagatttgtagcccctaaatctataaaaatgaaaaaaaaagtaaaatagagctctgagccatgacaattctcagtgtgcactctcagtgcaaagactggggctcactgtggctttggcatataaggaaaagtgtctctacattgttgtcatggtaaccaagagaagatgcatctgctgaccaagatgagctaaaaataagcacaaagatcttttccccttactttgcatgttccttacatattggaagaaagagacatttggctgggtgtaaaggagggtagatatagggtgagcattatgtctgggggtcacctctggtcacactcagctgagtcaaatgttggattggaagctgggtcaatcaagcatatgcaggcactaaaatgacgcttgagactgagactttgtcttccatgtcagatgctctctttcaaataccatgcaatgaccctactgaccaaagcatccacttacctgtgaaggtgcccatgaaggtaatgcccagggcaatgtcatcgtagccaggggtggaggagccttggacattccagcccaccccttcataaatggcgccatcctggcccaccaggaagctagaggaccacaaggggagatggagaccagcatgaaattctggaattgtttctctctttcatgtattaatttattcatgtctttactacttcagactttgattatctattggattctaagcactgggttacagaaacaagacagagtccttgccaatggagtgctggtaaactagctcagggggaatgagggaggcagggtagggagagggaatcccaatttacagcatatgctgatttctgtggtgtaaacctctcactatagcagatttcaggtgaccaacaatttaacaaccagctctcaaaattccagaatctctaacaatcagctctcatgagctggcacaagcccattcggctccagcacaccactgcggcccccaggtagctcacagtcaatgaagataaaagagaatgacagctttcaatccctaggccttttctccttctcaccaagaaaacggtttcccccaaggtgacccaggatctccttaccattaaatacaaagtaaacttccccagtctttcctgacttgatctctctgtacatttgactctgccacacctcttgacttctccaaacactctcttcccttagcttccatcacaccacactctcttggctttcttctccagctgctctccctccacacctcatcttcctgcaccctttccttaaatgtgaggttcctcaggatgctatcctcagctctcttctccccatactccacacaggactaacccatccacttccttggcttcagttgctatccatgaaagtccgcacgttcacaactggacccatcttcttcgtcacctgttcccctttctgggatccccatcttggtgaaaggcatggtcacccacccacccattggccccagccaggaatacaggcatcagcccacccacttcatccactcgttaacccaggcttgtcaatgatgtctcccaactacactccctgatctgccctgcaccctggtcattaaccattaacctccactgacctctgaaattcttccacttatctctgtaacctctgctaccatcacagggatgtcaccactcagtcctgcctggattgctgcacagtcctcagatctcacggcctccagttccaccctttcccatccagtccattcctaaagggtagccagactggtctttctaaaatacaaatcttactatgtcaaaaccctgttttcagtccctcagcactgagtgcacacaccccagcttaagttacaaaatccttctgacatggactgtgtctgcctccccagcatcagctctaccacactcctctttgacatctatatttatcccaatgaacttctctcagctccccacaggcgcctctctcaggctggaattcagtcctttccacagaggccatttccctcttcctgaatcactcttcctgcttcctcctcccactcaactgtaaggcctcagctaatctgatgttcccacagggattgcttccttcacgcctattttcctggcatcctaaacctcccgtctaccctccatgtgtcccctataataatgtttaacctaccctactagaacttatttgtttgaattacttttcttcctcactaaagcattggctccatgcaggcaagaaccatatctgtgaggcacatccgatggcatccccagagtagccttgtgccacgcagagtacacattcaattacatgttcagtgaattgtaatctatgaaggagggagtgtgtcatcctgactacagaccacctcaatgaaagaaaatgacacagtcataatgctataatagaagaggatacagtacaaggtccaagtcaagggacaggcaactaccctctgagacctgaatggaaaaagggaaagggcctcccctcagcctccaccactttccagtttaggctttccaaatttacagtccattttcaggtatccactcttattaaagacagcaacgctgcaagtaatcctgtatggcaggacctagcaaagcacttggtaggttctgatacgtcataggtgttggagggaaggttttctcctatcttgaaaagggtgctactaaaatggggacagagagcaaggggccagagaggggagagacagtcagcccagaatcgtgtaccaagcaatggtaaattcatcgctaagccataaatggccctagagttaaaggttccttctatgaatgtgcatgaatatgccaaatggtctaccagtagctttttctgagatttaaaatttagtgtgaattttcctgatgggatgttacatggggtctaacgccggatgtcttatctgcaaactctgaaagcatccttcaagaaatttctacttgttttgtggactattcattttgtgtgtttgtgtagcagtttttaaaatcaatactttttaatggaaacatcttgatcaaaaatgtgtcacagaattttgagaccctttaagataatgcttaatggggaaaaaaaaaagaaatgtttactcttccacttaggtctgtgtcttccttattaaagaatcacagaccttagcattagagaaatcaaaagatagtatttggtctctcccccgccttcagacaggaaggatatccttcccaaggaagttggtggtttctagaagcagagaagcagcacgggtctaccatgagggggaaccacttcaggttgtggccaaagtgagcagcagagccccagcctctgagtaggaggcggtggttacacaaacaaagcacaatctttcgattatcttttctacaggtgtcacaatcttgcatgcgtactgcttcctccagtgactttttggcagagttgtagcatccgtcatgccagtgtactacctttagtaggtacacatcttgagaacatgtttgggcaaatgactacccccttggctatctcctaagaaagacccaggcagggtcgtgtgatgaattcatttggttatccatacagtgcctctcctatggtgactacccagtaaatattagttccctttccccttcctttcaaaggctcagtttctgcccccaagggaaaagaagcccagtgtacccagacccactcacttataaccaatgtcgcatgacttgagcctgtctatgtagaaagactggatgtcccggaccagcaggcggcactcatcagaaatgttgcaggtcctcccggcagtgtggataatgatgccatacttcgctgggagagtcatcctgggacagtgggtctccctggctccccacacagaccgtgggacaacgccggggcaagctgaggtggggcgagaaaccacagagggttcatcttccccatctatgccagccacttctccaccgtaggctgatataatgctcaggaccctcaacttcccaaacccctctgggtctcccaccctgcccccaaccaccctgcccccaacagtgggacttgagagcagacagtgtcccgcagtgggacatggacattttattctaagaatatgtatttgagtcatttgtaatccatgaaactctctgtcaatgtaagcgatcatttatgttaacagatggcaccagagatcaaatttactcaaggctttaatataatagagatgaatcttctttcaatcttgattaagcccaagaaaaggctgaaagtgcttattaaatttactgtttttgatgttgctgcttgttaaacccaaaatggtatccaccttttattatctgaattatgttgagctctttctttaaagtctgtgtaagtggtggtctaagttttctgcagcacttcagtctattcgtgttgttttggtttttgtattcagaaatgtgtgtttgtgtgtgttcatgtgtaaacatatgagtgtataaatatgtgtataaatgtgtccagtccctttccattgtttcctcccttgcacttttctccatataacatcccaatatgtcacttatttatttgcttattgtctttctctgccctctagactgaaacttcatgaggccagggacttttgcttttcattcctgagtatattttcagggtctagaaggtgttcagtaattgcttgttgagtgatggaagaaaggagtgtgcatatatgacaccagggataatgctatggctctttcatatgaggaatctgagggacaaagaggtggcctggaggtttcctctcaagatttgccagccccaagagttcagagagttgggtggccagttgccttccagaaggaatctaatgggccctactgaaaaggtcactcccaatggtatttgcgagttagttggggtgagcccagtggcaggcccagtagggctgaagaaaggtcttacccttcttcaggcttgtcttctgccgaggggccaggcagttctcgcctttcccaagaagtggctgaacataactggatgacaggtggcccttctggacagcataggtgattaggttttccatggccgacagggcagcagggctgggactgtggcctagaagagagaaatctgtgggaaacctccacccagcctgagtttcaggggatcttttggggaaggagaagatgctctgccagcccctgcacagctgatggagaggaagaaaagggaacaggttatgcccccagttggagaggctgagaattaaggatcttcctggaaagatctctcagtggctcaaaatgaagtcctttctcatcccaaatacctgccaaacttcacctcctctctccatgaaagagctcagaagcagcaccaagcccagcagcacccgccaggccaggccagggtttcccatcagaaggggcccctccaggcatgtgtcaggctctttgcctacaataactcatttaatcagcagcacaaacctctgagagatgctattattaactgcattatttgtgaagaggaacttgaggctctgagaagtaatgtgctcaagatcccaagctaacgacaaatggaaatgagtagtcatgaaaacaaaagcaaaaacaagataaacacagagtcctctggagtgctggggaaaccacccaggagctggagataaaagatatggaccatgttctgattcctctccttctagctgtgtcacttggggtcatcgacctctctgaaacccagactgcacctctgcacaacaggggtcatgaaatctacctggactctctcaaaaggtactggaaggggaaaatgagaaactaggtatgtaagatctctgttaacgggaaagggtacacaaattcaaaggaatggtcctggagtacatatgttaagatgcatgtggcaaggggccttggagcaacagtccagaaagaagtagaagagagtcagagattaggggacccagagtggtttttttttagaaatatatagaaaatctaggagtaagagatgaaaggaagaggtgcctggcaggaacttggaaagcatggcccacagccacagaatggtcagagctcaagaggaagatgtgttagtcattgacatagaggagagagctgaagcccagataagcttgcagagagatgactggtcagcatctccacataaaagatggctagagaaagaggagcctgtttacaggggttgagaaggaagccagggcagtaggaagagacccttcacaaagtcatttcctggaaatcaaggaagaagaaaattccaagagagagtgggtcttcagagaagtatgagaaggataagacagcagagtagcagatagctagttcccatgaagtggcccctgagacaaaggattagagaactctttggagaaggtcagctgtgataactgttacctttcttagtgccaaagaaggcaaagcccagggagatgttgttgtagccttgggtgtgcactccttggatattccagccaacaccttcatacaccctgccatcatccccaaccaggaagctatggagcaagataatacaggtttcatggctggcactgtaggacattcctgagaggtgaaaccacttacccagcctcaaaatggagaaggactgaagctatgttcactaaaaggaatttgcatgaactcttcccagacattgaaaagagcaagtcatttatactagtccttagaattcagaaggacccactctcacactccctacccccttcccttttcagaggctgcagttttaccataaatcattctacatgctcaggagaagaggtcctagaggttccatggtaactgaccacacaatggaaggctcttctgtcttccacgcttccttaaaccgggctctcctacctcctccaaagtgtgtgctgcctgtgtgatccacgcagagctgttcatttgatttctccctgtcacgtaactgtcctacatagacttcccaagaaatagctcctgagacagggacgaggatgcaggcacttcatctgcaaagagatctaacagagcaggagcaccatcatctcagacaaacaccaccactttaaattccagctccctttctagcctcatgtatttcaaggaaatcacttctcttctaaaaaacaagcagccagaaagagcagacagtaaaacacagataagacagctcaggcgcagagaggggtgggaggaaagtcccttgagtaactgccaaacttcaccctcatacaattggccccagtaaaacagtgggccttaataagcacattcctttcccttcaggtgcactaagataaggaagctaaaagcagactggggggcggtggggatatgcctgcagctgcagaaagatgtatgggaacagacacacaactgtccctcccagataagcacgacaaagacacagaagcagtccaagcctctgataaactctcccaccctgaaaccttaaaaactcttagtctgtaagagagtaggctctgacctaacttggccaaaagcctctctcagttttgttttttctaaaataaaccagtcctcgactgtcgagccacctttcatggttctttcctctttaattcttacaggatcccagaagccagggtgaggagagtgagacagaaggaagaaagccagcaaagtatgtgaaattgggctggctcacagtggctacctgtgactccaccccaccctgtggccttcccaggagctgtgtacatgcgctttagaactgcctctcataagggctggggttgaggaggctacacaccaagccctgtcccccaggaaggcattcactcccttttgtcgtcaggggctgggggaaggtctgaagcaggaaagcagagagatgtgttgggcacttgaggcaggaagccatcactgcactcaggaactgtccacagctagccaaagtcagaggtgagccaagggcatgtggtatgggcaccagtacgacctactagagcgatcattacaggaacagatggacatttgcctcactgaggctggagcccatgtgtgtggtgtggaggagcacgccagggatgaagagagccagtttaggctccatgggtccatagatatgtgacctcaaattaatcagcctccctcccttgggcccctcttcccagggcaaagagatggtgacacctgcctaccagtcgggagagctaaagccctcatgtatgaggaagtcgtttgcaatctgtagtgtgctgtgcaagccagggttgggggagggtagagaatacagttattacttaaccttccttgcttcctcctgggagctctcagagacaggcacctcacagaaaaatccaaaggattgggagtttcatgggggttttaaatattttattcattataaaacatataggaccacaacccagaaaatgaggaaaagggatgagaagggacaggagaagcatcccagggaagcaacactgaccatgtgccgtgggacccagacccagctcttacttgtaggccacatcacacccactgttgttgtggacatgatgggcctgcagttcccgcagtctctggctgcagactgtctggtcgtgacactccagtccagggacatggtgtataacaaggacattcactggcgtggtcagctgaatactgcagccaacagcttctgccccccatgccttgcgagagaccgtggtggagacatctgtgggaaggccttggggacgtcactcagcgcacctgccccatcactaccgcattagcccgccaagctgaacatgcaggcatgggctgtgtcggccccttggtagtggaagagccttcagcaggcaggtgcacctgccctgcccacctctacatacccatctctccaacactcaccccgaacacagactctgcacctggccagggagcctaatgctttgctcccccatcccataatgtcccctactcatctcctcccctgctgtggtccaggctctgcacttcaggaagcatcacctgcttatccctggggaaagccctgagcagcctggcttggtgtcacctcagcattcaatgtgtgctctctgatcatttcctctgcggttctgagtgttccctgaggggactgcatcttctccccccagcaggggctatgtctccccctcagtctgaggacttcctgagggcaaggtttgggtctccctccacagggagtccctgtctgcagaggctgtttcccctcttcctgggtttctagccctccagcaccagccttccatcccaaggacctgggtaattaatgcaggtggtttactggtactgctctctgcacttcaaccccattttccccctcccagtcacatgtggctttgcagacctcagaaacatttccgatcacatgaaaaaccccagctcgtcccaaaacccccttactatccagatccagtttacctttttcagtgagctgggagatgttctcaaataggtactggagcccctctgatacctgtttagcttgtgttttgttccaggaggaatcacctgcaaaggaatatcccattttgcatcagagagcaccaataccagccatcatggtggcaccagctctgaacagaaacagccatcccctctccactgcccctctgcctcctcaaatcccagagcctcctctaagaaatctctctgggctgaccagagggccacctctaatagcagcaggtggcataacttccttccatgccaactctgggaaatcccctgggataggcaaggagttggaaatgttatccttttctcatgagctgtatctacacacacaattggcggggaaaaaaaaaaaactagaaatgtattcagacacttcaaaaccacaaagtcctctcttgtgtgcattttaccgaagcaatggggaagcgtgtgtgaagaaggggttagaattacctgcacggctcagaccagttcccccgggattgattttagggacgtgtgctatgcccattctcctgtctgaaggcccatgggggatgggcagggtgttgattgagacccttacccacaaggagctttctcttattgacaagcacaaacccaagccataggctggactctgattgacatcataataacacaaatgtaatccttgctcctgtttatttgcttttactgcccacgtattgctatatcttcaggtgcattatctcatttaatcctcacagtgagtttaggaagtcataactatctcaattttcagatgggaaaataagggtttatagagcttaattgcttgtttaaaatcattcctagaggcagagcgaggacttgaatccaggtctataggctccaagttctgtgctctatgtacaatctattctttctccttaagagagagtaggttttgggggattttttcgttttgttttgttttttgtttgtttgtttgtttgagacggactctcactctgtcaccaggctggagtgcagtggctcaatctcggctcactacaacctctgcctcccgggttcaagcagttctctcatgcctccctcccgagtagttgggactacaggagcgcgccagatggagtttcaccatgttggccaggatggtctcgatctcttgacctccttatctgcatgcctcggcttcccaaagtgctgggattagaggcgtgagcaactgcgcccggccaagagagaatgggtttgtttttgtttgtttgttggtttgtttgttttttgagacaagttctcgctctgtcacccaggttggagtgcagtggcacgatctcatctcactacaacctccatctcctggcttcaagcaattctcctacctcagcctccctcctgagtagctggaactagaggcatgtgccaccacacccagctaatttttgtatttttagtagagacgtggtttcaccatgttggccaggatggtctcgatctcttaacctcgtgatctgcccacctaggcctcccaaagtgctgggattacaagcataagccaccacccctggccaagagagagtagttttttttgttgttgtttgtttgtttttgagacaagttcttcctctgtcactcaggctggagtgcagtggtgggatctcggctcactgcagccttgaactcctcaggctcagatggacagtaggtattttttaattcctattatgagactttaggatcacccttctcggttgctttttggcccagggaaagaaaacttaccccaggcctggatacccagagcagagaagacaagaagccacggcagcatccccacgtggtcccaggacaccaatctggagagtgtggatggcagcctgagagagacgctgacagttgttaacatgaccattctcaatctgcagagcatcccaaaccctgactgcagtgggtgccatctgcctcctctaccatcctgtggcctcctgagggccagcacctgcttcagtcttctcagggcccccagcatacagcaggtgctcagcatccctgtcctattattacccgaggaactcaatttcatcacgtgcccacggcgtgcaaggctgtgtacacacttgcacatgcagtcttatttaattagtcctcacactaatcctgtcatgtaagactgttaacccccatttttacagacaaaggaagtaagatccaagaatggtacaaccgagaaatccagactcatatggatgggtcttatgcagagaatcccttcccagctgggaatatgccagatgagggagatataggagtaggaggggttcctagttctagggcagaggaaatccaatccttaacactctttctggtggattccagtccctttgctggaagagggcttctgaagaagaaacacatactcaactcacagatatctgtgggtcctgtgctgtcccagcccagcaggtcagggtgcagtcagcttgcccctgattggccagcagctccttcccttccagacttggcctccaggccctgcccttcttcaccaactggcgccttctcctccagccttcactctccctagccctagagggcactccctccctgggaatggagcactcgggctctagcttcccagagagaagagagcccaggatccctaacaaaagatggggagaagggaagacagagggcaaggctctgagccagctcctttcacagcacctggagaaatgcaagtgggaccagactcaggctgagagcacctggggacccgccctgtgaataagcccaggtagctcctccctgggaaagggcaagattgcccaacactcccgagagctcgtcctcagccccaacctgggaaagcctgcagggcctgagggttgtgtctgcaacatctagaaacttcctgcctgtgaagttctgctccaggagcctgaagactgtggattgaagtcactcaccaacaccaccttttaccagggtcatgagcagggtcaggatggacagagagaaactgggaggtacaatctcaggaaacagctcacgatgcctaattctgccccaatagcttacatgtctgcccatcatcctcccgcctgccactccccaccgtcggcatcaagctgccacctaccacagaaagcctcccacaaaccaagaatctccagctcctcgccatgttccagttgtcacctaatctcattccacattctgcaacctggacttacagcccttgagtcttcacagaggaaactctgcatgacactttccaagaacgcagtaggatgcagtctccacggggacctgcagagcctctcatgtcccggagggtggggcagcctccctagacacttaggaagtgccctgaatccagaacagttgctctcagtgagctgcagtcccactctcagactgggctccccaggagcgctctctggatggggcccattgagcatgcgccaggtctacctggcattcatcccagtcatgcacccagacccaggctggagctgtgtgatgagcaggggctgctgagctctgtcctggggtgagggtgaatgtggggcagagccagagacagagatgaaggagaccaagaactgcagcctgggaccagcactgtagggaccctggtagtttccccagcctggcaacatgctgtttctccatgccttttgctggccgcccatcctaaataagtagaacagttctcaaaatgagaaggtttctgggcttgcatccggggcaccaaggacttgaggagactcggttcccctttttggagcggcttggggaggggaagcccaagaagagattgggtggtggctgccaaaggggaccaacagattctctgccccatccagagaccaacagattcttgaggactaacagactgagggctgtccgggacgagggcatcgggagggaggaagagagcagtgtgggttgtccctctctgattctgtgaactcagaatcccgagaggacctcctaagtcctaaattatctggcccccagccccatctcactccacgctgccagagcaggctcccagtgctctctgccccacctcccaccatctcaagacccttcccaagtgcccagcctcgctccccacctgcgcccagaggctccacttcagcctggcatctttggaaagggctccgtgactagttgggactggtagaggctcagagtctctcttctccattctagcacctgaatgaattgtaattataatctcctcaagagcagttcccaagtctatctctttacctgcctttaatactatcattatttatatttacatttttttgtcctctgtcttaagcctccctccagctgtgaatttcacagaagtgggaatttactttattctgtagtctcagggtttagcttagtgtctggcataatgctgacacatgttagaaactcaataagcatttgtcagataaagaaggaaggaagggagggagggagggagggagagagagagagggagagagagagaaagaaagaaagaaaggaaagaaagaaagaaaaaagaaagaaagaaagagagaaagaaagaaagaaagaaagaaagaaaaaagaaagaaagaaagagagaaagaaagaaagacttaaacaggacactcttttaaaaggtgtcaaaagaagaaatggaaaggaaaagcaagccagcacaccgacctgcctcaaataatgcataccttcaagtacctaaggcagtggttctcaaaaagtggcccaggggaaactgggggaccccaagaccccttgggggggtccatgagatcaaaactaattccagaacaatattctctgaacttcccaccacaggaaactgcccacaaaccaagactcccggctcctcactttcctcactgtgctgatatttgcactgatgacacaaaaacaatggtagaaaaaaccgttagagacatgaacctatgtgtggcgtcagactgcactagcagtcattgtattcttcacaatgtattctttcaagaaaaggaggctcacttaggaatgtttttgatgaagcagtgaaaattactcattttattaaatctcaaccctgattctctcaaggaaaagcatttgtgtgctacagttgtgagctgaaccagccacttttcatggacgccgtgaacaaataacatagaacaaatgatagccaaactatggatactcatatttgggtatgcggcatacattttcttgaaaattaacaaagtgagcctttcacttccgggaaaacaactacaatttgttagcataataaaattggagctttcagtcaaaaatttgaattttggaaaatttgtgtctgccaccatgagtttgacagcttcccaatatttgaagactactgacaggatcagtggtgatattaacaaatgtggtggggcttttttgctttttttgttttgttttgttttgtttgtttttgagacggaatctatctctgtcgcccaggctggaattcagtggcatgatctctgctcgctgcaacctctgcctcccgggttcaagtgattctcctgcctcagtgtcccaagtagctgagactacaggcatgtgctaccacacatggctaattttttgtatttttagtagagatggtgtttcatagtgttagccaggatggtctcgatctcctgacctcatgatctgcccgcctcagcctcccaaagtgctgggattacaggcgtgagccaccacgcccggccaaatgtggtttatttatatgtgtgtgtgatatatataaatatgtatatatagagagtaataaatgatgtcagcatttagaagacgtacataactcagtcaaccaatattttccaaatgatcaatatatgaagtcacaaagtttggataaaagatccattaaattttaagagggaccaattgattctaatgtaacagagaacaaataattcattgatatggtttcagactttacgttgcaactaacctttgagaaaccatcacttgttgggttttgatgtaatatgagagaagaatatccacaattatatatttaaaggctattaatgtattcatcccctttgcaactacttatctgtgggagattggattttcttcaaatcttcaaccaaagcaacatacagcaataccttgtatgcagaagtagatgtgataaaccagctgtcttctttgaagccatacagtaaaaaggtctgcaaaaatgtgaaaaaaaaacactcttctcactagcttttgacatatatatataattatttttaattgtttaaaaacgtggtaatacgtaatgtgtttattaatggtactttaagtgagttaataaatcattttaaattttttaaacttttaatgtagtaaatactgatacatctaatccacaaaagctctttgggatactcaataacttctatgaatacatataaaagggtccagagagcaaaaagattaaaaacctggggccaaaggaatcccacaggctgtcctgatgcagataggccacaaggtggcagcatgcgccctctgataactccggagtcacctttcactcactaggagtctctgagcaacctcttttatccatcactcccttccacttccttccttaccttcatgcttctgtgtggcacgtcttttttttttctaactagctttatccaccaacgccttcataattacagggcatagccatctcctaagcataagttctggccaaaccaagccagtcattcattttattctgcaaacatttgtcaggtgtcactcatatgcaaagcttatcatccagggatgagtacattgagaacactgctctcaagtagttaataatataatgagggagacagatccaaacgccagtgattataatgcctgctgagtgtgaaaaccctttattctttacaaagggctgtggacttcaaagggagtcctgagagcagaggatgccaaaagccagatgctgagatactcgccaaaaatttctgcagagatctggaacctagggacatagtgagcgcaaaagccaggttcccaagagatcggggaggagaaagggttggagcaacagaagccaggcaacaaaagggaatgccagctttctcaattttgaaggtggcatgtctgagaaattaggaggatgatgagcagaggcagccaaggtggagacagggggagaggtccagacttggggaagcttaggttgaatgtctaagaagccagatcattggagggtcctcactgtggatgctggagcagcccagcatgggggcagggagtgcggctgctctcagcagagggcctcagagacctcaggatggccagtcaagggaggccacaaggatgccaggggtggtcaaagcttgatgtggactgagcccaaacgtggtagaacaatggtctgaagctacccgtggatagcttctgtaagtcatcctaatgcactagagtctagaatgagcactggggaaatgggggatgttagggcgcttgtggttaggagacccgtacccagagatctccaaggaagagcacttgggactcccagcaaggaggaagacagggagtggaggaataggcagcaggctgtgcgcagcctgagtggggctgggcctcaggcatcagagtccctgtgaggagagggacctgacttcacctgcaggtggagcaagtaagccaggagacagtgtccaggggccatgaggctagtagtagtcatgaagcccaccaagagtccatcaaaacttggaatctgtgctagaaatgacctaagggtcagctgtcccaatctcctcatgtaatggataagaaaatggaggcccgaacatggaaatcacttctaaagaccaccagcaagtctgagaaagctaaggactaaaaccagctcagtccctcagtccgggtcccactgtgtgcctgctgtaacacccccattacaacacaggaggggtaaagctccctgaaagaccacagtgggagctgcagagaagggaaagacagacccgcagtgggtcccaggcatctgggaaagagcacagtgatttgatggtagctgcaggaacctctgcctgcttgtttgtttacttgcttggttgtttgtttgtttgaaatggagtctcaccctgccacccaggccagagtgcaatggcgcgatcttggctcactgcaacctctgcctcccaggttcaagcggttctcctacctcagcctcctgagtagctgggattacaggtgcgcaccaccacacccggctaattttttgtatctttagtaaagatggaggtttcaccatgttggccatgctagtctcgaactcctgaccttgtgatccacccgcctcgtgctcccaaagtgctgggattacaggcgtgagccaccgtgcccggccacttatttgttttttaacccaaaaagccacacccttttctcccagtgaaaacctcgagtcattgtacagagccaggaaaattggcccacccacttcatgccctagcagaaggctccgactttccctggaaaatcagtacccagaggggaagacccccatcccaccatccctcagtccaacctctggcctcggctggcagtgaggaggcaggtgggtgtcggccacctactgatcatgccaggaattgtctgctccggtcagaaccagaatggctcagccctggcctcacctgcgcctgggctagcctggaacctgggggcctgcagtggccttctaagatgggggcccactgtcagcatcagatcccccaagtgcagattcccgtctgttttgaaaccctgaccagctgctcattcccacccactgctgagccttctctcccccaactccctattttactttcattctgaatcagcactaaatgaccacagtcagtggctctgcagaaagtcacagaacagagggtgacaggccagtgtttatgtcacattcactcatttcatcattgattcatgcactcctgaatttattcaatcaacaagcgttcatccagtgcctctgagccagcccttgcctggtgctaagactttggagggtagcaggcagcatccctgcctagaggagccacagtggtgtggaggaatcagaaagtccacctgaaagttgagagctccatgacaaagcagagatgcctgccgcacaccatcactcagggtttgagtcacacacaccctgcttcattgtcatgctttttttgtttttattttaaattaatggacaaattgtattaaacaggaattttcatataaagcttcagatgtcctgggccctcaggaggtccaagaacatctggtctactttcccacgtggcagccctggcctgacactggctgtcccttcaaggtaggaacgttctcattccccacagttgccaccactgtccagtgtccccaaccctgaggccccatatcagtggccacaagttgccctactgctgccgttgatgttctcatgccccaccagcttcaccttgggtctggttcccgcaagggtgagttggagatccttggtcctgagtgagaagtgctttgtcagaggcagcagagggcgccatgggagcacacaggaagggcgcctggggctgtgcagggactgcagaacaggctgcactggcacacagggttggctgctggctgctggctgctggctgctggctgggtttcctctattagcttaaacaatggaaggtggacttggataggaaatctacctcatgtattcctgagctgtgtctgcaccgttcattcattcgtaggcgactcatgtattcaagcactcatttatttattagatgcttgctgtgtgcttagcactgtgccaagccctgtccttagctaccaagagtttaaaacgtaatttggaagacaggatataagattatgtctcccctttgtattgcgactcactcatcaagttctcccagcatctagcattcatatctggcactcagtaggtgctcaacaaatatttgttgcataaatgaatgaaaagattattagtaataataccttttatttactgagctcttcccaactttccatgtattgtcgcaatcctcaaggtaagtcctgatattatcctattttattgataagaaaagtaaggcacagagaagttaagtaaactgcctaaggtcacacagacagtctgaagtcttaaccactactccaggtgcatctcagcagtgtgaggcaggccatgcttagggccaatgcttagcacacacagagattgcctcaggctttcagaggacaaagcagtcaggaggggctggggcaataaaggaaggcttcatggagacagaacaaaataaccagtgcaggtagaagaagagaaccatctttcctgatagagagagggggcagcaagcaagagggagtcccagggtggatcatccatactggcttccaggggtgacgggaaaggatgccagcaaggacttcagcaaggatcaatcagcaaatccgagggtgtctctcttgccaagccccgggctgtgtgcataggagaaggagaacatgaatgagaacctacctttgaggatctacagccaattgttggacagaggcaaaatatgtatataattttactccaggaaagcaagtgttgagagccagaagtggtatgagaatcatagtcaggaagacagaaactgtttccaaatgggaagcacagagcagtctccttggaagagagtgcattagaactgagccgtgggggcgggcaggatatcactgtggagtaggggaagggcactcctggggtggcaaggtgggaggtgggccctgtgttcccacagtgggcagggaggtagtgaaagggaagctggccggacaggcagggccattccaagagggctttgtgcgcagggctaagccaagctttctccataggcaatggggagcaactggaggttcgtagcaggagaaggacacatcttgcccaccaggaggctaagtaaaaacagttgtctcccaagttataagttcctggaacccttgctgggagcaggatttagaaaaatgatgctgagagatgctagaaacatattcgccctgaggctctctcactcagactgcaagaggaaggtatcatcagaattgcccttaaccaggaaccagaatagctgggtccccttcctgccaagtcagcaaccagctatgtgaccttgctcaggtccatctccgggtgtcagtttcttcatctacaatgcaagagggttgcccacctctgagaacccttctaaccccaaatctcaccctatgaatctaagaacaccaacccctcgccatcctaagtatcacagagccaggcaagcatgggtgagagctcagaccatccttgttggactaaaaggaaggggcagactgcccatggggggcagccgagagggtcaggcccccataggtcctcagcctgcttcaacctcaaaggggatggggggctgagtggtgccagaggagcagcaggctcgctcggggagagtagggccttaggatagaagggaaatgaactaaacaaccagcttcctcccaaaccagtttcaggccagggctgggaatttcacaaaaaagcagaaggcgctctgtgaacatttcctgccccgccccagcccccttcctggcagcattaccacactgctcacctgtgaagcaatcttccggagacagggccaaagggccaagtgccccagtcaggagctgcctataaatgccgagcctgcacagctctggcaaacactctgtgtggctcctcggctttggtaagtgagctgccagcttccccaggcagaagcctgcctgccgattccttctttccttccctgacccaacttccttccaaatcctcctcctagaagccctccttggttggccctgcctactttaaagcttctttcacattttcttaggtcatgttcccctggggcctcctgccctcaaatgctttgctttttggcactctgtagatattctaaaaaatcattttgtacatgtgtgtgacaggccatctcccagttaagttgcagcctgtgctttctttttattttgcacttcccccactatttctgtgagtgcttagtaggaagtgtcaaagaagcttgacagcattttcttctaagtgtcccaactcttggttttccattacacagacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaaggtagggctggactctggcaggtctgacccagcctcaccgcagtttgggttgacaagggaggatgggagtatgggctacagcaatcaaggggaagatttgagctcctggagcccagccccaagacgcagcgagtgtcctgttatacagggcaggtgctcacagttacacaggacgacagggtcaagaaattgctcaattgaacacctgctatttgtcgggccctgttctgggcagagggatgtagtggtaaatggggagcccactattccagtggagggagacacacagtaaagttgttggccaataaagagcacagataaagccaaatgccaataagtgcctggaagaaaatgagatagagtgcgctgtgggcaatggggctgggtggggtggaggtgaccagttagggtacatgagaagggcctctttgaggaggtaacatttgagctgagccccgaatgttggggagggaagcccctgaggatgacacttggcacaaagctgaggagaccctaagcctcaggcgggaacttggggtggaagacttgggggcttttctaatcctaagggtctgcggtggaaaatgaatgcataaagagcacatggagagcacctgcacagcactcagggaactgggaggtttttcccccgctccaaaaatgattaggcagttctaagaaaaaggctgagcacttccaacagcctttttgttttcttttcaaatttggggaaagtcgggaaacagaggcctgcattaagaagggtggaacacatgggtctcagtctcagttccagtcccggagccagacatcctggggtaggtccccagccctcccagtgcccctccctccgccttggtaaggtggagaattgcagccttcagagttaggggccctgacagctctccataggtggaggcctcaggcaggcaggatgctgggtggggtaggcaagaaagggcccagcagagaggccgcatggcaaaactatcctccatgtgaccccctatgcccgcttcaccccccacctgacatcccccaccagaagcaaagcgatgctgtgggaaaggaagcagagcctcatggatgggctgcacaggagagtgctcgcattggctgggtaccccacaggttctgggaggggacttagcgaggtgactcagccagagggtggcagagctggaaccaaccagtgctctcttggaccccgcctgggtctgggtcttccacctcccctgatgtctctcctttttttttttttttttttttttttgagacagagtttcgctcttattgcccaggctggagtgcaacggcacaatctcggctcaccacaacctccacctcctgggttcaagcgattctcctgcttcagcctccagaatagctgggattacaggcatgcaccaccatgcctggctaattttgttattttttgtagagacaaggtttctccatgttggtcaggctggtctcgaactcttgaccttaggtgatctgcctgcctcggcctcccaaagtgctgggattacaagcatgagccaccctgtccgaccatctccccttttatactttatcacacccttgaggtcagcggagcacatactctgctctctgaccctccatctcccctgcccacacctagtttttctaggtgtttccccgttgtattggttgaaataagtttcactaattggtaacctccagagggaagggaagggagggcaggggaaggagtgaagtgcagaggggtagcagagtggaactggcctctaagtcagatctgaatttgcatgccctcaatagtcaagctgtgaaaactaatgaccctctctaggactggtttcaagtcttcctccaggaagataccattcctagctgttaaagttgttataaggaccaaatgaggtgacatttccaggcttactcatgccatgaccagggcaagaccctggaactcagcttcctcttctataaatagagaatcagcacccaagtcacagggtcatggagggaataaactggagagcgtttggtatgtgctcagtgtctgctccattgtgcgcactcagcctatggtcatttttaatttttaaatccagccccagggtgaggcttcccttgtacatttgccagctggtcatttactgtgctcccagtccccacctctggccacacccagctctcacagccttctctccccacccgcagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctccaagtcagtgctctgtgtgcttcttccacctcttctccaaccctgccttcccagggctctgggcattagacagccctgtccttatctgtgactcagccccctcattcagtattaacaaaatgagaagcagcaaaacatgggtctgtgctgggccccttgggctcacctccctgaccatgtcctcacctctgacttcaggccccactgttcagatcccaggctccctgccccatctcagacaccctgtccagcctgtccagcctgacaaatggcccttgtcactgtacactgtagaaagcaaaaaggcatatctctaccccttgatatgcctgctacctcaccaaccagccccaagcctgtcttcacccatcactgtctacacagccctctctctctcctaacagaattctattcctctgaaagtcttccagaaatggacctagatagtgccatgtctggggaggaatactggcacccaggcagtggaaacaaggacagatccggtgtgtttactctcacactttttctggatccaagagagcaattggatctctcttaacagacctgccaccctaatcaacgggagtgctcacacaagtgggagtctgagagcttagccctatgcccaccctggtctcaacagaatggcagagtgaagaaatgagctccagtccgggctctgcagctaaaagactccgtgactaccaggaggagtctgtgctctgggtccagagagcctgggggtctgaagattctgattttaagctttgagggccagctgtcctttctggtgggtagctgagagctgggcccagcacaagtatctgcttctctctgcaaagcctactaccaggcctggccctagctgcctcagggctactgctgcagctcccccttcaagctgccccagatccaagtgctcagttcagggactcctctgccatcttcctgccctttggctataaagtccctttcctaggttataaccagtggggtttggccttccaaaaaccagagtccagatcaaggtcctctgacccctgtcctttcagcagaaagaagactcacagaattaggatctggggaagctgggaagactagcagtcacctactctcccttttcataagtgaagaaaccgaggtgtaatatggagaagagactagtccaaagtcacacaaatgacagagttgctcaaaataatgcagtacgaaaagtagcttgaatcatatctgccccactggctgcacctccccagccccttccccagtgcagagcaggaagatatagagctgccagtgttggatttcagccctcccctcacagcctggctatggttgtgcccccaacctgcctgttgcagactcctgctttaagggcctgggggctccgctctgggtgcagggttttaagggctcccactcgagggtatgaggatgtttccaggaactgtctcaggctgagagcttaggcagcagagtctagaagccctcctcagtcccttctgtgcctgacttggagacctgacagctggggacactcattttctgacagcccttctgctcccatgctcacatccagggaggagtcactgtcttcactcccttctgaacacagcttggtaatgaggagagagaagcatcctggggattggagggccttagaccagatgcttccagtagggtggtaagtgctccccctaggccctctgcccaccactacttatcacaatgtgcctaaatatgtttatgactctgcctacccctccagactgataactccaagagagcaaagtccatctgttttttttttctgatttattctcagcacctagagtagtggctgctacatagaaggttctcagcaaatattgcctgtataatggcctaggtttctcacgtgttctatgctctcttctcaagggatgatgtggagaaaaaaaagcaagaggagatcaaaacctgcaaatggaaggcttctgcattagcattacagaatctcaaacctgaaggtaaggagcagcaagttgatggaatcggagggcccctccaccccctgttcaatcagaccaatttgatttgaaggaagagatttgtcttgaaaaaagtgtgaaaactatggacttaatccaatctgccccacccacactctagagtgattcttgccaacatccctgccaagtgactgaaccaaccctgcctgaattcctccaggaaaggagagtttccccctttgggagtgacacttggaatgtccctcattatactgagctgaaatccatctcctcatgcccacccagcattagtcctacttttcctcccctttgaggacacagaacaaatctaaccccttatcatccatcctcccatccacatgtttattcctccacttcttcaaaacgccttccctaaattacatccaggctttctccagcctcttcacctttgcaccaaaaatgctgtgctccatcctggtgtctcttgtaagtcccttaggatccatcaagccttggaacaagtgttactgcttcctcaccatccacccttctcaagaagatagggacttcctcctccaggcccacagaactctgacaattccaccattgcacttcaaatactgaatggcaaatactcatttgccaagactatgaacccctgaaagcagggactatagctgattttcccccacattcaagatcccagcatggaccatccacttgttcatccacaaagtgaagataggatggttctagagcagaaatgggtgctttgctcgaatgtgggtgtgaggtaggagtggctctcaggaactggggttgggggtgccagctgtctggagacctggggctggcagagagcagagcagctgagtggcaggatgacccagagacctcctcaggtaacaaggattcttccatttaccttgtctctagtaactcagtctgcatgtaggcaattgtttcagaccctgggggaaggtctgacaacaagccacttgcaccctgcggaattttctttaaacgtagttgaacagaactcatcaaggtgacttaacctcttcattcccattagcctctttcatttcaaaaaaaaaaaaaaaaaaaaaaacctcattctgctgagtagagcagagtgggcttcttttctcagatagagagagcaagcatgtccatgtccatgtcaaggttaagattcccactccaagtggaaatcagtagctatctctgtgattaatgagtcctttggggaaacatgacctttggggactttcccagcaccatggtgactaaagaatcagagacaacctgtcttcagatgactatccaacaattcctgcaacaatgagttgccctccaggctggtgttagcagtggaacctgaactgctagatgccttcctgggaggaatgaggaaggatcagaagtagtctaagctgctaaactcttcccagacacttcacagtgctctgaatgtggtctggggcctgggtggtggtgggatggctccagaacttgggggagaaatgaattcacttgtccactcacttgtatgtcccttcattcactcaacagacattaactgcagacttactatgtgtcaggcacagtataatgctgaggggccttcatgataaataaagcttgtccatgttgtcaaagagttctcgggcctgcagggagacaagacagctcctcaaattaatctgatgtggaaaatgagaggccagggaggtccagctaaaagatttcggtgggatgtagctcggtgggactttgaggtgggaatgatgcccttcactggggccatctccatggaggggtaagtatcagtgtgacatcaaggctggtacctggagacatcccgggataaacatgaaggtgcttcaggagaccatgtatgcaaaggcctggaaatgggcaggcgtggggtttgagggcgaatgaggagcactgggggcgtggcagggagaggtaagagagacagatgagaacaggataggtaccaggccaaggaactcacactccattcagcagaacaggggcagagccccgaaggcttcagggagggcaatgatataatcacatttgcatttcatagaagtttctctatctgtgttttatgggatgggtttggggtgggaatgagaccccaggcacatggcctgtggggagtctgttgcaagagcccaggtgagcacttaagagtccaagcggtgcttctcagaaaaagtaaagctagagcctcaaactaccccaagcttcacctcaattaggagaggtgtgactgcaacatgataaataagatcatttcatgctgtttgccaagacctttccaggaaggaagatctcagctttcaccagcccggtgagccaaccttacacaaccctgatgcagccctgccctgaagtaagctccataatccaaccccaatgcactgccccctcttccggcagttgcttaaaacatatattttagaaagccccgtgtcatggattttgacactccaattaccaaagtgacagcaggactgaaacaactggtttctcaagtcctattgccccttggggctctgacctgaaacagtttctctatcctaagacgacaatcagtccctggatgattagatcacccctgtcttcagagatccactcccagacacaggagacagggaaagggagcccctgagcgacagccagctggcctccatcctgagtgtcccacggaatgcagagtcccaactaaacacagagcaccgctattggtgctggctcaaaacaactacatctaggctttccttttctgcatgagttctcccactcttgcccacgtacccaaaattgctgcatgcagactgtacagtgaggaaggggtttgttgccaagacccgaggtgaagaggaagaggagggtggccaccagcaggggcggcaggggcagcaggattccagcatgcagcccgcaccttcagcatcccccgccttgacttggagtctgatcctccctcctctcccctgcctctcccccaaccttttccctcttgatttgccccctctctttctctctttaccttttctacatcctctccctgagctttttctcacttactgccttctgccctcctgtcctctgtggtaaaatgcagttctatgtggctgagtgctttcagggaagcaactaggggtcatatctaacctttgtgaagtaactacgggtcatatctaaccagaaatggctccctcaaaacacaagatgtcccagtttcgagtctactcctcataatgaaaggagacaatcacaagggaaaattgttgaaggtcttggggaatcaagtctggaaaaggtaagcaagggagccatgacagctgccttcaaatatcaccagggtccagggagaggagcccacccccgggggcaaggcctccaaacccgctgtggtgtggctcatttgctgccaggccctcccactctcccagcactgcctcaagcatcgccctcgcattctactccaggtgttcattccctctggtaggaaacagctccatgcaaagaagccaacattcatcagctattcagtctgcaaatactcattgagtgagaactaaatgcagagcactgttataggtgctgggtcaacaaaactgcgtctaggggagagtcagacaagaggcaagtcaagaaatagatagcccagatcattttagatggtgatgagttgcacaaagaaaataaaggggacatgctaacaggactgctttgtgggccggcagccaggcaaggaagcaacactggaaatgaggcctggatgacaagaagccatctcaacgaagatttcaccccaaacacattggagagcctttggagggttttaatcaggcaggtgatgtgatatgatgtatctggaggagaatattcggcagctgtgtggagggtagcctggagaaccccagagtagaagcatgaggaccagttaggaggctgatgagcctggtcttatgtcaaatagtgtgctagattccctgccttcacagagccctcagtccagtgggggcacaattaccagatattttctctataatacaatgttgtgggcaaaagacaagcaaaggcagatgataagcacaagatgcccagagagtacagaaggcactttttgccgtcttattggctgtggtgtgggggagggggtagaggggagccggggggcaggggtagagggaaggagagagaaggaaagcttgcttggactaatgcccaagctgagttttcagagggcaagaattgcacttccatgtgcccagtgctgtgttaggcaataaaagaaatcagagaaacataggaagtaagggctcttgccctccagatttttagtttgctttatcttaaaacttgaaaggcttcttgtgttggccaagtcaaaatgatgagacctagccattctcacatcaggggcttctgatagtcattttgttgagcccagatccttctcctgagctccaagagcctgatgcacaggctggcatggcttggcttgtggtgtactggaagcctgcctgaaatatcctcctgagggcaaagtattgcacatatagcacccaaaagagtgttattggtgtcctttatcactcagtaatgcctttgcccagacagctttgtcaggctcatcattccagcagcagccagtgagcagaagagggaggtcagccccaaattggaaggggcctaaagtctactcttgatggaaatacatgaggaagatatgaacaggtgagctccctggaggatgtgacggttgagtcaggccatggtgtataagcaggtgttctagagccagagaagggcccaggtagcctagtgtctgcaacagagcagacacaaaaaaatgtttgtgaatgaagggatgaaaaggcacttcagacaaagagaacaagaggacagcaggagcaaaacccaagaagtttcaaagccgtggagaaactagagactgttctagagtggctggagaatagggcctctgggggtggacagatggtgacagtgagacagggcctccagaagcaacagggccaatccctgggctctgtggatctaacagtgcttgtgttcatttgcttgttccacgacaccagccacagtcacagggtctagtctctgtgtattcatgaagggactggagatcacttgtgcaaacagcacactatatacatgaaaaaactgaggctcagagaagggaagccattcgcccaaactcacagagccaagcagttgagctgggagtctaaccaagctcatttgattccaagtcaagggcccttgtcattgtccttaggtgccgctgactgatggattttgaccaaggttagcagcccttaaaatttttctagccatgatttaagttcaatttgtggttcagtgggctatttggaaacaaaattacagctggtgaatgttttcacaatagcaaatgtgctggacttttgctctcatcggttagttgttggtttttttgttgtttttttttttaacagattctaatactactatatatatcagaagtggtcccaaatcaaggtaagtgcatcaagggagtggcctagtttgcagaacagcttggtctagttcaaaggcctttagaggaagatattgcataacttcccttggttccttatcttacactggtcaactttaactatccaagccacccctaaatataacctcagtctgctttggtttaaaataatctatacctattgtgctgtggcagagggtgggtcagctacaatcgttacctcctgtctaaattattatcttactgttattgctaatgtttgttgagtgcttactctgcatcagatactgtgccaagtgctttccatgtgctatgagatgacctaatcttggccagtcgcatggcttacgcttgtaatcccagcactttgggaggccgaggcaggcagatcacgaggtcaggagatcgagaccatcctggctaacgcggtgaaaccccgtctctactaaaaatacaaaaaaattagcctggtgtggtggcgggcacctgtaaacccatctactcgggaggctgagacaggagaatggcgtgaatccgggaggcggagcttgcagtgagccaagatcgcgccactgcactccagcctgggagacagagcaagactccatctcaaaaaataaaaaaataaaaaaaggaaaaaaaggagatgacctaatcctctcaccaactctgggagaggggtgctgtggttatccccatgctactgatggggaaattgaggtttaaagattctaagtaacttgttcaaggtctcacagttagtaagtggcaatgctaggatttgaatacagaagcataacttctagcctcacactctcgactgctactctttagcaccaagggacatcctccttcctaccctctcactaagtgatgttctccttctagaccctgcaccaagttcccctctatccaactgaggtctctcagagcactaacactgggtgacacctgagtattcacctagtctaaaactttccaaaatagatgtttaaaattcctttgaattcttcaaaaataaagaaaacacagacccagagaggcaaagtgatttggccaaggtcatgcagtgagggaaggctttccccaaatgctctcacattctcattcacatttggtgatagaagccttccaggcttgggccattccaggactcccttccctgggtcacacattccttccttttctgccaatcccacttcacccccatcttcaggctctcccctcaaccccatctacaggcttctactttctcgcacactttccacacaactgcaattgtttcctttgatgggggtggtcagcaaagcttcaccccaagaccatgtgcccaggactcatcatttgtcacttgtcctgaatcccagcttcccatacactgtctccacatggcttcacagtaaataagccgaaagtcaaacccactctcctgcagtaaaaagccccctttcccacttttcctcacatctgtcttgcctgacctccagcagggtatctaacctttctaaaattcttcaattttgccacctggcctgcccctgctgctgaagaagatccagaggtggaacaggaattaaaagaaattaaagaatgtgtaagcagaaactcagttgtatgtaagaaaacccaattccccctgagaaggagaaagagctggagtcctttaaaaattaactgcctgtttttctgtagctagtgagccttatctttcctcctttcccaggcattatgaagacctgtttctctagctatgcagctgcaaggtcactagacaaataaactcaagtcataaaacgtgtttttccttgaaaagtaagaaatgatgtaacgcatgtctcaattaattgaaatccagtgtattacagttctagtacatctcacacatatgaccatgtttcaagtcctcagtagtcatgtatagatcgtggcaaccatattggaccctgaagccctagatcatttcagaaatggaatggggctggactagggtggtgataatggtggtgacaaggggtggtcagattatcaatacattttgaaggtggaaatgactttccagtgacttctgctgatttcatagttcagggctcagtcctttgaatgttaatccaactggaccggttcacctaaataattaataaatatcctcctcaaccccattggtctctcttattttttaaaatatcccgctacagagggagcagccacgggagggtctaccagagcccaaggctctgcccctgctgcctcttctgtgtgtatcttgatgttcccactaaacagggactggggctgacttctgatttcatgctccccatcagtgccagacctaactttagtggttggttggaggagtcaggggttggaggacagggaggtttccagtgacttccgctgatcagattgaattgcacttttcaccagggcccaacagctgtccctgaggccatgcttcttcatattttccctggggccagttatagagagtcaagccaacagacttatcaatttccacacatttattcatttaagaaatgtttatcaaacattgtcctagtgtcctcatgctactataacaaaatatagaatggataatttataaacaacacaaatttatttcccacagttctggaggctgagaagtccaagatcaaggtgctggcaggttcaggtgcctggtgagggctgctctctgcttccaaaatggcgccttgttgctgcttcctccagagaggaggagcactgtgtcctcacatggtggaaggtttaaaaggggaaaacttgcctcctcaagccctttcataatgcatcaacccattcaaaagggtggaggcatcatggcctaatcacctcctaaaccccaacctcttaatactcacattggggattaagtttcaacatgaatctcaacaggaacacaaatattcaactcatagcaaacaaccacctctttccaggcactgtgcttgtgctagtgattcacagtgattcagcacctgctctttaacaacctagtccatcagagaagatgaatattaaacaaataatcatggccatggatccagaatcacaaaagaagacaagagcaccaaaggagagcagcatggtcctacggtactgttaaacaaagaacctggcctggactagtgtggagagtctagtcagggaagtctcccctgaccctatgttggacagggcataatactcttctccctggtcacttgctccttgttcttcccaactcctttccatccctttccttctttaagaaaactaaagagagtgtttctcactatcccatgcccacagacatgcaaattctatatcatttcccccctttcaaagttctgccccaaattttatgaccatgtgtccactctttcaggtagcctaactggccccagtgcacccccaaagctgggtcactctctattctcccacaacatcgtatacttacttctgccaaaacatatatgacatggcatagggattcctcccgattcaggccttccgcaatcagagatgaacatttaagccaaggacttcttctttcatctctgtatccctagcatccagaccagtgtcttaggggaaaacttttggagtaatccttgatttttcaatttccaccttcaaaatgtattgataatctgaccaccccttgtcaccaccattaccaccaccctagtccagcctcattccatctctgaaacgatctagggcttcggggtccagtatggttgccatgatctatacatgactactgagcacttgaaacatggtcatatgtgaatctttggatttcaaagtcttaaaatgaaagaaaagaatgtaaactatctcaacaataattttatatagctgaagtaataatattttagatctattaggttaaccaaatgttattaaaattaattcccctttatttttacttttttaaatatggtttctagtaaagtttaagttatacatattatatttctcttagacaggattgccctggggaatctcttcttagctgatctcttagcttccatgcttgcctgtgctctataatctgttctccacgaaagcagccaaagtaatccttcaaagcataaatagaatcatttcgctcccctggtcaaaaccccccagtgtctccttagcacatttagaataaagtctaaagtcctccccatggtctataagctgctgttatctgcttcctgatacctacaggctcatattccccaccactccccatttcagtcactgtactccaggtatactggcttctgtgctactctttgagcaggtcaggtatgtgcccaccaagagccttggctactcactgccaggaactcttggcctctagatagctgcaagtcactcttcttcatttctttcagatttctgctcaaatgtataccctgaccaccccatcgaaaccaacatcaccttccttccctttccaccccaactctacttctctactttagttttcttcatataacttatcattaactactattgtatcaatatgatcacaccatgtcatatcatattatattatatcatatatacacatatatatgtatatatcatatatatacatatatatatgtttaaagacatatatatatgtgtgtgtatatatatatgtgtttaaagacaggatctttctatgttgcccaggctggaatgcaatagctattcacaagtgtaatcatagcacactacggcctcaaactcttggactcaagcaatcctctcgccccagcctcctgagtactggaactacaggcacatgccatgatggccagccatacaatatatttttatttgcttgtctatttatttattttctattctctcccaaataatatgcaagctctaagaggacaaggactttgtgtctttggtctctgatgctcagagaatatttgttgagtgagtgaatgaatgaatgaatggtggacattcaataaataattcgataaataaataattggtgatcaaatgaacaaatggggcaggagttctaagggatctaaatcagactgccagaagagcaggggtaaggtgtgatcaagtttgggaaccgcaggcatggaaagaaaaaagttcacagacactattcagaacttttcgtgagtgtgtttattaactcttactccccacgggcaaggctgggttttggtgagggaaagaaaagaccctcattgaggacattgctgggtaaaaagccttcagagagctacctactctttgtgggtgtggtaatgggcagccttcagcgcaatggctaccagggatatgaattcttgaaagtcgacctgttcatcttgattagcatccaggccttggaatatttcatcaatgacagctttatctttgatattctaggaaaaaaggacaacagagaccttgagttcagaacctccacacaagaccctttcttaggcctcttatccctcagagctcgggttgtgaaggcccaggcacattaactcattagccaacactgtgttggagaatccagtgtaacaaaacagagaacacaatggtcatgaaccaccctggaattaacaaggcttgacctggaaggtactcttctgctcactcattcaacccctcccgtgccctgcctctctccattttacatatgaggaaacagactcagagagaggaactgagtagagccttaagtgagttattgagagagggaagcaaaggacctctcccacagcagcggggagagcatcctttgggagctcaaactggggccaaccccaccccagtccttgtcccaccatcctctgccaggccttgccactcccctcagtgcagggtcatgggcaagtttgcagtgagaggggcatcacctaccttgatggtgtttgcaagctcctttgtaagcagctgcttcagctcacccttagagagggtgtcaaaatgccccttccgaactgagtattggtggaagatattgacaattccctccagatgctcttcaagttttgtcatcttcccagcctaatgttaaccttcaaggaaacaagggaagtctagaggcagtttctcccccacccctcaacctccactctcccctctctttctgaatcaagggcctaaagaaaacataacatcctccatatctattttgtggtctctgctctgtttgatccatggtgaacttctcatgtgtggataggatggggaggagaaaacatataatactgtctaacgtctaaaaaaatcagcctcagttgcccatgttccataccacctcatccaccggggtgcataacttggagggtattgcttactcaaggtcccttgggaagggttctgtgattggccaggctgtttgctttcctcaggtgatggcactatggccacatatcccccacaaatggtccataacccacccctgcttagccattctttttttgttgttgttgttttgggttttttgtttgtttgtttgtttgtttttgagacggagtctcactctgccgcccaggctggagtgcagtagggcgatctcggctcactgcaagttctgcctcccgggttcacgccattctcctgccccagcctcccgagtagctgggactacaggcacccgccaccacgcccggctaattttttgtatttttttagtagagacggggtttcaccatgttagccaggatggtctcgatctcctcacctcatgatccgcccgcctcggcctcccaaagtgctgggattacaggcgtgagccaccgtacccggcctgcttagccattcttaaatcatgggactgagtctacatagcacaacaagagctgatctacttgggtccaaaatgcaatatcaccccagaggtgctcaggcaagtggagggttgtggtttccaacaccttgtgatttcaaagtggtcacctgcagtcactaccctgtggaccacctaagaacccatccaaggaaaatgcacttacccctcaatgcacaggaatgtggagctacagcaaaaagccagcagtggtgaagggcactgagccaaggaaggttttataatcagttcaggcttcatcttagcccttgggtgaagaaatctctgattcatcttgaggcaatttatgtaaagtactctgttgctcaatagaagcttcaaacctgtggcttaggctgccacaggagcagcccagattgtacccagactgaattttgccctcctgctcagcctgaaacaaaatcacccccactccacccacccgcacaggggtgccctgaaccttttttagccctgagccagggcccaggtttcaggtttagctctactccactgctccctaataaaagactaggagaacaaactttacagcctgagtgtcttgttttaacagatgaggttaccagctcttcagttttggcaaatggaatatcaacttaaagatctttatgcagctaaggagataggtagggagacctcctcctaagtcgttctgggatgcaaagttcatcactggagcagaggatcagttttcaaaatagattccaaggttttcaaaaaaggagagagcaatgctactatgcctcccctttgctttcccaactttctaacttggctgttacaaagacctagaaagctggagtagggtaatcattgtgtgtgaagaaagttcaccatgcctaggttactttaccatgttcatgagttcagtaagacagaacattcacacgagttttagtaaagcaactttattactcacagagaggcagcaagggacaacagatgcccaggattcatggagaggtggtccttcaagattcagaaacctgcccaaaatggattaagtctcatctgtacattccccatgtcgcaccaaagctaagggacatccaaaagcactctgcccttggtttatgcctagaggtcaataagattgctgagcaatcaaggccatgccagaacctgtgctgccatctaccccacaacacagatatcccccttagcaaagctagttcatttcatgtgcccaccgacctctctggatctggaggcaaaagtctgtctctccgatccatgtgtcaccttgactgacacaatctcagtgcaacattgttaagccattgacagtatttgtttcactaggcccaggaggacaccaccagagcaggatgatcaggcttgtgtaaatcaatgacaatgaccaaggtgaatctcaatcattttaggaggtttatttggccaaagttaaggatgcgtgcccagaggtaggtctacgtctttctccaaagatgattttgagggcttcaatatttgaaggagaaacagtggatattgggggaagaggaagaaatattttttaaatgtgtcagtagataagagacaagtgattgcatccttttgagtctttgatcaatctttcactgaatacacaattttcatgtgggagcggagtagaggaaatagtcacttatgccttcatctggctcagtgaatctgcatttttacataagataacaaaaataggggagaggaagcaatcagatatggatttgtcttgggtgagcagagggatgactttatgttctgccctttgtcccacacctgtgaagataagctgtcaattacactgccagggtgaaattcaatagaactgttttagggtaaagatcttgaggctcacaaggaatttccttgtgggcaagttgtgagattggtgtatggctttttatctttgtagctatcttatttagaaaccaacctgggtgggggcaggcttgcatgacccatttcccagcttgacttttccctctggcttagtaagtttgggatcctgagatgttttttttttttcacatctgcctggagaagggactagcccaggatcccagccatccaggcaagaggttgctaaatgcggatcacgaggtcaggagatcgagaccatcctggctaagatggtgaaaccccatctctactaaaaatacaaaaaattagccaggcatggtggcaggcacctgtagtcccagatactcaggaggctgaggcaggagaatggcgtgaacccacaaggcggagcttgcagtgaaccgagatcgcgccactgcactccagcctgggcaacagagtgagactccctctcaaaaaaaaaaaatagaaatcaaaaaagcaggaacacagcctcacatacaaatattaacctccaatgtgaatggcctaaacactgcacttaaaacacataccttggcaaattcgatttaaaaacaagacccatccttctgctgtcttcaagcacctgtctcatgtgtaatgacacctgtagattcaaagtaaagggatggagaaagatctatcatgcaaacagaaaacaaaaaagagcagaggttgctattcttgaatcagatccgatagactgtaagccaacaacagtaaaaaaggataaagaagggcattacatagtgataaagggttcgatttaacaagaaaatttaaccatcctaaataaatacacacccaacactggagcacccagatttataaaataagtacttctgcatctaagaaaagattttggcagccacacaataatagcaggggacaacaccccactgacatcagtagacaaatcatcaaggcagaaaactaacaaagaaattatggacttaaatttgacacttgaccaattagacttaatagacatctatagaacaatgcacccaacaaccacagaatatatattattttcatctgcacatggaacatactctaagatcaaccacatgctcagtcataaggcaaatctcaataaattcaaaaaaatcaaaatcataccaagaatcttggaccgcagtggaataaaaatagaaatcaataccaagaggaactctcaaaaccacacaaataaatggaaactaaacaacttgttcctgacttttggttaaacaacaaaattaaggcagaaatcaaaaaattctttgaaacatacaaaaatagagacacaacacaacatatcaaaacatctggaatgtagcaaaagtagtgttaagagggaattttttttttcatcttggatgtgggcgaatctcattttaattgcaaaagacttcattcacagcacattcaataatggaccaacaggagagttgctggcttttgaacatatgaatatataaaaataccttgcaacttaggtagtcaagataataagtgcataaaaggaaagcaatcctcatttttctgaaaacttttacattttaaaaggtgactaggcatacttggaagttcaaagctgtagaatgtaccttgcaggggaagaaggaggaaaatcctttccatgtttttaggtaaatatataacaaatatatcccaattccacttgataaagtcagttgcatgacttccttgaaccaggctagggcagaacactcagtaaaagcaggccctgggtggggatgtgaatcctgaagaggagcaccagatcccacgcagcactaaacacatcagttttaccctctaacatagatgaggcacgccgccccatgaccctggacaggggatgcaggagaacagacatcaggtggttactgctcccactgcctggtgctttccaatggttttaagtcaggccatggagaaaatcctttaccaccaaacacaaactgccattgaacttgtcataaaggatgttatgggggaaattcttgaaacacatacataaggacttctatttacctaattagaaaaatgattacagaattggcattcctgttttcgtaagattttgttctctacattggaaaggtttaagaaaagttgtctatttttggttttattttacactttcaaaagagagggaacagagagaaacgtatgactaactgcccaactttggggtcccacaggtatgaaagcagacttctctgactctaggtccatctagatttgggggaagtttacattcctagggagggttagtgaagcctgttacacccccaatcctacagaaagtattctacagccaatctatcacagtgttctaacaaagcatatgttgaggaaaactacaggtttcaacctaacatctaaatcttaaaaagtagcacttcggcaacaaacaagcgcagagagctcacctgaaaagtgaaataacatgactattgctcagatatctgaaaagtcaagctgctgcccccagctccgcccactcaaaggcttaggcagacacctagggtggcggcggctccttggcagcacctagggtggcggcggctccttggcagcaccattcacagtggtatcatcataccggggtaggagcaccttagtgtcattgctggtaacataaaccaggacatcggaggagttcctgccgttcatctatctgcagcagttccaaacacagctaatcaagtaacccttaaaagttaagataatgctaataaacagaagaataataaggaccaaacaggtggattcactgacatgacatcatctctgtagggaaaattaggaggcagttgtcgtatgtattcctgaatggagtttggataaacaagcacagtgattgcaaccaaggtgttcagagcaaaatcaaagatctggtaacagggccaggtgcggtggctcacgcttgtaatcccagcactttgggaggccgaagggggtggatcaggaggtcaggagatggagaccacggtgaaaccccgtctctactaaaaatacaaaaaattagccgggcgtggtggctggcgcctgtagtcccagttactcggagaggctgaggcaggagaatggcgtgaacccgggaggtggagcttgcaatgaactgagatcgcaccactgcactccagcccgggcgacagagcgagactccgtctcggaaaaaaaaaaaaatctggtaacagaagaatgggatgatccagaatgcgtgttgcctgtatgcttcgtaattagccttaattacgtaattagccttaattctcatgatatcagtatcatgagaagagaaatcgcaatggcaatgcacgtattggcgtcatccatgaactcaaaatcacctcccagttcagaacttgaaaagtgatactgatccggatcagccagggcactcaacaaaatcaggagtaccacggcgttgatgatcaggtaccagacacctaacaggatggtgctggtgcggacatggaggcacaggcagcagctgttggagtagaaccgcatccagggtgcgaccagggcgtgaccatcgtcattgctcctggagcagaggcgcgaggacgagcccaagtttccaggagcgttgacctcctcgcccagactccgccacgcggctgctgcagactcctcggctgctccggcttccggcccgctcaccggtgtgcccgccagcctcgctcctctatcctcccaagagggaattttatagcgctaaatgcctatatcaagcggggtgggaggaggggggagagatagcattaggagatatacctaatgtaaatgacgagttaatgggtgcagcacaccaacatggcacatgtatacatatgtaacaaacctgcacattgtgcacatgtaccctagaacttaaagtataataaaaaatatatatatataaagaagatattaatagaaagatctcaaattaacaacccaacctccacctaaagtaattagaaaaacaagaacaactaagctcaaagctagcagaagaaaagaagtaactaaaataagagcagaactaagtgaattgagacccaaaaagccatacaaaggatcagtgaaaggaaaacttgcttttttgaaaggataaacaagattgatagaccattagctagattaacaaagaaaacgagagaagatcgaaataaacacaatcagaaatgacaaaggtgacattacaaccgattccacagaaatacaagagatcctcagagatatgaacctctctatgagtacaaactagaaaatctagaggaaatcaatacattcctggaaacacaacctcccaagactgagtcaagaagaaatagaatttctgaacagaccaataacaagtaatgaaaataaatcagtaataaaacacctaccaacaatagcaacaacaaaaaaccctgtatcagacggattcatagtcaaattctactagatctacaaagaagacctggtatcaatcctaaagaaactattacaaaaaatcaaggagggactcctccctaactcattctatgaaaccaatatcctcatgacaccaaaatttggcaaaggcacaacaaaaaaagaaaactacagaccaatatccctgatgagcatagacataaaactcttcaacaaaatactagaaaaccaaatacagcagcatatcaaaaagttgatttcccaaataagtgggctttattcctggaatgcagggatggttcaacatatgcaaataaatacatgtgattcaccacataaacagaattaaaaacaaaaactatatgatcatctcaatcaatgcagaaaagcattcaataaaaattcaacatttcttcatgatgaaagctctcaataaaatagacatcaaagaaacatacctcaaaataataagagccatctatgacaaacccacagttgacatcatactgaataagcataagttaggtgcattctgcctaagaactggaacaagacaaggatgtctactctcactattcctattcaacatagtactgaaagtcctagccagagcaattagacatgagaaagagataaaaggaacccaaattgaaaaagagcgaattacttcttttcactgacaatatgattctatgtccagaaaactctaaagattcttccaaaagactcctagacctgataaacaacttcagcaaatctcagaaaacaaaatcaacatagaaaaatcagtagcatttctatacaccaataatattcaagctgagaaccaaatcaaagatgcaattccatttacaacagccacacacaaaaaataaaatacctaagaaaatatctaaccagcaaagtgaaagacctctacaaaaagaactacaaaacactgctacaagaaatcatagatgacacaaacaaatgaaaaagcatgccatgctcatggattggaagaattgatatagttaataagtccacattgcccaaagcaatctatagattcaatgctattcctatcaaattaccaaggtcatttttcacacaactttacaaaactcgtctaaaattcatatagaagcaaaaagagcacaaatagccaaagcaatcttaagcaaaaaagaatataaccagaggtaccacattacccaatttcaaactacactacaagtctacagtaaccaaaacagcatggtattggtacaaaaatagacacatagaccaatggaacagcatggagaccactgaaataaaaccacatacctacaaccaactgaccttgaacaaggctggcaaaaataaacaatggggaaaggaaatcttattcaataaatggtgctggggaaactggctaaccatatgcagaagaatgaaactggacccttacctctcaccacatacaaaaattaactcaagatggattaaagacttaaatgttaagaccttaaactattaaaatcctggaagaaaacctaggaaatactcttctagacatgttctaggcaaagaatttatggttaagtcctcaaacgcaatgcaacaaaaacgaaaactgatatgggacctaattaaactaaaaagcttccacgcagtgaaagaaactaataacagagtaaacagacaatctacagaatgggaggcaatattcacaaactatgcatctgacaaagggctaatacccagaatctataaggaactcaaacaacttaacaagaagaaaacaaataaccccattaaaaagtgggcatagaacatgaacagacatttctcaaaaagaaacacaagtagccaacaaacatgcaaaaactaatcatcagagagatgtgaatcaaaaccacaagaaatatcatctcacatcagtcaggatgactattatttaaaagtcaaaaaaataacagttgttggcaaggttggagagaaaaaggaatgattatatactgttggtagaatgcaaattagttcagcattttggagatttctcaaagaactaaaaatagaattgccattcaacccatcaatcccgttactgagtatatacccaaaggaaaagacacctgcactagtatgtttatcaaagcactattcacattagcaaagacatggaatctacccaggtacctatcaatggtgggttggataaagaaaatgtagtacatatatgtcatatatgtcaatactatgaagcataaaaaagaacactatcatgtcctttgcagcaacatggatgcacctggaggccattacgctaagtgaattaatgtagaaacagaaaaccaaataccagaatttctcacttatatgtgagagctaaacactgagtacacacagacaaaaagatgggagtggtagacactggggattccaaaaggagggagggcaggaggggcaccagggttgaaaagttacctaacaggtactatgttcactatttgggcaatgagatcattcgcagcccaagcctcagcatcatgcaatatacccatgtaacaaacctgcacatgtatatcctgaatctaaaataattttttttttttacaaaaaggccaaagaaggatccttcagatggcctcactgtttgaaaccaacgggctgggtctgcctgtggatcccttcccctgtgtctgtacaatccctgaggtgtttactcaggtacagcaggaggtgttggcaacaaccaaaggccactctgctctgccagcagatgatcagaggctgttcaggtgttcatcaccagcttagttaatgcattcagtgagtctcactggtcctaaatagtccaggtggtagcattagttgtcactgacgtagtcaatgacaagttgggtaccatttttcccagggcatgtacacctatgccaagtaggaggacacagacagcaaaatggaatcagctatcagaatgccttcctggcagagtatgtcaggcaaccttgcaatgtcagaagcccttccagcttacggtgtcattttgcacaaacacttgaggaccccaaattccaaaacagcatgctctatctaagggtgacaggtattctgcagtatatcccacaaaggaatatactagccaggggagcacgtgtaactccggtcagggaactgtcactataaaagtctctagttgaagtgtacaaagcctgtgtcagatttagccatgagttacatggcaaggtaaactgcatgatgagcctgctttcccataccattgaccatgtttaaaatctgtctgattttatgtctatgttctaggtaacctgcattgaggccatcactctccaatcagaaccaccgatggctgttggggccccattcaaattggcaacaggccacagattgactattccagcatggagatgccctgagtacatgggtggctgattcagcagtgttttagatcacaggggaatttccaaatctaagactggaaggaaagctcctccgcccagggaagaagacagaattgttactggggcaacccctaagagtttagggcaatcaaaatgcccaatcctcttgctctatacatagggagattatctttgcctagaggattgctcacaccaggaaaaaactaccagtccttcaggccctgaggtgtgccaggtaaagtcctgggcaaggaaaagtggcccaagaaagaagctcatctggtacctcctctccctactcctcactctggacagcagagaccctataggggatgaggagaaagaggccaggcaggcaggcgaggaatggctgtcccatccacacccagggtggaaaacggctacaagagagcaccttcatgttttaattagggtctctttcttggagacagtagagatctgattctacctctgccacttgccagattcataagctttgtcaagtttctgagtctactcatgtacaaaatggaaatagtagttacctctctcatagggttgttatgagaaatgagataagttaccacaatgtcttgagctaaaaagcgaaatcattaacaaaataattggcctgtgtcaaaatttttgtttcaattcattaatgagagaaccagtgaggaagacttttttgaactggtttgaaagatattaagaatatgaaagacagttagaaagtaatgtctaagattcttaatttagacacaagactagatacaagtcttttgacttttcatagggtgacaaaaacaaaccataacagttttgggtttaatgtcttgaccagcctataaagccatattgccctatccatcagaggtaaactgtctacatcatctgttatgaattgctatcaaacatgctttgccgatcacttttctcaaaagtgtcagatgaggtctagtagcaaggaccttctttttttcagacagactctagcatgagatcaaaaatataagcaatcatcagtttgcctttttccaggtttgagatgattttttttctttcacactgacacatagctggagcccagtaagtgttggtagctttccctcccctcttcagcccatttcaatttagactgaattcccccaggcaggagggcagaaaatgggctgggttctggacccaatcaaaattgttctggttcccaagtggagggataaacaggaaaatcttttccattggaataaggccttttgctcagccactgtagaccgactgcccaagtccagattctctccatgccctttaagacttttgtcacaaccaccaggaacacacctgaagtcaggacacttgggcgaagaacttggaaggaaaagcaagacttcaaacaggtcatccttataggacccagaaatcatagttgccagatctgcttcaattggtgagccaagcactcctttgtgggctcaaatgttgcatgcgatttcctgctaaactacttatttctaaacttcccactcccttgttcttcttttgcagctggggaaacaggaaacaaagtcatcttgctctgggccacaagtcctgtctgattctgcccagtcagtgtggtttcggtaatgggcacggtcttgtttgtaaatcatcatctccaagcctgcgtcctctgggaagcttccaaggcctgcctctctcacttctcttctccagatggccagtgacagctgggccacctcccctgcccaactgtgcactcaagaatcaactgtcgacccaattcttcacaaccagtacccatcacttatggtgaaactccaaagggcaccgtgggccaccttcctcttctggtaggctcagaaaaagaagacttattggacttccaagtaatggcagacaactgagaatagtaactctccccaaaagaatccattgacagcaagtccaatagtgcactttcaaggggaatcaaaggcgctgggataggttgcccctcaccaccctgacacacacacacaccccaccaccaccactgccaccaccaatgtggatagctgaaaggcagaatcagggtactcgctccttttttgtactcctgttactatcttttctcttgtgagttcccctaaatgttgagttgacctgagatgtggcttggtgaaccctggaacctttcccaccttttttagcctgggccacattcaggtcagctgctcacctttgcactatatattggagaaaactatagcaagatcactgtggtgtctctcagagctccataatctccgtttctgcaatgcggagtgtattccacactcctgacttaagcagaagcactggcttgggaggatggatagatatccttcagcaaaactgagaagaaagtaatttaatgcctaggccttcctccttgccccagcagaagcccatctccacattctgatgactaaattttcccatcccatcttagatgccaatcttaactttcagctggctgccaaccattttcactaatatgttagctgataacacataaaattgactggtaattaaaaatattggtgaataagggcttaaactattacctttccctgctcatttatattttatatgattaaggcctactacaagaaaaagcccagtgacctgaactgagtaatcttcagcactggaaaccagttaatctgagtggcattttgctaatggtaggaaaagggtttgctcctcctgaaatcctagggaattggttacctcctcttctcctcttgagcatgaagcatgtctagcttctccaaagaacccctcccctccactatcccagagttagcttcctctcttcagcccatgatcctggggttccaagcacagtaattatcccagagagggtggaaggctccctgctgtatttagtaactcgccccgcaaagaatcaattgacagcaagtccaacagtgcacttccaaggggaatcaaaagcactgggataggttgcactcccgccctgacatacacacacacgtgcacagaccccaccataccccaccataagtactggtagctttttctcccctcttcagcccatttgaatttagactgaattcccctaggcaggagggcagaaaatgggctgggttctggacccaatcaaaattgttctggttccctagtggaggaataaacaggaaaatattttccattgaaataaggtcttttgttcagccactgtatactgtacttaggcaatggctggggcccttgtgcggtgcagagggacaccaagcagcttccatcttccaggccggggtgtatccttagcttcacagagcaggaaagctgtggaggactgtgggcagcagggtaggaactgatttagcccttggcaacaacacacgtccccacaaagcatacacccacccacccacccagcacaacaatagcaataaaaatactccaatctttggccaggtgtggtgtggatcacacctgtaatctcagcactttgggaggccaaggtaggaggatcgcttgagtccaggagtttgagactagcctgggcaacatagcaagtttccatctctacaaaaaaataatttaaaaattagccaagggcagtggctcatgcctgtagtcccagctactaaagaggctgaggtgggaggattacttgagcccaggtgttcgaggctacagtgagccatgatcatgccattgtactctagtccacgtgacagagcaagaccctgtgtctcaaaaaaaaaaaaaaaaaaagagagagagacagagagaaatactctgccatttgttactaaaaaccagtaagcaggacaagtgttcttaacctttttgaggtgttgggccttttcgagactctgatggaagccgtggaggaatgttctcagtgcgtcactcaaaatgatgcacacaacttcaacccaatttcagagatgtatagacagacaagttaagaaccctggtttagtgattctggtgacagcttcctacctttttacccatcactaacaccactgccccagcacctaagtgaggacaacagaaaattccccacaccacagcatgaaaatccagtttggggtgacattcttgtcaaaaggttccccttcattttcttctttttttaatgtccacctcagagaagaaccactcgtcttctggccttccccttgtaccagcccttgggaagtattttttagataattttctgatcaccaaagcatagaatcccatagggcagcgtatgaataacctattctttgacttaagttttactaatttattttcctatttgcctattcctttatcatttaattgagttgggagtttgggagtggagagggaggaaaaattttcaaaatccccaaggacaaactacaggtatgtggacaggtgtgaggattatcctgttaatggaggactctgaacattgtccacctacatcacaccacacacacaatcagcctctccccccttccctctcttgctctctttctgtctgtctctctctcacacacacacacacagacacacacacacacacccacacacttctatgtagctatcactctaatttcccaagagccacatctaagacatttagctggaagctaaaatttagcttagagaacagtatcagttgttcttatactaccaccctgttcccaaatccccgacccatttcagaaccactagtaaaatcatcagctatagtgtcatggactttttggaatccttaagcctcaaatccaatggctcaagatggaggggctggaagggaatgtggggcagaggccaggtgaggggtaaagcaggaaaggcttgtgagaggtagggtgggataacatagatttctttttcttcctttgggttttccaaccctccctccacaccgaggaacctcattccacaaaagcataagagagaggcatgaggtattgatgactttattattctgcaggtacatgtccaggggcccagcctctgggcccagtaactcagctactctttgtggctttcttcatggctttttttgtgggctgccacgcccatctttatcaccagaatgaggaactcctggaagttaactgcaccatcagtgttgatatccaactctttgaaccagacgtctgcaccctttttctgtcaagattgaggaggaagaagccagagtttaaagatctcagagagagccgaggcatagccatctatgaagggtggcagggaggaccgctggcccagggcagccccaggaccaggcagagagcccccgccacacccagcccctcctcaccctgatatactgaggacactcggtctctagcaatttcttcaggtcatccctgtagacggcatggaaattcccctttatcagggagtacttgtggtagacgtcgatgatagagttcaaggctttctccagctcggtcaacatgatgcccacggacttgccccacctgaaaaacagaaccttctggggaatcccatggcagggaatttgcatctggccagggcagtacgcagaggattcatgccccaagcgatggccttgtcctggcctgcactctccaaataaccaaaccagcagatggctatggctctggtgggaagggtgggatgatagggatacacgtgtgggaaggggaagggtccattcacacagagacatgtgcacacacacggggcccgtagactttccttaccaccccaccctctgctcaagaaaagtccagcctaggagacaatgtgcccttacccactggaaggtgctggaggatactctccttccttatccctgcctcactccccacctccaggagtatctttgctccagacctccctgagctttctctctcctctctcaggaaggctgctccacttccctgaccctccccaagagaagcccaaagtgcggggccaacccagacagtcccacttaccaggtcttctgaaagacagctgacaagagacatgcagggctgagaggcagctcctttttatagcggttaggcttggccagctgcccacagcttcaggccatcagagacagcttctccctgccagagttgctacagtctctggtttctcaaccaggtgaatgtggcaatcactgtgcagaatgaaaattttgggtggggaggtaggagaagcggaaagaggaaggcatttgctgggcaatagtgcccagaaggaaaaagcaggtaggggggctctttttctgggctgctggcatccacttgcttgatccagccagattcccactcccatgccctctccactattgcgattgctaatcccctgcattggtggtcaggccatacatccctgaaactgaattgaagttgaatgcatcattttgagtgcatgcactcagtgagaacattcctccatggcttctgtcagagtttcaaagggtccaaagaccgcaaaagggttgagaacacgtgtcctggctgatggcttttagtcatgagaactattgttctcattactaaaaactaaaactatcgttgttgttcttttgggtgggtgctttgtggggaaatgtgttgttgccaagggctatatccattcctaccctgctgcccacactcctccacagctttcctgttctgtgaagctggggatggaccatgccctgggagatggaggctgcttggggtccctcggcacttcacaagggcctgagccattgcataaacacagcagggagcctttcaccctctcttggttaattattgtgtctgggaccccaggatcactggctgaagagaggaagctaactctgaggtagtggaggggaagagttctttggagaagccagacgcgcttcatgcctaagaggagaagaggaggtggccaattccccaggatttcaggaggaacaaatcctctccccaccactaacaaaatgctactcagattaactggcttccaaccttgaagactgtggtgtgtttctgttgttacaaagaaaatatttgtaaaacaaatatctgataagggattaatatccagaatataaaagaatccctacaactcaacaacaaaaaacaaacaaaccaatcaaaaattggggaaaagactcaaatagacacttctccgaagaagatatacaaatggtcaataagcatatgaaaattactaatctttaggaaaacatgaagcaaaacgacaatgagataccacctgacacctacaaggatgactactacttcttttaaaacccagaaaacaagtgttggtgagggcatagagaattggaagcctaatgcactgttagtgggaatgtaaaatagtgcagctgttatggaaaacggcaagtttgttcctcaaataaataaacacagaattaccatatgatccatcattctgctcctgggtatatatgcaaaagaattgaatgcagggattcaaacagatgtttgtacattcatgttcatagcagcattatttacaagagccaaaaggtggaagcaacccaagtgtccctcaacacatgaatggatgaagaaaatgttttgtggggacatgtgttgttgccgagggctaaatccattcctaccctgctgcccacactcctccacagctctcctgttctgtgaagctggggatccaccgtgccctgggagatggaggctgcttggggtccctctgcattgcacaagggcatgagccattgcataaacatagcagggagtctttcaccctccaaaataaatccagctctctctggatgtgagccattggggacccagcacagtgcccagcacacacaataacagcagccacaatcactgatcagagcaaatcatgacaaaatactagttcacactcactgagcttttcccatgtccgggaactattctaagtgctgctttatttgcattgatcatttaattctcacactaatccaatgacgtatgtactattataatgcccattgtacagatgaggaaactaagccccacagagagacatagtaattcagcgtatcaaatgattgagtgactcatgatgtgatgtgacagcatccacttcctattcctgcctgtaatgccttttgtccctgtaatgtcctcctcaccattcctgatccagctcaggcatcatctgctccaagtccatccctgatccacctgccctcaccccatcaaggcagaattagttcttctctcctccatgctacccaaatccttacccatcacagcatttgccctgctatgttatgattcacttgtttattgtctgtcttttctttgggaccaggagaccatttagaaaagaaatcacatttcttttcacaaccctagggcctggcagctactacatgttcaattaatacttattgagggataaatgaatacaaaattaagtttgacccttcccttatccaaggcagaaattctctttatcacaatcagccatcttaaatcatttctggaagaaggcagggtataaattcatcaaacaaatgcagtctgacttccttgacaaaagatgaatcaagctccatctaggaaaacaacgccatttctgacatgacaagttttcaaccaaggatccacccttggttaatacctattattcaccacgtactatcctatgtgaccagcataacagcacctgcctcaaagcaccatatcatattttcaaagtattttgcatccactgactcatttgatattcccagcaacctagtgatgtggacattacaagtataattatccctatttgacagatggggaaactgaggcacagggcattacttcaggtccttcccctggtccagtgagggagtcctgagtggtgacctccttcccacatcatgtacaggctgaccagcaagatcgtgaaatgtcgccccctccccagaaactgcgcccctggacagccttgggtgctttggggacagcaggagccaggctgaactgaccttgcagcaaaaggtatcaggacttgggtaagcacatctggggaaaggcagaggctgtaagcagcctagcggacatggggcaacctagagggagcggaacctggtcatgtttacaggaaagggctcagtccctgggtgtgtcccaacagacctgacaggtccatccctgaggccaaggaaatgaggacagagcaggcagagctggtgaagaaacccccagaagggggcaggagagggcagggagggctcaggctgggtgcccctgcttcgtactcaatgcctgtggagcccagcacttctcaggtgagacaggtatttctcccctgggcctgcaagaagagtggccaaagtaactcaggcgatggtcttcatgcctctagacacagccaggggcctgcaggaaggagcacagatctaggtcatcaattccagccccacaggccccaattctgcattccttccccaaacacctgctgagcgtttatggggacactgaggtcctgtctcggcggagagtacaaaacaagcacagtgtggcagaagatgcccttccacaggaaagaatgcaaaggggaatggggtgcagacatctcccaaggaatggagggcccagctaggtcctgaaaggcaaactaagctgatggcaagtgtgggagggacagcaggccaggcccggagcagcaggggcaaattctgccccagagcctgactgatgagaaacaaggtctccagctcagctccagggacaatccaccatgtttggcgcaaaggaccaggtggggagggaaccagaccaagtttcttaagtgaccctgcagtcctgtgcgcaggtggtatatcaccccccaacactctttcaaaatccatgatttctatctcagtaagctcaggacaccggttcccagaccaaccctcagaaaagacaaccctctaaagtgggctctggcatttcctgaaggcagaggagaccctccctaagggattctgcattagatccctagagtcccaggggagaggaaaaggaaaaagaaacagagcaagggcagggacaggtctcaggtgggtggggtcagggataccggaggactcagatcagtggttcatgaatagccctgggtcaggagtaaccctcacatccatcatcatgttgtagaaaaaaacagacccaacccttctctccctcaggaagccttcctgggttgactgtcacccaggttctactcattgctcttcccttaacatgtgtctgtggttctgccaggctggattgttggctcagctcctgtcagtgtctgactcagcatgtgcaaacccagcacacaatattccctgcagactggctcccacccaggcaccgaggtcccatgccaatcgccagcacctgaaacctccacctcattctggatcctcctctccctcagtctgcgcccaggtctggaccttgatgttctgccttttctgatgccgcctccctcccttccgtccccatgaagctgtttacctcctcgtcacagcctctagccaggctgtgcaggtctgatctgtcttcctccaccccaaacccctaccactagtttcctaaagcacagagctggtcccagggccctcgccccttccccacacttaacaactaaggatcccttaccaaaaggataaagtccaaattccaatgctcagttttcagggacttccagactctggtcctaacccacccattcaagctgacttcctactgttttctccatgaacactaatttccaagcaaaatttctgttgctcctagacatactttatgattttctactgttgttccctctgctagaaatgcacctgcctcccgatcctggtctcttcccaggctcagccccacccttgttcactgattcttggggctctctttcagagcagggatgctgtcggagcggcatgttagttcacccctaccctcacccctgtgctaccacctgtgtggtgggtgagtgagtgaccacaagcgaggcctcgctatctccccaagagaggagactcttccttctcaggctgaacactgcgggtggggactgtctccctatcagatagggccccctggaatcagaggtggtgtctctcccatccaatataaactccctagaggaataagctgtgtctcctcctcagacagggactccctggagataggagctgtgtctccccctcaaaaaggggctccctggagatagaagctgtttcttcccctcagacaggggctccctggaggcaagggctatttcgttgatctaaaatggatctttcccagcttgggaccgaaacttctttttctggattgtaggtgaagcccagaaccatatactgacaaatccttggaaatatgtatgaaattgctttattctctctcacattgatgtcctttccacagacatgtacacacatgtgcacacacacacagggacacacacagacacacacagctgtgttctccattcagctcctgatatcaaggtcacacctcctcctgggtccggcaccggtgggcaggaggctgcctgagctccctctagtagaggctgtgttgggcacagtagcgggcacacagctgctggtggtagtgcaggtggtagtccttcaccagcttgcccaagatgtagaggaactcatcgaagcagatctggttgtccttgttcttgtctgcggcctggaacaactctgtgatatagtatggctccttccggccctgagaagtgggcagagcatcaacaacccacccaggcatacagcccacctgccaggctccccactgcccactgggaggggatggggtaactgtggcctggccttgcctgcaaggaaatgactcctcactccaatcgtcagtgactaggactctgaatgctgcaaagagacaggggcatagttggtgcccctagttggtgcccccataaccgagcctggagctagctgcatgtgtgcagacaaaggaggtaaactgggcaccattgatggtttactgtctgcagtgcccgagaagcactagcatcccagacgacttcgcatccactggcagtagctgtttatacttctcttcacagctgaactggaggctcctctggagaaacaccccagccagggcttcctcaaggcagggcagtgccttcctcctccacactgggagctccccaagagcagagtcgacctggccctcgagtctgcatccccagcgctgctgcaaggctggtgcccagggggtcagaggtttgcatgcctgtgcatttgcctgcatcaggagcaattcccaggcagatggtcagcatgcgaacctctgaacccctgggtgctgggcccacatagagcgcagaacaagggaaaggacaaagccaggagccctggagctgtccaggttgttccgaggcaggcggcccagatgtgaccctgagggctgagaaatggggatggtaggggagaggaaagaggcatttgaggtggaaggaacagcatgaagaaagtcaggggccagagcacagcacggggacagagtgggaagagacaaggtgggcatcgggagcactgggcagggcgggtgaggcagctttcagcaagatttggctggtgggcatgaggaccagtgtgaagccctagaaaccatctgggggaagcagctgtggacaggtttgcagcctctctctcccctcagggcccacccccaccacctgttcctgtgatcttaactgttccacaaagctggttacccagagaggagctggaggcttcctgcccgggacaggctctcccagcttccctcacctcggcccaccttccccagggccgccttctgtgtccaggttctatccccgcaagggccccgtacccaggcggggctgtgacccccatgagtgcagggtccgggccatcctggtacagtttgccctggaaaggacaaggtttcctggaaacaggaccaccaacaatcacttccccctcactccgtccctctctacaaccctcagagtaacactccagtaagcagaggcaaggctggggagatgggaagtgactgaagaagagccttttcctggatggagtggccttgagtcaggatggaccagaagtcctctggagatgacagtccagacaccccagggcatggatagacagcagcaccccacagacacccttgcaggccccaaggagcccagtaatcatgggtctacgtttgatgacaaagaagatgggcagggcctgagggctgtctaagcccggatttgggtgctgggcctgtccaggtctgagagactctggggataagaggtggaaggggaagtaatgtttcctaaccccaccccaccctactcccaccctggttaggggggccaccgcagtccctgctatccttcccccgggcatggatcccacctctcttcctgctgccaccacactgtgccaccctctccagagggagtccccatgccatcagcaccatcccttcagccctcacattcccatggccctcccagagcctctgtgcagctcctctctggtgctctgatgcctgtgacctcccactccccacttcctctggagatgagacaagatcaccctgtcagatcagcagtgctccctggactctacagataggaatcaggacaactgctgcttccaccgctcatggagccagccaggcaccaggtaagcactttatacaaattatcccgtatcccacgtaaccctcacgtgggccatagaaagcaagcatatttacccccagtttcctaagggggaaatgaaacccagagaggataagtaatttccccaagatcacacaatgatccacttggagcttcgttcaaacccatgtctttgggaacaagcccaaaggcatgctttcagttccagtcctacacccgccttgggccacgattgtgctgttgggatgcccatccacactgtacgtgttctccaaacaggtaaactgtccccacctctgctttttagaacctgcacagatccaacacaaaccctcacccccacaattctcttggaagaggcactgacctgtcactgttggggtgagtatccaaatccacagatccagcctgtagttgatcccagagattccccaacgctcaggcaggaggcacctgtgtgagccgcgaacccaccaccaagccccacatcccacccatcctcaatgcctccaattatggcagccagtgttgtgatgcttcacaggtccttcaggagcaggactgagccttaattgcattcctgaggtgacatcacaacacttaacttgctaagattaactcaaccagtttcaggggcccacatcccttggagcaggatctgaagcatctaagaatcacaaaaggtcccattatctgtctccctgcctcagagcttgtcctctcagctccagggcttgggtggggtcagacacacacttaactacatctccctggggtgtcctccctccattagtgaacccccaaactccactgtcatgaagcacattcattccttcattcattcaacgaatattcttgagtacctacagtgtgccaggccttctgctaggcaatatgcatcagatacagggccagctcacagggtggggacatgtgaggggacagtcacacactgtcactaggcacatggaagccaactgagtgacacagacaggtgctccaggcacccagaaagggacaccttccacctggggagttgggggggacttccttagggaggcgatatttcagctgcgacttgaagagacattttgagttgcaaggaggaaaggagaaccaggcactctagacagaggatatggcacaggcaaaggcccggggctgtaaaagagcgcggccccctcaggggatggagtccacagggtgcacaatgagaagttagaagaaacaaggctggagaggcaggagggagacaagaccggaagaccctgtgccaagctacaactgtgactttatcctatccagctcatagtctgtcagtggaggcagacatctagccaaaactccaaggtactgtacttagaaaagcaccacagacttggtgccaaacacgcatctcccacctcacaacccccactacccatggccagggcaagactgtgatacacaaacaagagaggaagctaatagaggattttttaaatcagttgggtgatggacgggaggtgaaagagaagtggtagaaccagatttgtttactagtaaatcaccgactgcaatgtggaagtcaccctactctgagaggggccagaccttcaggctcgacatccctacagatgctacctgggcccctgagtgagtgacaggtggggtcccctctgccaactcaccccaacacaagacttctcccagccggccccttctacttggccccatttcaccccacacagctcccttgggagggcctgcacaggctgatgactgaatcttccagaatggggcgccaaagggcaggtcatcaaaccagagactccatctatgcatctctgaaggctggagagaaaatcataggtagataccgaagccaacagcttttccagtttgctgggtgagccttcatctactcaacataaagatttccccagcaaacaagtggttcatcaatacactttcctgtttctaaactaaaaacatggcttgaatttctcagcattgccaagctagagctacaaaaaattgtatcgaattctttggttcagccatcattaccctggcaatttctcccaaaacaattaattaaacagatattttaaaaatcatcaggaaaatgtccaccattgcaatatccataaccaagaaacaaaaataaaagcaaaaccttaaaactatctaattaacaaatttggtatacccatatggcttactgttggacaattgctggataacagcttgttgtttagaagaaacttcatttctgacctatggctggggatggggggcagactgcactccttttcaccctaccttttgttcactctgggacaaaacagccccctacgccatgccaatacccagtgatgatcccttgcacagctgcgctgtaactgcactttttgcttaatgttatgctgtggacatctcacatgcttaatcaatgctagcctgatttttggcgagtacatagcgatcatctgtttgcatttatcaaaatttgtcttatgaatccattattgttagacattaaattacttttatttatacattttaatgtcaactcttccttaatgtttatcagaattttgccacgtgttaggtgctaggtgcacctgtgctaggtgctgtggagaaagggggcggaaatgaattgaataacattctgccttccagaaactcatagtctgtaggtggagacagacatttggccaaaacttcaggttactgtacttagaaaagaaccataaacatggtgccaagcatgcatctcccatgtcacaacccaaccacccatggccaggactaagattgtgatcttgacaaacacagtcttcatgtctttccagtgtgcagaccagacactgaaaacaatgtcccgtgacatccagaagccagtacagcaaaggagtagcgctttctggtgaaattgagaaaggaggttacccgaaactggccctgaagcacccccatccccgcttcggccgcacccagggttttagacacctcaagaattggaaatacttcaagcaggataatattcaatttctgactaagagggcggtgaggtggtggtgaagaggatcaagtaattaccttaaaaattaaagaaatctcatatggtacttgagacgatgaatcgggttatactgatggaatatttagggatttttgccagttcttaccagtgtatatctattttcttttttccagaccttttttatctttaggattagagcaacctgatatcccagtcaacagcctcaagagtatctgaaatgtgtgttagatgggctgtgcttgaagggggagctgctagatgcattagaatcctcacagaaaatgtgataaagagaaagaaagggtacattattgccgtgtagagaaaaagaataggatttgagcatagggagtccctaggctgcttctgtaggaccaggaggctgctggagagtgagaagatgattaacagtattaagttcttcctctttgctgagcactgctccatgggctttacatccacccattcatctcatcttcttaacaattgctgaaaaagcccaaggaatgacaattacaggagcatgctggggacacagctagtaatgcagaggcacatttctaacccaggcccatgggccccacatacctgttctcaaccactacattaccttgtccccgaataacaggaaatccaaccttagggagagcaggagaagggccccatggttagaggaaagagctggaacagaggtgctcaggtaggagccagcctgggctgacagaggggcagaaagaagggctggagtggtgtaaatggagcccagaaagacaggagatgaggtctgaggggcaggcagaggacaagccaacgaggactttgcaaaatttggactttaagcaggatgggaagccactaaaagtttttagtaagggatatgccatgttcatagcagctttacatgctattgtaaagctgatagttctcccaaacgtaacctatagattcagtgcaatcccagtcccaaagtccttgctggaatttttgtagaaattgacaagttaactgtaaaaagtatatagacaggccaagaatagccaagggaatcatgaaaaagaaaagacatgggaggatctacagtactagatgttaagatttatcataacagctccggtaactaagatactgcctggctggttcaaggacagtcacatagatcaacagaactaaatagaggtctgagaaaaagacacacacgtatggtatatttattctgtgacaaaagtggcactgctgagcacaagcttttcaatacattttactggatcaactggatgctcatgctcatgaaactagaccacacaagcagacaaaatgacaattccaagtggattgtaggtctaactgtggaaagtaaagtcataaagcctcagtagcatatgcaaagatattcaagacctcagtcttgaagatttacttctatattttcttctaagagttttagttttagctcttatgtgtagggctgtgacctattctgagttaatttgtgtgtatgaaggaaggaaggggtccagcttcattattttgcatgtggctgtccacttgtcccagcatcatgtgttggaaagactattctttctccattgaattggcttggcgggcttgttgaaaatcaattgactgtgaatgtgaaggctgagaacactttatcatgaactgttagcttcacctatgtaaagatatcttctctctgctctacctcctgtcgaaatctgacacgactcttgctcaaaacaagctttgtttcctgagttccgtggccttgtctcatgtggagcaatcatgtcacattaaccccctccccacccccactccacgtccaccctgtgggccacggccctgccctttcccagctgttttatgatctgctttttcaattaggactatgtttaaaacatctccccagttcttaaatatttttgagtgattgattccaaatagctacattatatggaattccagaaccattctgactaacaacacttttgacgccaaatgtgtgggggttatatttcctttttttaaaatccccacaccaaccaattctccaacactctgaacaccatcggggtatcgtgcaattccgttctgatcctaactaccaagagttagcacagaccccacaaggtgaaggctcagccccacaacactgcccccactgcagatgccaatcgcagcacctgaccgcccatacttctgactgactggctaaaattggaggttcctacaaaccccctcctcaggttagataatctgctacaagagttcacaggactcagggaggcactttactcatgattactggtttattacaaagagtacaactcaggaaaagccacgtggaagagacacacagggccatgtatgaggggcagcatggagctcccaggcccactccaggagcccacccttccggcaccccacctgctcagcagccctacagttctctgaaccccatcgtttggggtttctatggcagtcacttcatttaggcatagttgattaaataattggccactggtgattgaagtccttccccagccgctctgtggaggcccagtgtggggctgaaagctccagccctctaatcacatggttgcttcctctggcaaccagccccatcctgaagctatctaggggtccaccaagagtcacctcattagcacacactcagcatgactggaaggggattgttatgaataacaaaagatgctccctctcccctgtcattcaggagattccaaggatttcagacgctcggtgtcaggaacagggacaaagaccaaatgtccatttcgtatcatcacagggattccatgtgtataggcatcaagatttacttaacccaccattactaaaaatttaattatttttatctcttcctgtttctaccacttgattaacaattgtgtccccaatatactattttatgcagtgtcctctggtaagcattggagagagaaaagaatacaaattaagtaagaaaagccctctgcctttcagaagcttttggtgaagatctctttttttaacaggtgcaagattggtgcccgacgtgggactcacaacctacagaagggcgggaaccacgaaggacccagccacgtggtactgcctccggcgacaaccagggcgaggtgggtgctcggtggcgccaccgtgtggaagcttgggaaacagaaaaccaattctctgcactcagggccagagttttgtcctgggcctctgactggggccaactgtaacaggaacagcccttacagtgtaagtcagaatcctacagtcctccttggccaaggagccttcctggagtcccccccaccccgcactgctttctccagcttgccagttttacctacacggcccagcctcgtcttaaaattgggcgagatgaggaatgatcattgccaacttgaaatttggttgaacagatacatttctcagggtacgcttgggtcacttcctagcactgtctgtgtatgcggcctccgagaaagcaacctcccttatcaggctaacagaattgacagtaaatcctcccagcaaacccattcgacaggatggtgggtgttagtccaaactgcaccattttgtaagccccctgccattttgcggaccctggtcagagtgaaacattccatgtggattcaggccgtgagaaacatcctgcctaaccacctgaccgcaaggcacaagagcatccttatcataccctgctgggcaaaggcgcaactgaaggaacatccccatcatatcctgcggggcaaaggtccaagaaacagcctatcacatcccgctggaaaaaggtccaaaccgcctgatcacaggaacatcttatcaatatcctcccggcgagctagccatactgcccagacccccacctagacctataaattaccccagcctgtaagcggcagggggctctggcattaagcttgtcccccacctcctcaggtcttgtgctggacataaaacctgcatttccatagagccaccaactctctctgtgtctttttttaacccttgccttcccttcaaaacctaacagtgggaccacaggctctgggctgcagctgggtgttctcatcctccagtgtggatggctcacagcagaactgagtcctaataacctcttgtgaatgctgcagaactctctctctgtctctctgtcccgctcccccaactgctgcacgagtccagagatgcagctggccagcaccacccagaaggaccccaaacagaacagctggctgtcttggaacattcccgtggctccctctgccctgtccctctcaccgtggctcctggaagtgctctatggcctattgaaaggatgcccctacaaagcttcccctggttcccccacctgaaaagtgatttctcctcttccaaattcccacacactttatctgaacctttttgaagacacctgcctcacttgctagtttggccaatgtttatggagttctctgcactggaggctgggggcacaatataagacatggctgggcggcagcaaacatagcatatgtgtggccagggctgtcactgagacatgcagggacatggggatgatggctctgcctggagaaggcttcacagagaaagtgaccactgaactgcctggggacctgggggcttccgggctctgtcccactctactctctcaccacccagtgccttatattggagttctctcctggggccagagcattgctcaaagcatggtccacatccactccatctccctgccaccctgacacctgcacacccagaacagagtcagcactcacagcataaatgaatggataaaatacagcaaaaagaacaaattgctttctgtcctcttcccccagcaacttgagatcttctagagacccaggagtatgttgcttctacttcaggctggggagaggcgagctccccaaaacgatagaggagatgaagatatcaaccagccaaattcctgttcacaatcagcctgttgtgagctctcctgggggatcagcagtggctgggaggttggatgtgtgataggatggggtgggtttatggagagtgtttgttccagacatgacacaggggaaaggctcacagggttcaacctgatgagcaggtgcaaaagataaggcccctattaaagctaatttgctaagattttgattttagcaaaaacaaatgatcagttttttggatgtctcaaatatgtttgatatttttggagaggttccaagatggccgaataggaacagctccagtctacagctcccagcgaagcagaagacaggtgatttctgcatttccaactgaggtaccgggttcatctcactggggcttgtcagacagtgggagcaatacagtggatgcagcccacagagcatgagctgaagcagggtgagcatcacctcacccaggaagcacaaggggccagggaatacttttcatagccaagggaagccgtgacagacggcacctggaaaatcaggtcactcccaccctaatactgtgctttttcagtggtcttagcaaacagcacaccaggagatcatatcccgtgcctggctcggacagtcccacactcacagagcctcgctcactgctagcacagcagtgtgatatcaaactgcacggcggcagtgaggctgggggcagggtgcccgccatttctgaggcttgagtaggtaaacaaagcagccaggaagcgcgaactgggtggagcccaccacagctaaaggaggtctgcctgcctcggtagactccacctctgtgggcagggcatagctgaacaaaaggcagcagaaacttctgcaggcttaagcgtccctgtttgacagctttgaagagagtagtggttctccaagcacggagtttgagatctgagaactgacagactgcctcctcaagtgggtccttgacccccaagcagcctaactgggaggtacctcccagcaggggccaactgacacctcatacagccaggtgcccctctgagacaaagcttccagaggaacaatcaggaaccaacatttgccattctgcaatatttgctgttctgcagcctccgctggtgacacccaggcaaacagggtctggagtggacctccagcaaattccaacagacctgcagctgagggtcctgactgttagaaggaaaactaacaaacagaaaggacatccacgccaaaactccatctgtacgtcaccatcataaaagaccaaaggtagataaaaccacaaagatggggagaagccagagcagaaaagctgaaaactctaaaaatcagagcacctcttctcctccaaaggaacgcagctcctcaccagcaacggaacaaagttggatggagaatgactttgacgagttgagagaagaaggcttcagatgatcagtaataacaaacttctccgagctaaaggagtttgttcaaacccatcgcaaagaagctaaaaactttgaaaaaaagattaaatgaatggctaactagaatagacagcatagagaagaccttaaatgacctgatggagctgaaaaccatggcacgagaactacatgactcatgcacaagcttcagtagccaatttgatcaacaggaagaaagggtagcagtgattgcagatcaaatgaatgaaatgaagtgagaagagaagtttagagaaaaaagagtaaaaagaaatggacaaagcctccaagaaatatgggactatgtgaaaagaccaaatctaagtctgcttggtgtacatgaaagtgaggaggagaatggaaccaagctggaaaacagtctgcaggatattatccaggagaacttccccaatctagcaaggcaggctaacattcaaattcaggaaatacagagagggccacaaagatactcctcgaaaagagcaactacaagacacataattgtcagattcaccaaagttgaaatgaaggaaaaaatcttaagggcagccagagagaaagctcagggtacccacaaagggaagcccatcacactaacagaggatctcttggcagaaactctacaagccagaagagagtcggggccaatattcaacattcttaaagaaaagaattttcaacccagaatttcatatccagccaaattaagcttcataagtggaggagaaataaaatcctttacagacaagcaaatgctgagagattttgtcaccaccaggcctgccttacaagagctcctgaaggaagcactaaacatggaaaggaacaaccgttaccagccactacaaaaacatgccaaactgtaaagaccattgatgctaggaagaaactgcatcaactaacgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggagacctatctcaggtggagagatacacataggctcaaaataaagggatgaaggaagacctaccaagcaaaaggaaagcaaaaaaaagcagtgcttgcaatcctagtctctgataaaacagactttaaaccaacaaagaacagacgcgacaaagaaggccattacatagtggtaaaggggtcaattcaacaagaagagctaactatcctaaatatatatgcacccaatacaggaacacccagattcataaagcaagtccatagagacctacaaagagacttagactcccacacaataataatgggagactttaataccccactgtcaacattagacagatcaataagacagaaagttaacaaggatatccagctctgcaccaagcagacctaatagacatctacagaactctccaccccacatcaacagaatatgcattcttctcagcaccacgtcacatttattccatcacatttattccaaaaattaccacatagttgcaagtaaagcactcctcagcaaatgtaaaagaacagaagttataacaaactgtctctcagaccacagtgcaatcaaactagaactcaggattaagaatctcactcaaaaccactcaactacatggaaactgaacaacctcctcctgaatgactactgggtacataatgaaatgaaggcagaaataaagatgctctttgaaaccaatatgaacaaagacacaacataccagaatctctgggacacattcaaagcagtctgtagagggaaatttatagcactaaatgcccacaggtgaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaacccttcaaaaaatcaatgaatccaggagctggttttttgaaaagattaacaaaattgatagaccactagcaagactaataaagaagaaaagagagaagaatcaaatagacgcaataaaaaatgacaaaggggatatcaccaccgatcccacagaaagacaaactaccattagagaatactgtaaacacttctatgcaaataagctagaaaatctagaagaaatgcataaattcctggacacatacaccctcccaagactaaacccagaaaaagttgaattcctgaatagaccaataacaggttctgaaattgaggcaataattaatagcctaccaaccaaaaaaagtccaagaccagatgaattcacaaccgaattctaccagagctacaaagaggaaatggtaccattccttctgaaactattccaatcaatagaaaaagagggaatcctccctaactcattttatgaggccagcatcatcctgataccaaagcctggcagagacacaacaaaaaaaaagagaatattagaccaatatccctgatgaatatcagtgggaaaatcctcaataaaatactggcaaaccaaatccagcagcacatcaaaaagcttatccaccgtgatcaagtgggcttaatccctgggatgcaaggattcaacatacgcaaatcattaaatgtaatccgtcatataaacagaaccaaagataaaatccacatgattatctcaatagatgcagaaaaggcctttgacaaaattcaacagcccttcatgctaaaaactctcaataaattcggtattgatgggacacatctcaaaataataagagctatttatgacaaacccacagccagtatcatactaaatgggcaaaaactggaagcattccctttgaaaactggtgcaagacagggatgccctctctcactactcctattcaacatagtgttggaagttctggccagggcaatcaggcaggagaaagaaataaagggtattcaattaggaaaagaggaagtcaaattgtccctgtttgcagatgacatgattgtatatctagaaaatcccatcgcctcagcccaaaatctccttaagctgataagcaacttcagcaaagtctcaggatacaaaatcaatgtacaaaaatcacaagcattcttatacaacaataacagacaaacacagagccaaatcatgagtgaactcccattcacaattgcttcaaagagaataaaatacctaggaatccaacttacaagggatgcgaacaacctcttcaaggagaactacaaaccactgctcaacgaaataagagaggacacaaacaaatggaagaacattccatgctcatggataggaagaatcaatattgtgaaaatggccatactgcccaaggtaatttgtagattcaatgccatccccatcaagctaccaatgactttcttcacagaattgggaaaaaactactttaaaattcatatggaaccaaaaaagagccctcattgccaagacaatcctaagccaaaagaacaaagtgggaggcatcacactacctgacttcaaactatactacaaggctacagtaatcaaaacagcatggtactggtaccaaaacagaggtatagagcaatgtaacagaacagagccctcagaaataataccacacaactacaaccatctgatctttgacaaacctgacaaaaacaagaaatggggaaaggattccctatttaataaatggtgctgggaaaactggctaacccatatgtagaaagctgaaactggatcccttccttacaccttacacaaaaattaaatcaagatggattaaagacttaaatgttagacctaaaaccatagaaaccctagaaggaaacctaggcaataccattcaggacataggcatgggcaaagacttcatgtctaaaacaccaaaagcaatggcaacaaaagccaaaattgacaaatgggatctaattaaactaaagagcttctgcatagcaaaagaaactaccatcagagtgaacaggcaacctacagaatgggagaaaatttttgcaacctactcatctgacgaagggctaatatccagaatctacaatgaactcaaacaaatttacaagaaaaaaacaaacaaccccatcaaaaagtgggcaaaggatatgaacagacacttctcaaaagatgacatttatgcagccaaaagacacatgaaaaaatgctcatcactggccatcagagaaatgcaaatcaaaactacaatgagataccatctcacaccagttagaatggcgatcattaaaaagtcaggaaacaacagatgctggggaggatgtggagaaataggaacagttttacactgttggtgggactgtaaactagttcaaccattgtggaagacagtgtggcgattcctcaaggatctagaactagaaataccattatatgacccagccatcatattactgggtatatacccaagggattataaatcatgctgctataaagacacatgcacacgtatgtttattgcagcactattcacaatagcaaagacttggaaccaacccaaatgtccatcaatgatagactggattaagaaaatgtggcacatatacaccatggaatactatgcagccataaaaaaggatgagttcatgtcctttgtagggacacggatgaagctggaaaccatcattctcagcagactatcgcaaggatagaaaaccaaacatcacatgttctcactcataggtgggaattgaacaatgagaacacctggacacaagaaggggaacatcacacatcagggcctgtcgtgaggttggggcagcggggagagatagcattaggagatatacctaatgtaaatgacgagttaatgggtgcagcacaccaacatggcacatgtatacatatgtaacaagactgcacgctgtgcacatgtaccctagaactgaaagtataataataatttttgtaaaaacgttaattatctaatacagattatataattaatttaataaagaacctcaatacaaaaaaagaaatttatatgtattctctatggtcaggcacaaatttatgaatgcacgtgtatataaataaatttaagtgtgtccttcaaatattttgtatcaggaatcagcaaattatggtcttaaagccaaatccagctggccaaccaattctggagattagtgtttactagaaacagctgtcttcatccacggggcccttatgtccagggctgcttctgggctgtggcagcatctgcccgccctgctctgcaccattactggtgttttgttatctgacgactctgttgagttcctgggcagactctgccagaaactgccaagtgatataaatttgtcagttttcattaatttatttcaatgtttgctttgtataattcaatattatgttcttgtgtatataaggataagactattgccaggtgcagtggctcacaactgtaatcccagcactttgggaggccgagatgagtggatcgcttgaggtcaggagttcgagaccagcccggccaacatgatgaaaccccatttctattaaaaatacaaaaattagctggatatagtggcaggcgcctataatcccagctactcagaaggccgaggcaggagaatcgcttgaacctaggaggaggagattgcagcgagccaagatgacaccactgcactctaacctgggctgcaagagcaaaagtgtgtctcataaaaaagaaaaaacaagaaagaaaaaaaagataagactattgcatcttggtgacttgcacactaatcaataggaaatattcttctttttcatttaatcccttttcttagaattctttgttgtcttgtattaatattgttgtccctgattccttttgtattgcatttcttctgttccttttttttataaacagtgatgatatgtaactcaaaatgaatcatagacctacatgcaaaacataatattacaaaactcctagatggtagcataagaggaaatttgatcatcttggttttggtgatgactttttagatgcaacaccaaggcacaatccatgaaagaaataattcataagctggacttctttaaaatttaacatttctgctttgtgaaagatattgtcaagagaatgaaaagataagccacagactgggagaaaatatttacaaaagacatatcagactttgtatgttatccaaaacgtacaaagaactcttaaaactcagagataagaacacaaaccaaacaattagaaaatgggccaaagaccttaacagacatctcatcaaagaagatacagaaggtgacaaataagcatatcagctgatgctccacatcatatgtcctcaaggaaatgcaaattaaaacaacaatgagataccagtacacacttatgagaatgcccaaaatctggaacactgacagcaccaaatgctaaagaaggatgtggagcaacaggaactctcattcattgatggcaggaacacaaaatagtacagccacttgggaagacagtttggtgctttcttaaaaaactaaacatactcttaccataggatccagaaatcacactcttcgggatttacccaaaagaactgaaagcttatgtccacacaaaaacctgcatacacatgtatatgaacacattgcacagtggtgaagtccgggcttttaatgcagccatcctaaataacacgcattgtacccactaagaaatgtctcctccttcacccaccacctgacctcctgctcttcactgtctccagtgtctatgattctactctctctctacctccatctgtatgcatgatgtacctcccacttacacatgagggtgcacagtgtttgactttctttttctgagtaatttcacttaagataatagcctccagttccatccatgttgctgcaaaagtcatcatttcattctttttatggttgagtagtattcgtctgtgtgtgtgtgtatgtgtgcgtttgtgtgtgtgtttgtgtgtgtgtgcgtgtgtgtgtgtgtgtgtatcttttgccgctaaaagtaatattgccgtcatatgggaaactgggagagggagaaacaggtccccctggttacataagaactgacagagaaggaagttgaagaaagatgatgggtggagaaaataggtcccacctagggagacatcacatcagctctatggagccccagagtgcttaaagggctggcactaaatgaaccaggacctcttgcggcctacaaggaacattgtaagggggtagcagaaaaagtccatttcagtgattcatcatctccttttcctcaccatgccccagggactcctgtgccttcccaaccctcttgcccctacctggttcaggctttccacagcaggttagggcacattatagccaagggcacaactcccaactcctacacaggctgttttgcataggaggaggaaaaacactgaagactttctgggaagttagtgccatggggcaggaaagaacttttcccactccctacctccaggctcattccatggggcggggggggcgggggtcactccaccactcaacctagatagtgaggcccctgaccccagtccccccacctaaatccagggcttctgtgaggggctgaccaatggttagcaatgaagtaatcctgcttccctccctggactttgagttcccatagggcagaccctgatgcaacccaagacctatagcacaggggataagagtaaggatttgattcaggcttttctttgttcgtgtgatgatttgttgtgtttactagctgagtaaacttgggaacatctcaacttctcctttcctaaaatagagattgcagcacctgcttcttaagactatgaggggagggttgaggaggatgcaagagcagcaggtgtcttgatgtctagacattaaaacgctcagtaagcggtgggggtcatagaacaggctgtcacaacaaatgtgtggaagtactgggggagggaataaacaagaccatgctgcctttgggagtctgaaactccattctctttgggtccagaggcccagtgctcttttctcccatttcctgacctgttactacacatgtaccgctgccttaccctcaaatcaagattgagccagagaaggccccaggtgaggtctctggggtggggtgggacctggtgacctgggaccctggccagaaatcctgagcacagcctcctgggtgtgtcccacacacctgatatgggacaagcctccaagaaacagatgacagaggtggccccaggcctcccaacccgtgggaagagccaggctgagccttataaaggactgctctttgtccaaacacacacatctcactcatccttctactcgtgacacttcccagttctggtaagtctcacctgcctctttgcattttctagaagtgcccagtgcccagcctgccatgctgcctgtaggaagggaaagggctgtggacaaagtctcagaagcctgggtctaggccagctctgccattagctgggctgtgtgaccttcacttgaccccaaaagcccacgtctgtacaaccaggtggctgaaccagacctgtccattgctcctttgggatctcctgagacaactcctgtggaaatgtccccagtgggacctgagcacaggaccctccctttccttcctgtcttcttcctccctggattcattctccttttgggatcccagttgctgaatcccctccccagctctgcccccacagagggaggagggataaggatcccctgtgaatgctttggaggctctccaaacccccaggccttggacctgtaaattctcagtcaatctctgggcacagggcttggcctctggccttggccttggcctcagattcagaaagctttgagtggcttctcttagtcagttgctggcacggagctttctcctgcgttgagaggtgttgggggtttattgtcagatgcccacatgcgttagccaaggtccttttctggttctttggaaagtgtagaaatgagagctgcactgtcttatttttcaggcttggggtgcagggcagcccaggctggctactggctggaagatctgctttggaaagtcagacatttttatttaaacagggtcaacccttggtgattcagagggtgcagatatttcccaagagcagacatgaagcgactcccacctcactcccaccccatccagcagcttaagaaccagggagttatttctgttccttgtaacagaggcaattcttgtttctcattcccaagggaatgtaggaagggccccctgtcctcgggagagggctgtgtttcctgctcacactcatgtccacgctcacatgtgcacctggagcctgcacgcactgtgtcatgcagggcttgcacttgagtcaaggtggggcccacggtgtctggttcctgaagcagccgaggagggtcagacaccagatcaccaaggccattgtcctgcccccgtgactctcaccccgactgtgaagctggaggagatggatttggtgctgtttcaagagtggggtccgccatgtgctggttgaggctggggggtcccagcttagttcttctatgtgttgctggcctccgactctccctgcttctccttctctgaagcactgtccacagctggacttctgccatccacctgcatctcttcttggccctggccaggatgggccgggtctcagacttggtcctaccctctcatttttgaacaacttatcccatcacatttaaaaaaatcaagttccttctgctccatcttagggctgtttttactctgtcctcagccctccttctaacacccccacatagagaccttaattcaaactaaggtaagaaatgattgtctttatttcctgaaggctttttgaaagcaaagatgagcaacactcaagctgagaggtccataataggcatgatcgacatgtttcacaaatacaccggacgtgatggcaagattgagaagccaagcctgctgacgatgatgaaggagaacttccccaatttcctcagtgcctgtgtgagttggggtctagcttctcaatgttggttggaccctggcatggctgaggatacattttgctatgtggccttggacaggtcaccctcatcctctgattaaaaagtttcccatttgcaaatagggctttattgcttggatcatatgtgaatctaaggatggtaggcgaaaaagtatgaaaatgggaaagagttatacagatataaaggaggttattagatggtcagcaaagtgtgcagcttgaggacagtgcacagtcccctcccagcgctcactgaccctctctctgtgagactgaaactcacatgctcaggtcctgcttcccaaaggccccacatcaacatccctgagattactgggaaagcactagaagttccattgctagtagaaatcaatagccctctttgcaataaagaaaactcattggcaaatctgaaaaaacctgtgggctactaggtaccaaagggtctagatgaccaagagtagggaacccagaagatgagtttggtggaaaaggagaagaaaggagaggaggtcagagaaagaagagaacaaagcatgagggccaattttgaggccctggggtagaactaaggtaggcagtgcccttaaatgctgggaacaggcaagattgaggctggggcaggggactgctctccccaaggtcacttaacagagtgcctcgggacaggacctgcctcccatcctgaggtgtgagacaaaaagtctccttagagaactccagggataacactcacgtcctcaccccaacttcacccactcaccctgtgctctcagccccacgaccatgcctgtgcagatctaggtacttgtctgtatctctgcctcctcctctcccctcccagcccaaaacttgtttgtgattgaatttttctattttgtatgtttttctcttcacaggacaaaaagggcatacattacctcgccactgtctttgagaaaaaggacaagaatgaggataagaagattgatttttctgagtttctgtccttgctgggagacatagccgcagactaccacaagcagagccatggagcggcgccctgttctgggggaagccagtgatccagccccaccaaggggcctccagagaccccaggaacaataagtgtctcctcccaccagacacttgccttatttcttcttctctttggtgacctacattgtcaaaactaccaattccaggttaactttgttggagaatttcccccacccccatccagtgggtcacccaggagtaatgtccctccagcaacgttccccctatggcctccagcagagctgatctgcctctcacacaggtcctggtgtctgcctctgcaccgttccctaaatgcagccaccttggcaggttccaggtggaagttggtagaaggcccctgccaggtcacagcaatgctctccttgtcaaggcatggaccagggtcattcagacacattcagatactgcactgagaaggagctggcatctctcagtgtgctcctgccctcccactcctgccccagctgttctccagggcttggggaaacagaaaccactcacatagggattcctggatggcttcaggttcagcgcccttggggctatgaatgggaggctcagcagtgccctgaggatgggcttccttgtcctgtggcctctgctccaggggcagtgtcctttccctgtgctgtgtgcttgtgtgcatgtgcctatgtgggtgaccctgtggaagtgagaaggagtcactgtgatgcttagctgtcctaaatgatggtttgctcaatgccaggactgggtttctggtgatgaatgaatattccagattttgaggagctctaagtggtccaggagtccaagtaagcagtctggctggaataaggcagcatcacggaaattctgtaaggactgacacagagagctcatgctgactgtgatgagaaattgcagcacctctatctcgcaggtaatggagtagtttgttattggtagtctactccaggccaggcagtgtgttatgggctgaggatgcagaaacaggcaggacacagtgctgtcctagcagtgcactggcgggtctctccatgcaggccacaacacagggtcagtgttcacctggtgtcacttccaggcaatgttctgtgcagccgctcttagtattcttccttgaggctcacatcatgtgtccctatcactcttactactctggtcagtctccagctaacctctcaatcaggcaaacattcttcttggaggaatcaggcaaacatctcaaaaattctctttccatcctaccagcagcagtgtgtaagatgggctatttgttctttggaatgactgctccactccacactcacacctctattcacagaccagcatctcctctccttatcaggaacattccttcctgaacatattctgcacctcgtcagccttcaggactgatctgccattttcacctctaaatccccatgtctgaccattagttttcttctctttccttctctccctttctcattctcattccacctgttcttggaactcacggagacctacagtccctgggctttcattttctcctcccagccccctgctgccttctctatgcagcctgccctccatcatccaccccagaattgctctctttcctctcttagctctgttgcccactttccttgggccataccttccctgcagatctccagcccagaaccatcttcccctgttgtcctcctctctcctccaccgggactgctggtcactgcttagaaccgtcatgccagggtcccaaaagtgtgggtgcctgacttcctctctgtgcagcactctctgaatccctcctattcaccttgctgctgttattccccgaatgcgcaacataccccccatcaatatatctcagtatttcatgtctcaataccaatcttttaaactactgcctctaccagaaatgtcttttaatacttcttctgtctcattaacattacatttcaaggctgagctttaatgtcagtgtctcttagacattcagagggtgaaccaccatcccttcaccccaaagaaatgatctctgcttcatttgtgcctccctcaccatgaccccactcttaccatagtggctacattacttcagattcccctaatgtctttccagccagacttggaatcatggagggaaaacattgttacctcggatctcctggttacccagcacatagtagtactggattccagctcataataagtactctatatcatttttcaatataaaatgtatttgtgcaaattctagtcaatactactttatgtaaacagcagtgtaaaatccaaaaacttccagtcctggaggcaggttgtgcagcttaggggaggaccccagaatctggaccccagagtctggaagcaggccagaaaggataaggcaaatgactgaacagttccctcaggactcacgtactgatctcccaaaagaagagagggtctccctggggtggggttgctggaccttcaatccatcgctacagtccagaaggcaattggccactcctaatgtgggcctgccctccctttatttttccagttcttatttcacctgataatattccgtccaattggcaatggcacataaaaattaggatggagtgtgtggacaaatacttcttcatcttcttgtctaggttttagaaatcaccttctcaagggagccttgtctaatgttcctgagactatttcacactctccatgcttatgtcaatgcaggactcatcacatctattcggatattctgtttacacacccatgtcatcccagagaggtgatcacagggcagggacacatgtgtggcatacagttcctagttaagatcccaaatcctgagatattgctgatttgctatggcaggtcgtcaagagaactgtgtcattccaaactcaccaaggtggcttatagaacagaagcagatggatatgaagaggagaggggaccagaccatctccgcaaccacagcccagagctccagtcaccagatagaaaattgatttgatttcatccaatattccttcgaaagagtgtcaaggaatagggtggggcaatgtgtcattctgcattggaaggaggacattttagagcaaggcctaagggcacaggtattagtgtcatattgatcagaattcaacctttgttctaacacatactagagcaagaatttacttgatttggaataattaatagctactggacattatattggtactaaagagaaagaatacttgacagctctatgcccacactcacattacagctgatgtgaaagagattctggaaatccaaatgttccccagaaattctgatatcaaaacattccaataacttttttttttcaggcgcagtctcactctgtcgcccgggctggagtgctgtgagctgtccgtggtgctgaattcactgtgacgtcactcctgtctctctttgctttcttctgactgacatttattcagccttctctacaggaatctcttatgttcccccacatgcaggtggtttttcagtaggctcctgaagagtgatctcaactttccaggaagaaaagagggcaaagggaacaatgtgaaaagaagcagaaaatcataaaagaccatgtgtttgataaacaaccagattgtttctggttccctgccactataaaaacaccatgagagcatactcatacatgttcccttataaatctgcgaggtagtttctttggtattcttgcccaggaaatgggttgattcatcacagattttatatatatacttttttttaactaagtgtgagataatatcttattgtttttgtaacttgcattttacaagagttctgaccagcaccagataagcttcagtgctctcctttctttggccttaatattattggattaaagaattactgcctctcactaggagcatcatttatttaccattattttcaatttcatattaaaactcaatttctagtagagtctttggtttccttggtttatttttctatttaaatattttttatcttttattattctttaccatgttttgaagtaaattaaagcagttaatatgagccaatcaacttctttgggaattacatagaagagcatgagagcctttatttcaggcaatgcaacaacgtaactttaaagaaatttaaagtggaactccaactcatatccacattgctctatgcacagttagcattattacatccgagctacatttacttcataatctgctgccacagtatttgtctacccacttctccacgaataccttccctaacctcatattgcctcccactccttaacaccacaaacaatactatggggaacatcattatatatatttccttatgtatctgtgtgaatattttttggaatatatatatatatattccaaaaagtagactacctgggacacagactctatgtgctcttggcttgactattgttttcttaccaacagtaccaagagttcctatagctcagcattactgccaatatgtctgcttctggttatggaatactttcatagcagactaattatcctaacaaaacatagaaaacgtggatgaaaatcagaaaattttctgcttcaaagcatcaaaaagctaccaagtaaccaggacttgaaggctctggttatccaagagaaagaagactcgatcaatgcactcaaaattaaagctgcttctcttcctgaggaatttatcatttctcaagtagtttgtacaaagaagttaaaaaccaaacagaaagtaacttctaagagacaaagaagattatttgcgactttaatagtcattcagggctggtgagattaaaatcagtgttgaggacttccaacacagccagaacttgaaaagccaagaatttagataaaagagaagcaacaaatggtgagttgattactctaattttctccctttgaggcatgcgtcttttcacaagttgcacaggacaagaggtacagaccatcagaaaatctttgttaaaaacctaaatagctagtaagagcctttaggagataaacatcaaagctcagaggatttccaaggtagaggtacccttctaaacattccaggatttcagttagaacacctaaagtgctactcctaggaataagtatatggatcagaaatataaatcctaaaatttagttttgaatcaactttatcctagattggatttaaatgatctgctacttgaattcctttccagaagctaaagaaaattctctagagggagagaaaatcatccatatcctgaaataaaaaaaattcatttttaatgttcagcattcaaaaaagccaagtacaccaacagagaagataaaaataggaaatggaaataagagaagacaatagaagatgtaaacaaaccgagagatgataagccaggcacagaaagataaatatcacatgttttcactcatctgtgggagctaaaaaaaaaaaaagttggtctcatggaggtagggagaatgatggttactagaggctgggaaaggtgagtgggtggggtgaagggagattggctaaacaaatagaaacatctagctatatagaaggaataagatctaatgttttatggcagaatagggcaactatagttaacaagagtgtattgtatatttcaaaatagctagaagagaagatttcatatgttctcaccacatagaaatgataaatacttgaggtgattgatgccctaaataccatgacttgatcattatacattctgtgcatgtaacaaaatgtcacccatgtaccccataagtatgtaacaatattagacatccataaaaattttttaaatactgtaaatggaagcagagaattgagaagattgcagaggagagtgaagtcaaaataattatttaaggtcagacaaataacagtgtatttgtatagaatgaaaagaccagaaaacagaaaaaaaatgatggtgcataagaaaaagaggagaatttctgtagagggtgtttgaaaaaagcaaggaggatgggatgtagtgaaagaggatggatagacatctgctgggaacataaaaagttcatagtagtggggggaaggcagagtgtatggccactgattctgataagagggtagatggggtaattgaagtatgcaaatactctcttatttgtattgaatgtgcagttggattagtggtcatgaatttgaagtgtgaccagtcaacaaggtaagcacatttttctccagacttgtttatctgcagaagtgtagacagagttggatttacccagtgttggcaatgatcattcatagctgatacagaagaaaaagacacccagacatgtactcttgatagtagacaaccccacatttgaagcaatctgctttaaaaaacctgaaccctgaagatgcttaaggctctagatctaccgagttacaaagggaagagagaggctgagtaatctgttcattgacaccacatggatgcaatcaggaactccacactgtaggaaattctacaggacaaatgacccagtttctacaacaacaacatcaaaatgaaaggagaaaaagaagaaattgagagtgaagctgcacatttaaaaatcttggctgagtgcagtgtctcacgcctgtaatcccagcactttgggagactgaggcgggtggatcaagtgggtaatcctaattaaatatttgttaaatcaaaaataataattcctggccctgcacagtggttcacacctctaatcctagcactttgggaggccaaggtagaggatcccttcagcccagcagcttgagactaaccagggcaacatagtgagacctccatctctacaaaaaataaaaaattagccaggcatggtggcatgtgcctggaatcccagttacataagaggctgaatcagaaggattacttgagctaagaaggtcgaggctgcagtgagccatgaccctcagcctgctgcactccagcctcagcaacagagcatgaccctgtctcaaataataataatcattccgaaataagggacataatttttaaggagagttaaaaggctgaaaaaataatagcatacaagccagaatgggagtctctgaatttaaagtgaattatttacattgtttaggaggagaatagagatattgattaactctagtctagtatatattgcaagttaaaatttcaaaggtaaccacaaaaattgtgtgcctgtgtgtgtttgtgtgtgtatgtccaaacctataaaagatggggataaccacataaaaaagaacaaaatgtggctcacgtctgtaatcccagctctttgggggaccgaggtgggcacattccttgaagtcaggatccaggcagatcagctggagaccagcctggacaacatggcaaaacattgtctctcctaaaaatgcaaaaattagccaggcatggtcgcagccacctgtaatcccagctacttgagaggctgaggtaggagaatcacctgaacccaagaggcaggggttacaatgagccaagatcacaccactgcattccagcctgggcaacagaacaagactctgtctcaaaaaaagaaaaaaaaagaaaaaaaaagaaagaaagaacgaagtagctaatcaagaatcaactgtgttgccaacatgcatatttaaagagaaaaaggaaaagaacccagcaaccagagcaggggaccagtttactggctcttggtgtctgctgagccagggcctgggtggacagcccatgggctgggctgggctgagatggggctgggtcatccataacctttagaacagggcttctggccatgggactgatggtgtaattccttagcaactgcagcaacactggagacaaactcagaaaaattgatcttctcctcatgattcttgtccttcttaaacaacttttccaagaaatctgggctctttttttttttcctgtggggagaagatatcaaacaaaaggaaggttataacctggggctggactgggattgtgagaaggagatggcagaagctaaggggaaatatgtagcgggtgaggtgggggttttaggagggtggggttgggacagccgtaatggatgggatggggagccctaaccctggcgttttaattggtgactcttggttcaaatgagagcatgcatagcagatccaaaaattctgaggccaggtctgtctgtgccccttggaatgcctgatattcattctacatgggcaaacaccctttggactccagtctcaaaattccctccactcctcatcatcccatcaaaatacaccaattctgaatcccctccttgtcggagctcactctctgtgattcaatctgttgcattatttgtgccagtgaggtcagtgggtgctaatggtttaatggtgaagttagatgttatagtgagtggaaatcaaaaactctccagggttttagggctgcctcatttcacttggcattatgattctgtggtgtcactactgctcccaggggtacatgaaaagaagcttccagaaggagcagacgaacccagagttgaatctaaagggggaaatttttttacagacagaagagagatactttaagccaggagaccttctctcgacccacaagtcacatagcctgctgactgtctaataacaatcgttaacaccactatccctcttcccatcttacaaaacatcgcacatgttttacctcatttaaatgttcataacaatcccaggaaataagtgacattgtccccatttttacatctaaggtaactaacactccctgagttggtgtttacgtatttgtaacaatgaaataagtaaacagcaggggctgtgcaggaaatcggttcttctcaccccatcctggactctgtctactgcccaccttccattcaggagtagaggtgcaggtggctggggggaggtgtgagatgctcgccagcctgccacatcggtgcctctccatgtgctggttctcaggccagtcagggccatgggtgccgtgcactcctgccccactcccacccagccgctgggtccctgctcacaaggctgataggaaggtgggggaaatgcatgacgttggacatccagatctgcccatggcatctgaatctcgggtgtatttgtgacataggttgagcaagcccttcagctgctcctcagctcccatgtccagtaagctgcaggaaagggcgccggtcgcctggcttgctttccaacgtctaagactgtggggaacagggatgagaggagacaggataggcagggaatggagtgagggccggtgctgcagggaaggtgagaggcagccctgagaaggagcaaaaggaatctgataatccttcagtccaggtgaaatccagaggagggaataaatgtttgaggagagggaggggaagtcatggaaattgtaagacccagggtgggatgtgtgggcagagggaggagggggtcggctgcaggagtggaagaatgaggtggtagcgtctgagggatcctgaatttaaggtgctggggaaagtaggagtccgcctagggatctattactgctgaaatcagcagtgagaccttccagcaaaacactgacatgaagaaaggcacgatcaccccctcgctttcccagagctctgggatctcagataaaatataaagaacccaggtggtgccccgtctgtgtggagctactgacaggtcagcaatcaacagcccaggggaggcctgagcgaccccactccatgtgtctcctggacctctgggctcaagtcctcttacgatgctccagggggcactggagggctctgccaatccctgcacatttgtaccgtccctgtgctcccaaccctgggcccagggctgggagcaagggggaattaagggaacagtacaaacatgaaggattcactctggacctctccagtgcctcagagcatcttgaagagacctgagcccaggaagctgcgaaatgaacaaaccactcagtagaaagaaggactgcagcaggtagaggcggtgctgggaatcctggacttggctctggcctcatgggtctacagagacattctctgcagtagctcttctgtgaagctccttggtgtcacaagaccaccaaaagtcagaacagaaaggatatagattatctagtccagcccctcactgcccaaaagaagatgctgaggcctggagggagaggatgaatgacttccctgcaggttgcacaggccagtcagggacaagctgtaacttgaacccaggcatcctgactcccagcccagggccttcctcctgacataaataggcagcaagcaggatggagcattgtgccttaaacatagaagcacaagggcacacggggactcaccagaccctgcagagaaggcctagaggagggtaaatgggagaagggtgtcagatggagagcagtgcctttgatggtgctcagatttaggctgggaccaggactgggtgcctggggcttattccatcagctgcctcaacaggatgctggtccgggtgggaactcagccgacactgccctgggactcagttgtgcctgcccagcgaggccccagcagagtcctcttgcctttctaagtcctatggggctggaacggtgggtgatgacagagggaatgtgagagtgctgctgtgcccccaggacatagggcatttggggatttgcaggtggaatcagagtccctgattatgtatccaatgaatcatttgaggagctttcattacctgtcagtaatgtaaacgcagctgtcatttgtgacaggttaccacatgccaggcagtctgctaagagctttgcatgcatggtctcatttaattatcaggagaatcctgtgtgatgggtattattatctcagtttacagacgtgaacagagagtttagctagatttgccaagagtacacccttagaaagtggcaaagccaggatttgaacccaagtcctactgactccgaagcccagcttctagccatctgtggaaatccagggtctgtgctgtcagtcttggctgagcatggagttaccctgccccgcaggagccactgtccagtgcagtgcacagtagaggaaccagggctctgacctggacatggcccagggacctttgtccaggctgttctgtgagctctaggccccagatggcaggcaggaagcctctgtgttccccagagcacactcctgctggccacagtggcctccaggtcactccagaagggaaagctgctgactaagaccctgtgctttctaaggaaagccacttttatttgagatgtcttgctgatcctcccagggcacccaggaagacaactgagatttttatctcatcttacagctgaaggaaaaagggtcactggcaggtggcttgcacaaagtcacagagctggggaggggcaaacatgggaccatgtcacagaactctgtctccaatgagcactcttgctgcatgatctcagagccccaccaggttcctggacacaccaagacagccatggtccatccgccacagaaacctcaggggcagggacaagtcctgccaactcactgggcttaccattggcctagtatgtaatgcaaattattccccactgggagaggggagcccggattagtcagtggacatccactcaggtacgctggtgctcctcaaggctgcttctcatgtctcctttgaatagggcctgttcatggagcccttcatattccccctacagtgctcctcatgctcccagggtctgtcaggagcaccagtggccttcctgacatcaggactccctggctctgctattctctcgattgtccctcatcacatgtgtgtgcacacgcacacacacatgcatctgtgcacacgcacacacacacgtgcatctgcacacacaaacacacacacgtgcacctgcacacatgcacacacaagaacacgtgcatctgcgcacacacacatgaacacctgcatctgtgcacacacacacaaacacgtgcatctgcgcacacacacacacgaacacgtgcatctgtgcacacatgcacacacacaaacacgtgcatctgcgcgcacacacacatgaacacgtgcatctgtgcacacatgcacacacacaaacacgtgcatctgtgcacacacacacacacacgttggcactgaatacatctgcactggtgccttggaactgtatcctctgcacagcttcccatccaccctcctccagccaggccctctttctgcagagttttcaaatgtgtttattccaagatattttcaggagtcagagatgtcaaactgtaaaaaagcacaggagcttagggaagggatggaggtgaggctgtagtcccaaatcacctccaaagccttccggttaaaagcacgggttccagacacaggctgccatacaacttattatctctgtgtgtcagtgtcctcatcagtaaaagtggtgacaaagatagtagattcctcctaggttgttgtgaaaattaaacgagttaatatatgtgaaggacttgagagggtaatcaacaagtggtatttgctaaatatacttactattattattattctgtctatattcaagaaagcagcataatgaggtattatttgcactacctttccccagggcaggtgcaggagggggtacttggaagatggtttcatcttgagcagaaagggcagaacctcgttgcttgtctcagaaatgccgagttttctaccatcacctgagggtcccagaatgaaactgtgtgtgcagaagacagatctgaggattagccagcctctctagtgctacctatccaggtgtggctcccttcagttagtatggagagctgagaccttacctgaggcataagtacaaatgcttgcccaactagtggggttggttccagcctgatccctgcaggcagtctgtctaagacggtggtttgcacagtgtgccataggggcccccttggaagaacacgtgatgaaatgaagcaactggggctcaggcaacagcccaggagttaggagcactgaattcttgtctgggtggctgcgggtgaggcccttacctccttctgtagagttgtctcatctactgaaggatgaaaagaactcattgcacagaattctcctgaggttcacaagagataatggggacaatggtaatatataaatataaggagatggcagttttgtttttgttgggtttttttttgtaaacaatagtgattttcttttcttttttaatttaattttatggttttttttaagttccgggatacttgcataggatgtgcaggtttgttagttacataggtaaacatgtaccatggtggtttgctgcacctatcaacccatcacctaggtattaagccccacttgcattaactatgtatcctgatgctcttcctccccccgccaaagtgacaggtcccagtgtgtgttgttcccctccctgtgtccatgtgttctcattgttcagcttccacttataagtgagaacgtgcagtgcttgggtttctgttcctgtgttagtttgctgatgataatggcttccggagatggcagttttgagagacttagggccgatggggttaattggagccaggtcaggtggggcagcaaattaaaactagcaagagaaagtccaacaagggggtgacaggtgcatcgaaatgagaatcaggcaacttgctcctaacaaaccatgtggccagcagcgggcacacctcaggcctctctttcttcatccataaaatcgtatgaaatcctgtgtcatgaaggagtgctcccatatcagcaacacactcccccaccaccattataatgcactctccttgattcagcaccctccaggatcccttctgagacatactctcctggttcctcctgcgtcctttgaaggcaggggttggccattggagatgctgatactgaactaagtaccctggcttaaatgagagtgactggatcctacagcagtagaggcaggtgacagaacttaaccattagaagcaaggtggcctcacaacataccaggcagcaagattaggctggccgcaggggagtgtgtcccgcagggatctacggagttggctaaagagcatggtgctgataggaacaagatatacaggcatctgtgtcagaaggaattcagccttgcccacacagaggcctggcctctgccctgggattctggaggtcatgtctaagccctggaaatatcatccccaagaagcgtgtccttgttttcctggaaattagaaccactccagaaagcctaacaatgtgattgatggtggaggctttgagtcatgtcttatcagctcaacttctggagggctggagactgaggtcagtcacacaggcagtgcaccaaacggtcctcataaaaactctggtcaccaaagctcagataaggttccctggttggcaaagccacaagctgttgccaggagcagcactgcccatgactgcacagggagaggatgaccggatgctcctgcttggagctttcctggactctgccccatgtgtctctttcttacatattatagtctgtatcttctccctataatcaaccacaactatgagtataaccactttcagtgagtgctgcaagttcttctggaaaattatcaaaacacagggtactgctagagacccctgagcttgtaattggtgtcagcagtgagggctgtcttgtggactgtgctccctccaactctaaaacagccaacagggtacagcttaatatgatcaataaaaagaaaccaagaatgaaagcagaaggcttagatcagtcaccagatagaaaagtattatcctttgtcaggtctccacacctgagccagttctcagaccccgaacccatcattagaaagagaagcctggtccccacagagagaccttgtaatatcacagcaaatgcatataacagcgatttcttcaccttcatctaaggtgcctatggccaattcctctgcttgatcagttaggctcctcgtgccaggaccccagttgcccccaaaaaggtgtaacttcacaggaagggtaattgattctgatcaccatgtgggactgctcctacataatggggtagggagcatacttctgggactcgggtgatcccctggggtatcaattattatccctacatatagttttaacagtaaatgggtaagtacagcaaccgaggtctgataagggcataggaaccagcagcatgcagccctcagtgatgagagtctgcgccgccccaccaggtaagccacctagaccagcagaggtgccagccaccaggagggaaatctataataaatcatagaggggggagaggatgtgcatcagttgtgacctctaaaacaaccgcagcaggacagcctgtagtagcccccaacccttcttttgtaaaattacccagaaatcaaaaccagctagaactggagaagcaatcgctggatggaatgaacctgatgtgagaagcaaatagatctgagtgggcataaggtgtggactgcagtagatactgtgatgcccaccctcatccctgttacctgatccgtgtgcccgtctccagcttctgttaatgttggccactaatagggcacgactgcacccttctcctaagagcagcccctgatccaatggagctcccagcccggaaatgcctaaaaggctctgcctctccctgggggtggcctatagccagtgacaaatggtgcaggaatacacaaggtgggcctctttgcctccaggtggggtaactccattcaggctgcagagctccctgtgggatgagaacaaagctagactgaagctgagctcctgtctccaatgagctttttccccgtccatgctgtcacccccatgtcctcccaggtttcccctgacagcactccctgataaaccatatcacttgcaggggaatccccatcttagtctctacttctaggaaatcttactgtgaacttaccccaaataagttctcctggtaaaatagaaagggtgatgtcagccaagtattatctggtggtggggcaatatcacgagtgaggagaatgcaagaatccgataagaaaggaggataagccaggcaaggtcgcgcgccctgtggtcccagttacttggaaggatgaggccagaggatcgagtccacagtgagctgtgatcacaccactgcattccagtctgggtgacagagaaagacctcatctacttaaaaaaattttttaatggagggggccaggcatggtggttctcgtctgtaatcccagcactttgggaggctgaggcaggattgcttaaagccaggagtttgagaccagcctgggcaatctagcaagacccatctctataaaaatgaaaaattttaaaaatagccagatgtagtgtcctgcacctctagtcctagctattaggaaggctgagccaagaggatctcttgagctcaggaagttgaggctgcaatgatctatgatggcaccactgcattctatcctgggacacagagcaagacactgtctcaaaaaaaaaaaaaaaaaaaggaggataggctgggcgcagtggctcatgcctgtaatcccagcactttgggaggtcaaggtggcagatcacttgaggccaggagttcaagaccagcctggccaacatgatgaaaccccgcctctactcaaaatacaaaacttagctggacgtggtggctcacacctgtaatcccaactacttgggaggctgaagcatgagaatcgcttgaaccagggagatggaggttgcagcgagctaaggttgagccactgcactccagcctgggtgacagagggagactccaaaaaaaaaaaaaagaaggaggataatcctatgacatgaggctcaaagatggaggaatttacagaggtgtaaggaataatagggaaattggggaaatggtctgaacatggccctggtgattaaaatgaatgctgatcctactgcctggcccaaagggtttgaagggcttaaaactgggaagaattagcaacacccagtggagaggccacaagaagatgggcatcttgtggggaggaacagccattgcatcatttttatttctgcatcttcattgtctggcagagtacaaggctcagagataagcatcactgtctcctccctgcccttcatctgatgctccttatccaacaacgaccaccccaaaagcatggacctgaatcagctggacttgtagccagtttcatgtgttttggaaggattcccccactggcccaaaactgactgtcttgcctttgcatccccagtgcccagctggatgctggcattcagcaaaccacatttcttagaaagacaacaatatccactcacactgatcccaacaagcagacacaggagcaaggccagagctgcaggggtcaggccagaggacaggggtctagtgctcactgctgctcctttctactcatgagagtggtgcagagagcaagtgcctatctggcctctggcaaggccccaggcaagggttccagtttacaccctgatctaggctcaccaagctaggtaggtaggatgcgtcctcccaggtgtgtgagcacaggtgaatctcaaagcccaacaaccaaaaaagaagagtgaccaaatcaggattcaggacactgtggggagcactctggaagcagacatttgctggggagcatttctgtacctagtggagcatctacaaagcagttaaccaacaacttcctgttctgtctaagatacacacggccaaggaaaaggaggaagtatcttgtgggagtagatgctttattgtccatgggggtctccagaggcccctgggtagggtgggatcactggcttcccccggaacagggtgccactccatgcattatcttgtggtggtctatggttatatcccccagcaaggaaagaaactcagaataattaaccttcttatccttattatcatcttttttctcaagggcattggacaagtaatccatgtcgcttttttcctgcatggagagaaacacgcaagaaagaaaaatgatatttgaattggaaaaagaggaaagaggtatcctgtggtgtgaacatgacaagtgggtaagtgggacaggagtgggtggaagagagagagcagcattgctgggttgttcctgaggagttctccattgagtgactccatgaggaaaacacagagattggtgtcaggctccgccaggaaccacactggtaaggagtgaggggccttcattggccacagacccacagacccacccacctacccacctgtacaggcgctgtctcctttctccccaggggcccagcacaggctgaccgccttccttctcttacatgttgactcttctcccattccatttctttcccattcaaactgttaagtgccaggttccctttctttaggacccagtgctctattctctcttgttatattttactaataagagtgatgcattctaacagtgaaataaaacccagtatatgaataagctctgccaaatataaagggtggtgctcatgttatcaatattctgatttccattgagttccatcttgacaagcctccacttgaacctagaggagtgactctcacagagggacaaggttacgttgggcagaagaaacaaatggccagagcgtgtgtgtaacctctccaggtaacgtggcagggggcccagtggcaggacaggagcccagcatgtctgattctcagttccagtctccatctcttgaatggttagtctctccacggggctggtcctgcctaaggctgggacagatggatcagtgaggcataccaggctcagaattacccaataaaaatagtgaattcagctcccagagatgagtcctcagacatgtcacaatgcacaggacctgtccaagaatcactactccattgccccgcacaaatataaaagctctcccagccaagggcgggcagagtccccactcacacagccactgaggaagttggggaagttctccttcatcaagttcaccagacctggcatgtccatcctaccatcatctccactgtattggcgaaacatcgcgactatgtccaacatgactttctcacctagagggatattcatctttgctttcaaaaagccttcaggaaataaaaacaatgattgttttccttctctagtgaatgactgatattaagaagatgagaagggattgaggagcaaatgaggacgaggctaaggtggaccagagaaacctgtgtttctctgtgtggtgggataaattgcttccaaagaggagggtagagccatacctgggatctgggctcacacaggccggggagcaacaggagaagaggagacaagcagaagcccagctatgggccgtgcttgtgagagggagaagtagggagagatagaggccaacaacacgtggaagaactaaaccctgagcagggacccccagccacagtcagcacatggcagactccactcctcaaacagcaccaaatccatctcctccagcttcacagccagggtgagagtcacaggggcaggacaacggccttggtgatctggtgtctgaccctcctgggctgcttcaagaaccagacaccgtgggccccaccttgactcaagtgcaagccctgcatgacacggtgcatgcaggctccaggtgcacatatgagcgtggacatgagtgttagcaggaaacacagccctgtcccgaacacagggggcccttcctagaccctcacaggaatgtgaaagaggcacgggtgaccatagctagcctctgttaaaaagaacagaaataactctctggttcttaagctgctggatggggtgggaatgaggtgggggtcccttcatgtctgctcttgggaattatctgcaccctttaaatcaccaaggctggatgttatttaaataaaaagttctgatttcccaaagcagatcctccagccaatactcagtctgggctggcctgcaccccaagcctgaaaaataggacagtgcagttcccacttcccacactttccaaagaaccagaaaatgacatttgctcatgcctgtgggcatctgacaataaacccctatcacctcccaaagcaggagaaagctctgtgctggcaactcactaaaaggagccatctaaagcctttttgagtctgaggccaaggccaggggctgagccctgtgcccagagggtgactgagagtttgcaggttgtagtagggagtgagggagctttggttgctcaataccttacccaggtaggggcagatcatctcaccagggctatgctgtgtggaggtcccaggcctgggggttcagcaagcctccaaagtattcttaggggactcttagccctctgtgggggcagacttggggaagggattcagtaccccagaccccaacaggaggatgaatccaggaagaagacagggagggtcctgtgctcaggtcccactggggacatttccacaggagttgtctcaggagatcccaaaggagcaatggacaggtctggttcagccacctggttgtacagatgtgggctctcgggctcgagtgaaggtcactcagcccggctggtggcagagccgggcctagacccaggctcctgagtcatcatccacagccctctttcctcctataggagaaagtgaatggtaggccagacactgggcactgctagaaaaggcaaataggcaggtgagacttaccagagctgggaagcatcacgagaagaaggatgagtgagatgtgtgtgtttggacaaagagcagtccctttataaggctcggcctggctcttcccaggggctggaaggcctagagccacctctcccatctgttttttggagctttgtcccacatcagatgggtgggacacacccaggaggctgtgctcaggatttctggccagaatcccaggtcacctggtcctacaccacccccagagatctcacctggagccttctctgttccaacctaatccaggtctggggcagccagtggatgtgtcagattaggacaaggaatgggggagagaacactgggactctggatcaaaagaggatggaatttcagactctagaaggaagcatggtctctgttcatacattcagttcttttacctttgagatacctagaactctcaccaccacttacccagcattttgatcttcccagcctcgagatccctgctgtacatgagtttctctttagtcctcacaaccctctgaggtaggtgctgctatccccaattaaggaaagagggaattgagatgttaagattaaagaaacaacccaagtttactcagctaggttccctcagccatcctgagctgagacatggacccattcacaatgaagagtaaagcactcactttgctttatgttgaagatataacagtacatttttttaaaaaggggtgggggactcagctcacctcaggatgctcacactttagaagaaaagaagaaacagaggctgagcagggtgactcatgactgtggtcccagctacttgtgaggctgaggcaggaggatcacttgagccagaagtttaaggctactgtgagctataatcatgccactgcactccagcctcaaggaaagaatgacaacctgtctcaaaaaaaaaaaaaaagaaagaaagaaaagaaaaaagaaagaaagaaaagaaagaaagaaagaaagaaagaaagaaagaaagaaagaaagaaagaaagaaagaaagaaagaaaacatagaaaaagaataaaatagaatctgtagctgctaaaagatgtacagtgaggctgtgtcgaccccaagaagagagcagcaactctggggaggagaggtggacagaggaaaatccagctggaggtggtgcctgagtgtaggctgacacctcctgatcatcagccaaaggaagtgaaaaccaacccagatcccagccatgaacaaacgctcaagggcagaaaaacacataatgtcaggactgagacaactgtaactaaaaaagaaaagaaaatcataaaaatttaaaacccatatttcgtgcctgggtatgaggagaaggatgcatggggctggcactaataatgtggccaactcagtacccagaccgttttcagagctcaatgctccccagttttgcttcagtgtttatactgcccagggccaggaggtgagtcccgcatggtcggagccactcctgacagtcctgttcctgctctgcctgcctccctggcaactacgactgatcgtgtgtcccactcagttccagccaaggaaactaagttctgctgggtagggcacctgggaactctgttttcctggctgaaggggactggggcagttggggacaggaacagctggcctagccctgtgctcctcccctgcccccatggcagggaccccggtgctgggcatagagcagtctatcagatattattagctctgatcaagtccctgtgcaagccctgcatgtcacacgtgcatgccctgcatgtcacacgagccctcctctggctcctagccaagaacaatagcattcatctggccttcaccctgtcctctgctctgtcacctgctccatgcaaggattcttttttttttttttatactttaagttttagggtacatgtgcacattgtgcaggttagttacatatgtatacatgtgccatgctggtgcgctgcacgcactaactcgtcatctagcattaggtatatctcccaatgctatccctccccgccccccaccccaccacagtccccagagtgcgatattccctttcctgtgtccatgtgatctcaatcttcaattcccacctataagtgagaatatgcggtgtttggttttttgttcttgcgatagtttactgagaatgatgatttccaatttcatccatgtccctacaaaggacatgaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagaaatggggaaaggattccctatttaataaatggtgctgggaaaactggctagccatatgtagaaagctgaaactggatcccttccttacaccttatacaaaaatcaattcaagatggattaaagatttaaaagttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagactgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagtccatgcaaggattcttatggtcccccagcctgatggctcctacctcagctttggtgtggagcatcattctcctgtcccagaactgagcaggaggccaggcactaagaggtgctcaggccatgagagaagagaacgaagccaagggagaggaacccaatcgtgagggagggcctgacctgccctccaccccatcaggacacagctccagggggactgccccatagtatggaggggtggttctctcttaacctctcactttctaggaggacaaacagcacaggtgaccctcaaatccggggcacgtgtctgacaccctctgggtggccccacctcggtataaagaaccatcctatggtagaagagtcctagatcacttctcccatggcctgtggagacacttgagtgggtcaagtacagcaggaagctgctgggtctctggtcctcacttctcttcagtaataagcactttcctggagatgggagaagaaagcacctgcaggttaccctccctctccaggggaaggaggatggtgcagcggctcatcctctattcaagcccaggttggctgcatgtgggctggagagtagtggtggatcccaagtgtcaacagggtgcctgggtcatagaagctcaggacctcaaggaagcctcgataggagggaacacagatgggctaactccacgcagagcgaattggcaaggaacaaaccaagaactggctcttctcttaaagctcacctaacacctaaaaggagagagattcctgcagtgagcagtgctctgacgtcccagagccctgtggctctgtctatggttccccccagagacattgccacccatatgtccccagtctacagactcagagagtcttcaaaattcagagctaaatgtgatgggagatcatccaatcctgaccctcattgtacacgtggagatgctgaggcccagagaggggtgtgtctcgtccaaggtgacacagcttagggtggcacagcttggtctagacctgattcccagcccgtgactgttcctcctgcatgagtgggcagcacagcaggctggagagtgagcactacccaggaggaagtgaaggcatggaccccaaatcgctagcctgactcagagccgtggaggaggcagaggaagacctgtgtaaagagtagatctgggcaaaggaacaggacctccagtgagtctcagacctggctaggagcctcaggctgtgaagcctggccgtggtccaccaccctcccagagcatggtggccctgcccagcaattcccaccagatgcccaggtcctgaaggatctgccccacccagacaactcatctgaaccttctgtcccatcgccagccacatgaggctgtgcagtaaaagtgataggaccaggggttaaaatttcccttacaatttccacgacttcccctccctctcctcaaacatttattccctcctctggatttcatctggactgaaggattatcagattccttctgctccatctcagggctgcctctcaccttccctgaagccccggccctcactccattcccttcctatcctgtctcctctcatccctgttccccatagtctcagacgttagaaagcaagccaggtgaccagcatcctttcctgcagcttactggacacgggagctgaggagctgctgaagggcttgctcaacctatgtcacaaatacacccgagattaagatgccatgggcagatctggctgtccaacatcatgcatttcccccaccttcctatcggcctgtgtgagcagggacccagcggctgggtgggagtggggcaggagtgcacggcacccatggccctgactggcctgagaaccagctcatggagaggcaccgatgtggcaggctggcgagcatctcacacctccccccagccacctgcacctctactcctgaatggaaggtgtgtagtagacagagtccaggatggggtgagaagacccaatttcctgcacagcccctgctgtttacttatttctctgttacaaatatgtaaacaccaactcaaggagccttagttaccttagatgtaaaaatgaggacaatgtcacttatttcctgggattgttatgaacatttaaatgaggtaaaacacatgcgatgctttgtaagatgggaagagggatagtggtgttaacgattgttattagacagtcagcaggctaggtgacttgtgggtcgggagaaggtctcctggcttaaagtatctctcttctgtctgtaaaaaaatttccccctttagattcaactctttgggttcatctcctccttctggaagcttcttttcatgtacccctgggagcagtagtgacaccacagaatcataatgccaagtgaaatgaggcagccctaaaaccctggagagtttttgattcccactcactataacatctaacttcaccattaaaccattagcacccactgacctcactggcacaagtaatgcaacagattgaatcacagagagtgagctctgacaaggaggggattcagaattggtgtattttgatggaatgatgaggagaggagtggaggtagtttttttgtttgtttgtttgtttgtttttttgcttgcttgcttgcttgcttgctttttttagatggagtctcgctctgtctcccaggctggagtgcaagggtgcaatctcagctcactgcaacctctgcctcccaggctcaagcaattctcctgcctcagcctcccaagtagctggaattagaggcacgtgccaccacacctggctaatttttgtatttttagtagtgatggggtttcaccatgttggccaggctggtcttgaactcctgatctcaggtgatccacccgcctcggcttcccaaagtgctgggattataggtgtgagccaccacacccagccaagtggaggtagttttgagactggggttcaaagggtactggcccatgtagaatgaatattgggcatttcaaggggcacaggcagacccagcctcagaatttttagatctcctatgcatgctctcatttgagccaagagtcaccagttaaaatgccagggtcagggctccccatcccatccattacggctgtcccaaccccaccctcctgcaacccccaccttaccccctacatatttccccttagcctctgccatccccttctcatcttcctagtccagccccaggttgtaaccttccttttgtttgatatcttctactcagaggaaaaaaaaaaaagagcccgatttcttagaaaagttgtttaagaaggacaggaatcatgatgaggagatcagtttttttgagtttctctccagtgttgctgcagttgctaaggagttactctattagttccatggccagaagccttgttctgagggttacagatgaccaagctcaagcccagcccagcccagcccatgggctctccacccagaccccaacatagcagacaccaagagccagtaaactggtccctttctctggttgctgtgttattttcctctttctctttggtcatgcatattggcactacagtagattcttgattagctactttatctttttttttctttttttttttttagacagtcttactatgtcacccaggctggagtgcagtggcgggatctcagctcactgtaacctctccttcccgggttcaagcaattctcccgcctcagcctcctgagtagctgaaattacttgtaaggtatagtgcccgccaccatacccggctaatttttgtatttttagtagaggcaagatttcactatgttggccaggctggtctcgaacttctgacctcaagtgatccacccacctcagcctcccaaagtgctgggattacaggggtgaaccatacgtatttttttatgtgggttttcccttcttttataggtttggacacacacgcacaaacgcacacacataagcactcaatttttgtggttacctttgaaattttaacttgcttgcaacataaactagactagagttaatcaatatctcttctctccacctgaacaatctaaataattcactttaaatttagagacttcccttctggcttatatgctattttttttttcagttttaactctccttaaaaattacatccatgtggtgtcaattaacagattcctcagcctctctcttccctttgtaactcagtagatctagagccttaagcatattcagggttcaggttttttaaagcagattacttcaaatgtggggttgtctactatcaagagtacatgtctgaatgtctttttcttatgtatcagctatgaatgatcattgtccctcctttaggaatgattattatttgagacagtgtcttgctctgttcctcaggctggagtgatgtggcaggatcatggctcactgcagccttgaccttcctagctcaagtaatccttctgactcaccctcttaagtagctgggattgctggtgtgtgttagcatgccttgctaattttttattttttgtagagatgggcatctcactatgttgccctggttagtctggaagtcctgggttcaagggatccttccaccttggcatcccaaagtgctgggattagacatgtgagccactgttcagggccaggaattattatttttgatttacacaaatatttaactatgattactcacttgtttgctatttccattatttatcattctttgtgcattagggtagttttccctttacttgcagtactgtacttgcttttgaggtttctttagtaagagtgtggtgggggttaagtcgtcttagttttgtatatctgaaaatgtctttatttcatccttttaaatttttttaaattatgaagtaatttttcagacacattaagaatagagaaaatagtgtgataactccatatgtattcattgcccactttgatgatggtcaatacatgaccatcttgttccacttatagtaccatccactcctatccttcgtttttgttgggcaaattccaaacttcatataatttcatctctaaccatttcaatttgtatttctaaaagataaggacaacctaagaagcccataatcacaatgttactatcatatctaaaaataattaataatatttctttaatataatcaaatatcctgtcaatattcacatttttccagttgtgatggattttttttaagtttacttaaccagagattaaataagttacatacagtatatctgattgatacggctctaaaaccttttcgttgttgttttctttcttttttcttttttttttttttttttttggctttttgttttttgttttttctggggttttttgtttgtttgtttttgttgtttttcttgtttttgtcgttgttgtcgttgcaagacagagttttgctttgttgcccaggctggaatgcagtggtgcaatcttcgttcactgcaacctccacctcccaggttcaagtgattctcttgcctcagcttcttgagtagctgagattacaggcatgtaccaccacacccggctaatttttgtatctttagtagaaatggtttttcatcatattgcccaggctggtctcaaactcctggcctcaagtgatctgcccgccccggtctccaaaagtgttgggattacaggcatgagccacagcacccggccaaggctttttaaatgtgcagcttcactctcaatttcttctttttctcctttcattttgttgttgttgttgtagaaagtgggttatttttcctgcagaatttcctacagactggagttcctgattgcatccatgtggtgtcaattaacagattactcagcctctctcttccctttgtaactcggtagatctagagccttaagtatattcagggttcaggttttttaaagcagattgcttcaaatgtggggttgtctactatcaagagtacatgtctgggtgtctttttcttatgtatcagctatgaatgatcattgccaacactgggtaaatccaactctgcctacacttctgcagataaaccagtctggataaaaaatgtgcttaccttgttgactggtcacacttcaaattcatgaccactaatccaactgcactttcaatacaaataagagagtatttgcatatttcaatgaccccatctaccttcttatcagaatcagtggccatacactctgccttcccccaactaccatgaattttttatgttcccagcagaggtccatccgtcctcttacactacatcccattccccttgcttttttcactcactacagaaattctcctctttttcttatgcaccatcattttttctgttttctggtcttttcattctgtacaagtatactgttatttgtctgaccttaaagaattattttgacttcattctcctctgcgatcttctcaattctctgcttccatttacagcaaatttttttaagaaaagaatttttatggatataaaatatttgtacgtacttatggggtacatgtgtgacatttctatcacctcaagtatttatcatttttatgtggtgggaatatttgaagtcctctcttctagctattttgaaatatacaatacactgttgttaactatagttgccctactctgctatcaaacattagatcttatttcttctatacagctgtatgtttctacccacttagataaaagagaagcaacaaatggtgagtcgatcactctaattttctccttttgaggcatgcgtgttttcacaagttgtacaggacaagaggtacagcccatcagaatattttcgttcaaaacctaaatagctaatcagagcctttaggagataaaaatcagagctcagagtatttccaaggtagaggtactatctaaacattccaggatttcagttagaacccctaaagtgctactcctaggaataagtatatgggtcccttcaccccacccacccactttcccagcctctagtaaccgtcattatactctctacctccatgagatcaaatttcttagctcccacagatgagagagaacatgtgatatttatctttctgtgcctggcttatcatctctgggtttgttatatcttctatttttctctttttaccagtttctttcttttttttttttttttttttggtgcagtggtgagatcttggctcactgcaacttctgcctcccaggttcaagcgattctcccacctcaacctcccaagtagctgggattacaggcacatgccaccacgcccggctaatatttgtattttttttttttttttttttttttttttttggtagagacagggtttcaccatgttggccaggctggtcttgaactcctagcctcaagtgatccacctgcctgggcctcccaaattgctgggattacaggagggagccactgcacccagctgattttctatttttatcttctctcatggtgtacttgaatattttgaatgttaaacattgaaaatgaaaatttttcatttcaggatatggatgattttctctccctccagagaattttctttagcttctggaaagcaattagagtagcagattatttaaatccaatctgggatagagttaattcaaaactgaattttaggatttatatttctgacccatatacttattcctaggagtagcgctttaggggttctaactgaaatcctgaaatgtttagaaggtacctctaccttggaaatactctgagctctgatttttatctcctaaaggctctgattagctatttaggttttgaacaaaaatattctgatgggctgtacctcttatcctgtacaacttgtgaaaagacgcatgccgcaagaggagaaaattggagtgatcgactcaccatttgttgcttctcttttatctaaattcttggcttttcaagttctggctgtgttggaagtcctcaacactaattttaatctcaccagccctgaatgactattaaagtcacaaacaatcttctttgtctcttagaagttactttctgtttggtttttaacttctttgttcaaactacttgacaactgataaatttctcaggaagagaagcagctttaatgttcagtgcattgatcgagtcttctttctcttggataaccagagccttcaagtcctggtcactttggtagctttctgttgcttcgaagcagataattttctgatttttattcatatttttatatgttttattgggataattagtctgcaacaaaaatattccaaagccagaaacagacatattggcagtaatgttgagctataggacctcttgttactgttggtaagaaaacaatagtcaagccaagaacacatagaatctgtgtcccaggtagcctattttttggaatatatatatactccaaaaaatattcgcacagatacataaggaaatatatataatgatgttccttatagtattgtttgtgatggtaaggagtgggaggcaatatgagggtcgggaaggtgtccgtggtggagtggataggcaaaataccgtggctgcacattatagagtaaatgcagctcagatgttataattctaactgtgcatagagcaatgtggatatgagttggagttccactgtaaatttctttaaagttacattgttggattgcatgaaataaaggctctcatgctcttctatgtaattcccaaagaagccggttggttcacataaactgctttaatttagtttgaaacagggtaaagaataataaaagatttaaaaaatacttaaatagaaaaatgaacctaagaaaccactctactagaaattgagttttaatataaaattgaaaataatggtaaataaatgatgctcctagtgaaaagcagtaattatttaatccagtaatattgaggccaaagaaaagagagcactgaagcttatctggtgctggtcagaactcttgtaaaatacaagttacaaaaacaataaaatattacctcacacttagttaaatatatagacatatgtattctctatgatgcatcaaccccttttctgggcatgaataccaaagaaactacctcacagatccataaggggacatatacgagtctgctgtcatggtgtggttatagtgacaatgtggaaacaatctggttgtttatcaaacacatggtcttctatgattttctgctccttttcacattgttccctttgccctcttttcttcctggaaagttaagatcactcttcaggagcctactgaaaaaccacctgcgtgcgggggaatataagagattcctgtagagaaggttgaataaatgtcagtcagaagaaagcaacgagaggcaggagtgacggcacagtgaactcagcaccacggacagctcacaacactctgggtatatttatgcgatatacacaagttactggaccagcctgcccaacatggtgaaactctgtctctactaaaaatacaaaaaaattagccgggcgtggtggcagacgcctgtagtcccagctactcgggaggctgaggcaggagaatggcgtgaacctgggaggcggaggttgcagtgagccaagatcgcgccactgcactccagcctgggcgacagagcaagagtccgtctccaaaaataaataaataaataaataacaaaaaaattcaaaaagtagtcggatgtggtggcgcacatctgtaatcccaactactcgggaggctgaggcaagagaattgcttgaacccgggaggcagaagttgctgtgagccaaaattgctccactgcactacaacctgggcgacagagtcagacttcgtctgaaaaaaaaaaaaaaattattggaatgttttaatatcagaatttcttgggaccatttggaattccagaatctctttcacatcagctgtcatgtgagtgtgggcatacagctgtcaattattctttctctttagtaccaatataacgtacagtagctactaatcaccctaaatcaagtaaattcttgctctggtatgtgttagaacaaaggttgaatttttcttttttttatgctttaagttttagggtacatgttcacaacgtgcaggtttgttacatatctatacatgtcccatgttggtgtgctgcacccattaactcgtcatttaacattaggtatatcacctaatactatccctcccccctccccccaccccacaacaggccccagtgtgtgatgttccccttcctgtgtccatgtgttctcattgttcaattccctcctatgagtgagaacacgcggtgtttggttttttgtccttgcgatagtttgctgaaaatgatggtttccagcttcatccatgtccctacaaaggacatgaactcatccttttttatgtctgcatagtattacatggtgtatatgtgccacattttctcaatccagtctatcattgttggacatttggattggttccaagtctttgctattgtgaatagtgctgcaataaacgtacgtgtgcatgtgtctttatagcagcatgttttataatcctttgggtatatacccagtaatgcgatggctgggacaaatggtatttctagttctagatccctgaggaatcgccacactgacttccacaatggttgaactagtttacagtcccaccaacagtgtaaaagtgttcctatttctccacatcctctccagcatctgttgtttcctgactttttaatgatcaccattctaactggtgtgagatggtatctcattgtagttttgatttgcatttctctgatggccagtgatgatgagcattttttcatgtgtctgttggctgcataaatgtcgtcttttgagaagtgtctgttcatatcctttgcccactttttgatggggttgtttgtttttttcttgtaaatttgtttgagttcattgtagattcttgatattagccctttgtcagatgagtagattgcaaaaattttctcccattctgtaggctgcctgttcagtctgatggtagtttcttttgttgtgcagaagctctttagtttaattagatcccatttgtcaattttggcttttgttgcctttgcttttgctgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagcttcagctttctacatatggctagccagttttcccagcaccacttattaaatagtgaatcctttccccatttcttgtttttgtcaggtttgtcaaagatcagatagttgtagatatgcggcattatttctgagggctctgttctgttccattggtctatatctgtgttttggtaccagtaccatgctgttttggtcactgcagccttgtagtatagttttaagtcaggtagcgtgatgcctccaactttgttcttttggcttaggaacaaaggttgaattctgatcaatatgacactaatacctgtgcccttaggccttgctctaaaatgtcctccttccaatgcagaatgacacattgcccccaccctattccttgacattcttttgaaaaaatattggatgaaatcaaaccaattttctatctggtgcctgtttggagctctgggctgtggttgcggagatggtctggccccctctcctctttatatccatctgcttctgttctataagccaccttggtgagtttggaataacacagttctcttgacaacctgccatagcaaatcagcaatatctcaggatttgggatcttaactaggaactgcatgccacacatgtgtccctaccctgtgatcacctctctgggatgacatgggtgtgtaaacagaatatccaaatagatgtgatgagtcctgcattgacataagcatggagagtgtgaaatagtctcaggaacattagacaaggctcccttgagaaagaaggtgatttctaatcctagacaagaagatgaagaagtatttgtccacacactccatcctaatttttatgtgccattgccattggatggaatattatcaggtgaaataagaactggaaaaataaagggagggcaggcccacattaggagtggccagttgccttctggactgtagcgatggattgaaggtccagcaaccccaccccagggagaccctctcttcttttgggagatcaggacttgagtcaagctcttcagtcatttgcattattctttttggcctagttccagattctggtttccagaatctctcctaagcttcacaacctgcctcccaaactgaagtttttagattttccactgctgtttacatgaggtggtattgaccagaatttgcacaagtgcattttataataaaaaattatatagagtacttattataagctgggatccagtactgctatatgctgggtaaccaggagatctgagttaacagtgttttccttccatgattccaagtctgcatggaaagacatcaaagaaatttgaggtaatgtagccactacagtaggagtgggctcagggtgagggaagtgcaaatgaggcagagatcatttctttggggtgaagggatagtggttcaccatctaaatgtctaagagaagttgacattaaagctctgtcttgaaatgtaagttaatgagacagatgacttattaaatgacatccagcagaggcagcatttgaaagactggtattgaggcacgaaatactgagatatattgatggggggaggtgttgcgcattcttggaataacagcagctgggtgaacaggagggattcagagagtgctggggagagaggaagtcaggtacccacccttgggaccctggcatgatggttctgagcagtgacctgcagtcctggtgaaggagagaggaggacaacgggggaagatggtcctggtttggagatcttcagggaaggtgtggcccaaggaaagtgggcaacagagctaagagaggaaagagagcaattctggggtggatgatggggacaggctacatagagaaggcagcaggggtctggtaagaaaaaatgaaagcccagggactgcagtcctctgtgagttccaagaacaggtggaatgagaatgagaaagggagagaagaaaactaatggtcagacattgggatttggaggtgaaaactgcagatcagtcctgaaggctgacaaggtgcagaatatgttcaggaaggaagattcctgatgaggagaggagatgctggtctgtgaatagaggtgtgagtgtggagtggaacagtcattcacaagaacaaataactcatcctacacacttctgctgggggaatggaatgagaatttttgagatggttgcctgattcctctaagaagaatgtttgcctgattgagacgttagctggagattgaccagggtggtaagaatgatagggacagatgatgtgagcctctagggagaatactaagagcagttgcacagaacatggcctggaagtgacaccaggtgaacactgaccctgtgttgtggcctgcatggagagacccaccagtgctctgctaggacagcactgtgccctgcttgtttctgcatcctcagcccatagcacactgcctggcctggagtagactaccaataacaaactactccattacctgcgagatagaggtgctgcaatttctcatcacagtcagcatgagctctctgtgtcagtccttaggacatttccgtggtgctgccttattccggctagactccttatttggactcctggactactttgagctcctcaaaatctggaatattcatttatcaccagaaacccagtcctggcatttagcaaaccatcgaggacagctcagcttcaagatgactccctctcacttccacagggtcacccacttaggcacatgcacacaagtgcacagcacagagagaggacacagcccctggagcccaggccacaggacaagggagctcatcctcagggaactactgagcatcccattcatagccacaagggccctgagcctgatgccatccaggaatccctatgtgagtggtttctgtttccccaagccctggagaacagctggggcaggagcgggagggcaggagcacactgagagatgccagccccttctcagtgcggtatctgaatgtgtctgaatgaccctggtccatgccttgacaaggaggaacattgctgtgatctggcaggagctttccactgacttccacctggaacctgccatggtggctgcatttagggagcggggcagaagcagacaccaggacctgtgtgagaggcagctcagctctgctggaggccatagggggaacgttgctggagggacattactcctgggtgacccactggatgggggtgggggaaattctccaacaaagttaacctggaattggtagttttgacaacgtaggtcaccaaagagaagaagaaaataaggcaagtgtctggtgggagaagacattttattgttcctggggtctctggaggcccattggtggggctgggtcactggctgcccccggaacagggcgctgctccatggctctgcttgtggtagtctgtggctatgtctcccagcaaggacagaaactcagaaaaatcaatcttcttatcctcattcttgtcctttttctcaaagacatcggcgaggtaatttgtgccctttttgtcctgtgaagagaaaaacatacaaaatagaaaaattcaatcacaaacaagttttgggctgggagggagaggaggaggcagagatacagacaagtacctagatctgcacaggcatggtggcggggctgagagcacagggtgagtgggtgaagttggggtgaggacgtgagtgttatccctggagttctctagggagtctttttgtctcacacctcaggatgggaggcaggtcctgtcccaaggtgctctgttaagtgaccttggggagagcagtcccctgccccagcctcactctttcccgtcccagcctctaagggcactgcctaccttagttctaccccagggcctcaaaattggccctcatgcttttgttctcttctttctctggcctcctctcctttcttctccttttccaccaaactcatcttctgggtatcctactcttggtcatctagaccctttggtacctagtagcccacagttttttttcagatttgctaatgagtcttgtttattgcaaagagggctattgatttctactaacaatggaacttctagtgctttcccagtaatctcagggatgttgatgtggggcctttgggaaacaggacctgagcatgtgagtttcagtctcacagagagagggtcagtgagtgctgggaggggactgtgcactgccctcaagctgcacactttgctgaccatctaataacctcctttatatctgtataactctttcccattttcatacttttttgcctaccatccttagattcacatatgatccaagtaataaagccctatttgcaaatgggaaattttttaatcagagggtgagggtgatctgtccaaggccacatagcaaaatgtatcctccaacattgagaagctagacaccgactcacacaggcactaaggaagttggggaagttctccttcatcatcgtcagcaggcttggcttctcaatcttgtcatcacgtctggtgtatttgtgaaacatgtcgatcatgcctattatggacctctcagcttgagtgttgctcatctttgctttcaaaaagccttcaggaaataaagacaatcatttttttcccttcatttaagttagggtctctatttgggagtgctggaaggagggctgaggacagagtaaaaacacggataaggtgtagcagaacgaactcaatttttttttaatgtgatgggataagttgctcaaaaatgagagggtaggaccaagtctgagacctggcccatcctggccagggccaagaggagatgcaggtggatggcggaagtccagctgtggacagtgcttcagagagggagaagcagggagagtcgggcgccagcaacacatggaagaactaagctgggacaccccagcctcagccagcacatggcagaccccactcttaaaagagcaccaaatccatctcctccagcttcacagtcggggtgacagtcatgggggcaggacaatggccttggtgatctggtgtctgaccctcctcggctgcttcaggaaccagacaccgtgggccccaccttgactcaagtgcaagccctgcatgacacggtgtgtgcaggctccaggtgcacatgtgagcgtggacgtgagtgttagcaggaaacacagtcctgtcccgagcacagggggcccttcttgtattcccttgggaacgagaaacaggaatggcctctgttacaaggaacagaaataactctctggttcttaagctgctggacggggtgggagtgaggtgggagtcacttcatgtctgctcttgggaattatctgcaccctctgaatcaccaagccttgactgtttaaataaaaatgtctgacttcccaaagcagatctttcagccagtagtcagtctgggctggcctgcaccccaagcctgaaaaataggacagtgcagttctcacttcccacactttccaaagaaccaggaaaggaccttggctaatgcatatgggtgtctgacaataaacccccaacacctctcaatgcaggagaaagctccatgccggcaactgactaagaggagccacccagagcttttttgaatctgaggccaaggccagagggcaagccctgtgcccagagggtgactgacaatttgcaggttgtggtagggagtgacggagcgttggtttctcaataccttacccaggtaggggcaagccatctggccagggctatgctgtgtcggggtcccaggcctgggggtttggagagcctccaaagcattcacaggggacccctagccctccaccctctgtggagctggagctggggaggggatttagcaaccgggaccccaacaggaggatgaatccagggaggaagaggacagggagggtcctgtgctcaggtcccactggggacatttccacaggagttgcctcaggagatcccaaaggagcaatggacaggtctggttcagccacctggttatacagacgtgggcttttggggtcaagtgaaggtcacacagcccagctaatggcagagctggcctagacccaggcttctgagtctttgtccacagccctttcccttcctacaggcagcatggcaggccaggcactgggcacttctagaaaacgcaaagaggcaggtgagacttaccagagctgggaagcgtcacgagtagaaggatgagtgagatgtgtgtgtttggacaaagagcagtcctttataaggctcagcctggctcttcccaggggctgggaggcctggggccacctctgtcatctgtttcttggaggcttgccccacatcaggtgggtgggacacacccaggaggctgtgctcaggatttctggccagtgtcccaggtcaccaggtcccaccccaccccagagacctcacctggagtcttctctggctcaaccttgatttgagggtaaggcagcggtacatgtgtagtagcaggtcagaaaatgggagaaaagagcactgggcctctggacccaaagaggatggagtttcagactcctgaaggcagcatggtcttgtttgttccctccccttatccttccacacatttgttatgacagcctgttctatgacccccaccgctgactgagcattttaatgtctagatatcaagatacctgctgctcctgcatcctcctcaaccctcatagtcctaagaggtgcttcaatctctattttaggaaaggagaagttgagatgttcccaagtttactcagctagtaaacacaacaaatcattatatggactcagaaaagcctgaatcaaatccttactcttatcccctgtgctataggtcttgggtcacatcagggtctgccctatgggaactcaaagtccagggagggaagcagggttacttcattgctaaccattggtcagcccctcacagaagccctggaattaggtggggggactggggtcaggggcctcactatctaggttgagtggtggagtgacccccccatggaatgagcctggaggcagggagtgggaaaagttctttcctgccccatggcactaacttcccagaaagtcttcagtgtttttcctcctcctatgcaaaacagcctgtgtaggagttgggagttgtgcccttggctataatgtgccctaacctgctgtggaaaggctgacccaggtaggggcaagagggttgggaaggcatgggaatccctggggcatggtgaggaaagggagatgatgaatcactgaaatggactttttctgctaccc

SEQ ID NO: 136 - DNA, 253846 bp, Homo sapiens
  misc_feature (105313)..(105313): n is a, c, g, or t
  misc_feature (125702)..(126552): n is a, c, g, or t
  misc_feature (216590)..(216590): n is a, c, g, or t
  misc_feature (216617)..(216617): n is a, c, g, or t
  misc_feature (216621)..(216621): n is a, c, g, or t
aatcaaagatcaaatgtaactgattaccacctgtttaggagaggttccagataacattcccagaagctgaaaaaaaaaacaggatttctccctgctagtcagaaaagctgagggtcagggacaaagtagaactgggtggtctccattgaacaacagctgcaggggaagaagggtgctttcacaaaggctccttagagacccctcatcccccttaccttccctaccctggtgcccactatcagtgcccacccagcctctctggggactgaggctgtttggcctttggcatcctctgtttgtggcctccacagtgccctctctaacctgcctctcccaccagtctgttggcatcgttcagaaatcttggtgaaagaacccgggcacagtggctcacgtctgtaatcccagaggcctaggtgggaggagtacttaaaaccaaatgttcaagaccagcctaggcaacatagtgaggccctatctctacaaaaaaaaaaaaaaattagccaggtgtggtggtgcacacctgtggtctcggctacttgggagggtgaagtgagaggatcacttgagcctgggacattgaggccacactgagccgtgatcatgccaccacactccagcctgggccagcaggcagagtgagaatctgtctcaaaaaaaaagagaagaaagagaaagaaaggaagaaagaaagaaagaaagaaagaaagaaagaaagaaagaaagaaagaaagaaaggaaggaaggaaggaaggaaggaaggaaggaaggaaggaaggaaggaaggaaggaaggaaggaaggaagcaagcaagcaagcaaagcaagaaagcaagcaagaaagaaaatatcactatcacactatgaaacaatcactgcccttgtgctttaaacacattttccttcctgggttcgagccaggatctttctttaaggataggaggagagcatgagctattttccaggaaagagccacctgacttcaggccctttctgtgtcaggttccttttgaggtctgtactcactctggcaccacaaattctgatgaacaccaaaattagcaggtttagggagaggagatctattggaaaaagcacaatgaggcccacagttgaggcccccaaatggccacccacttttccctgaagaagccatggagcccgctcctgatgataaagctagctcagcttgcatgtcatgtgtggctctggggcactgagcccagagtttgacctttgttctggaacagaggtcccaggtgctcactcccaggactgtgcccatccacggggacattctcgctggggtacagtgaactgtcagtgtcaggctgacaataccctttcttgagagtttctaattctgggtattaaaatctcctttctttcatggaaggatgtgttttgttaatgaccatacctggcaaataaaaactgaatagagctacacctgtttcctccccactttcatcactcataattaaaaaaaaaaagtttactgaactgtgaaattcaaaactctgggaatcactgctcaaaatggtctatacagacaagctagaaaaccattaagaaaccacctcagggatataaatgctctaatttaattagcattctcattaaggaggtcaaaattaccaagggcaaaacatgccttagaacactcactaaagctccagctgtgggaaaccttcacactctctctgacagtggctccccaagcctctcccagatgccttttctgacaggcccttttggatgtgttctgagctggtagctgctaagggaggaaagacccacaccaggtcaagacatcacagggcccagggaacaaagaggaaggcagccagtggtgcccagacctgccccaacaggccagaagagccactcatgaagcaggaatccatccgcaccaatccacagcgaggtcagtgaagcaacacctcgtcaagcctaaggtcagcgtatgagggtctgagccacaggcagcttcttcatgcagcacatgaaccccacattctttaccacgggaaagcaaatttcctctgacatgggcaggaatcctcgacagctagatgtgttcttggaattctgttcttagctgctggtcatctccactggcttctaggcatcaccaggaaccttatgaattgtttattttcagtcctcacaataacccgtatagtaagtgacatggtgcccattttacagataagggaattggggctcagaaaggtgaaatggctcactcaggaccaagtttctagctatctggttccacagtccatgccatgtggactcctatcctgcaacttctcattgtccagaaaggagtatggttggttcaacagaggcaaagttcagagagaaaaatcatcaatgtaaaggttgagagatgctcaggttggtccctgaagcagattctgatctctttgtctagagcctggcaataggacttatttgagcagagcctggaaccacttccaacatctcacctccctgctgtaggggatctctatggagagcagtatctcctccgggctcagcagggtctttctgtagccagggaagaaggtgtggtccatctggacagttctcctggtgcctgtacagaagcaagatgaagaggagccaaagtgagggaaaggctgggaaccccccatggggagaaaggataaccatcagtgggattcttcatgctggtctccaatgcccacagtcagagcaaatgactggcacaattggggccaaatcctctctctgaaatccttaagcatccttaagcaatggtgtgctggtgaatctttaacaaccagttccgtgtagggggaaaagccctggtttatagcatttgccaatttctgtggtgtaaatacttccaggccaccaaagttgcatcactgaatgtgaagctgggaagaaggcaggaaagagttagcacagcaacccggactgctgtcctctgtaggggttgcttacaaggctggcccttgggaacttgtacttcagaagggttcccagtgctccatgatggagcagctcactgcgcctaaattatctgtacaatcaatagtttatgctgaacccctgctttccttctgggagtccagactttaggcacatgctagtagaggctgcctatgtgatgagctcccaagaaaacctctgtcgctgagcctctaacaagctttcctggtaggcaaggcatcacttgtgttgtcacaacttattgctggaggaattaagcatgcactgtgtggctccactgggagaagtctctggaagattggacctggttcctccagactttgctcccatgtatcttttccctttgctgattttgcatcctcctgctataataagtcatagccaggaatatgacggcatgctgaatcctctcagtgaatatcagagccggggtggtcttggggaccctctgacaaggcagagatgcactggagcacataattgtagagcatttccaccgtacagacagaacagatgcaaataactccaggagcactgataacagcaaaatgaagtacttacgaagtgatgaattttgagtatttattccttttgttttgaatataatttatttcattgtaattttatacaattttatttttatttttattttttgagacagggtctcactctgtcacccaggctggagtgcagtggtgagatctcggctcactgcaacctccgcttcccaggttcaagtgattctcttgactcagcctctcaaggaactgggactaaaggcacacaccaccacacccagctaattttagtgtttttagtagacatggggtttcaccatgttggccaggctggtcttgaactcctgacctcaagtaatcctcctgcctcagcctctcaaagtgctgggattacaggcataagccaccgcactaccgcacttggcctgatttttattaataactgtgtttcacaaatggttcacagaattcctgaagatccaacagcaggctgtggtgagccagtgcatcccagccccagtaccccactaggtaaggcatgcaggtagcagttcctgctgtgaattctctacagagaaaatatccagctttcccgtccaccaaaccaggtacattctccatgcttccctggatccaaatcacagggaaagctgggtcactgaactttgagctctgtttctccagaaaatgacctatctggtgagacttttctcccccaagtccttcttcctggacctctgcttcaggcagctcacctctggacacaagtgtcagcttggccccactggccatgaacacggggttgaggtcggagatggggctggcagtgatgatgttccctccaacggactaaaacaagcagagagcatgcagtgagagcccaccccaggaaacccctgctcacgtagcaggctcctgaacataccagccaggtgacacctgctgcaggcaaacccctgaggtcctgtgcctactgtagtcacaataccagcatagtgagaacttcggcattctgaaaaatgcgcaaaatttgaaatcagaatacttgagattggatccccactctaaaattttagcaggcaagcccctttaagtgtgtgtgtttgattgatgatttcacccaaccttttcccgaaaggattgaggtgatttatcacagaggccatatagacttagtaaaatagaagataaagatcaaggaaagagaggaggaagacttaaggttgaacaatttgctctatttggatctgaacttcctggtaacttggcaaaaaaaatgtaagaagaatcagatacagggttctcgttattagaaaacaggaagaaaatcagttgcacgatgaaaatacaattcttcctggaaatagattttagcagaactagggaactcagcagagtttttgagtttatgtttccttatctacagtttatgtttccttatctataatcagaagtgacaggtacttggggtgggggctgggaggaataggagtaggctgttttgttttaatttaaaaaaacaatttaaaaatggaagagatagcttttcttccgacaccataaactgttgtgaagagcttccattggcatagggtgttcgaatgccaccatttgcaaactgggaatgtggggacttgtctgaaggctgactgaataatcaacaggtgtattcctccctctgtgggagggctctgtctctggttctccctatagctctgaaaggaaattcccctctcaattctgacttctccctagcatatccatatctcttgttcacctactgtttggctcagccaagctcaggaagggggagggaggcaggaagcctcatctctgcaaccacagaatgaagcctatgagtcgtggagtgcatttcccagggtgccccacagaccaccttcatcagaagcacctgaagagctgggctacatcccagacccatgtatcagaatctctgagggtggggcccaggaatctgcactttaacaagcactgctcctcccaggcaactctaagcgctaaagtttgaggcccactgcactgacacagtgagagtctggctgccctgctttcagatgaaagctccatcctacgggcctcgcttgcttctgagagcgactcaccgccacagacttgacttgcttcccagcaaaccagcgcagctgctccaggacccctctgaacacctctgtcttttgggcaggaagcttagcaacagcatccaccagggttttttccacaatgctcagggggcaagcagctccaaaggagatacctgggaacgcacgttcggaatcacagcaattcttcccacagttcagaagaggctttcatgcacagctcctctgaagctttccagcaactggagcaaggctgaatcaggactcacagctttccatggatgaggaaatgagggcccagagtggttgagtgacctaaccaatgccacacagctaataaaagagccagtactcaagcttgggcctcttgatcctacaaccaatgctctttcctctaaaccagtagttctcaactcattaaaatcagaatctctgaaggtgaagtcctagcattctttttaaaagcactcaggcacaatccccacctccccacccccgcatgagtgattctaatgtgtagccagaattgagaaaaatgattgaagatcccgcagcctcttgcccactggcaccctaccatggatgtttcagcaatgaatggggtctcctcccgcctttccctgtgcaaggtgagccccaggagaagcagggggcagccagagccagtggggagaccaccctgatacctgccacccaccttgtaacctatccccagcctcacagcccctccataagcttggagtgaacctcctcttaccgtcgggtccatgttctaccgaattcagctcagggatccaggctgggcagacaatcataggaaacagcatattcttgaacttcatctcaatgcctagagagaaacaagaagctgaagttgtaggcccattgttgtatcaccagggcaggccttagcagcttttctcaccattacacacaggatatatgacatatccacaatcataatatgctctctggtgactgtaggtgtctgggaataggaaactcagtagaccaggggtgggattagatgcagtctttggactgtcagcccaaaactaggtctttctttccctctcaaaaaacctacctgaattcaaatgaaatgagtttgaattcactctagtgtgtgtgtgtgtgtgtgtgtgtgtgtgtgtgtgtttgtgtacattagaaaacacaggaaattaaggtatgtcaggaacccttctaagcactttccctattttaacttaattaatgctcacaacaaccctatgaggtactatgatttttctgtttatagatgaagaagctgaggcacagaaaagttaagtttcttgcccaaatcacacagctaagaataaccaaatttcagtactggaatgattattcgtgttggggtataatcgtaataaaaacatgaaagtttaacattaaaacaaaaaaggaaaatgggagggaaaacttcaaatctgtcctccagttcccactatctgcctgagttcttcaagttgtctggctttgcggggccacacatctgtgtgtggtttctggccttcctgactaaatgagtcagaagcctctgttaaacaagtgtgcctctgttccttagacccagttggctcagcacctctcccagccctgccaacagtgtatagatggaaaaggttaaaaaagaaatacctgtgacctctttgcccccccttccccccaggtgctgtttaggatttctgaagggggccctaggctttgtggatccccagattccagaatcttcaaagctcccttcagaaatcctagaagcacctgaataccagccccttttgaatatcagcttccaggacaaagaacacagattgaagcagcaagttctacgttactaaggttttctctttgtctgccttcccccaacactctgcgttgactggaggtgactatgctattggggtatgtataagagagaagggagtggcgcagaaggaaatggtcttgagaaatcatttctaattgtggaacttaggtaatctttgttattcatttctcttggaatccaactgggcccaggacattggatggctcatggcagggagcatgcaagtgtgaaatgatccccttgaggctggggtgggggaccacatgagcccatgagtttgaggtgagctatggtgacattgcaccactgtatttcagcctgggcaacagagtgagaccctgtctttgaggaaaaaaaaagaaggacctcctaagattcccccagccaccttaaatcaagctacacctgagctacatgagccatgagtcctgttgagccatggccatcaagatcacatttcttgaggtgtgtctcagcccaccctgctgcctcagtgtgtcacaaaaccacagttggggactctatcttatgtatatgtgcgcacgagggaggcgtccattctgactccatcagcactgacccaagccaggctctcctctctgtggctgaggagccaaccagaactcagggcttggcagctccttcaggaaccagagccaggacctgactgcttagaaggagagcatgcccctccacagcagaggtcctcagctgtcccacggtctcctccttagatcctcactaggcttgggatccagcaaagtagaaataggccatgccaggtttagaaatcgacagagattagcagggacctgggaacctctccccatctcttacagcactggggctgagaggtgcatattctgagtctcccagcctgttcaactattccaggcctcacgtcctaggtggtagcactgacagggcaggtggccatggtcataggcaacacaaacacagtcacacctggagctctcctcttctttaccttatcacatcctcccccagaaaaagtggggtggtggggtcaaaagcgacatttatggaacctctagtgtccatcagccactggcctagacactttgcttaaattagttcctcctcccttagactagaaggcccttgaaggcaaggaaccatgtccaattgagctttgtatcccaagccccttccagagtacctggctcatgctcggtgctctgtaaatgtttgtggagagaagtcaactacatgcaaggatctcatttcacacccaaaacaatccttcaaggagttgttagtatccccatataaaaaacagaaaatgagggtagatgaggacaagcaacttttctgaggtcacacatccagcaaggggctgagccaggcctgtgggactccacagctaggggcctttgcaggaactggagtgtccagggatttccagtgggctccaggtagtcagtggggcagagggatagggtgcagaggcaagtaaagtcagggggaggtgaggatgggcaagaggacctagaaacacccccagaccccctggcagccccagggcagcctccctggcccttaccaatctccgtgttccccacgaccagcttggcgtcagggtgctgagccttgaggtccagcagctccttgagggttgaggcctgtatccacgtcacacgctccccttcaaatcgcagctgcttccgaggagtgtctttcagcctctgggaaatgcagttttcttactacaatgtctccctcttcctactgtcattcctcttataaattgctttaagtcctcaatgggatgttttactgacattcagaatgaaaatatctaacaggaagaagcaaggggaagtaatatgttcagaggcaggaactccattgggactagtctttacaagacttccatgaaggaggcattatgagcctcattttcaccagtgaaagaagatcctgagggtcaaggaggttatgggacctgctgaaggtcacctgccatgaggggtccccaacagacctggctgaaagccagattccttgcagtgccccataatatctccagggggcaccatggacaaggcatgagaagggagggagggagggagagagggagggagggagggagagagggagggagggagggagggaagaaaggaaggaaggaaggaaggaaggaaggaaggaaggaaggaaggaaggaaggaaggagtttgttataaggggatgcctaggaaggctggctttagtgcttgcaggaagacactgggctgagaacgaagccctcaaatcgaactgccagtattttcaaagtttcacagtccagagaaagatctgctggtggcctgctgcaaagccattctctctggcctgttgaagctacaaggtagttttcatagctcaaaactctgagaagtgtgcacttcaaaaactccgagtggcttgattctttcgttgccataaatattagagtgatggtgataaagtgggtgtgagggggtttccttaagacagagctgtgagctgcagatcatgtcctttgaagagagctctcgttttttgttttgttttgttttgttttaaataaatggattgcttatagagggaatacgtttcttggagtgcttatgtattagatataggcaggagatcaacaaatggttatagtgaacctgctacactacacagtgtgcctagagagccagtccctatcctcatggggcttgtcatttagcaaggaacacagacatcaaattaataactgtaactgtgacacacatgaactgaagtgcaggggctgtgggtacacatagcagagactcaacctaggggagtgtcagaaaatggaagggaaatttaagctgaaacataaaggacaagaaagacacaaagttcccagtgggtatgaaaataaagcaggtttccagggactcacagtacagacccggctggatctgtccctgaggcatcacctaccagcaactctgggggaaaaatgggctcctgggttggatccaggggcgtgaactcctctggtttgaataaagatggcgagaggctgacctatggggaaagagaacaggtaggtgatgcagtatctcctcctttcaaacacccaagaggaccaattcagcctttccttccagcaagctcattcccagccccctgcaggctgcaagaggagcaggtaatccctgggaggcaggaatgagagagtctcagttacaggacccggggctaacgtgcaccatcaccatccccacagtctgccatcaccgactcaccgtaggttcctcttccagcccccaccgccagggacatggagctcgtgcactgactcctctaagtctcagattacccccaggcttccagggggagaagaactcacttactgagtggtctttcttctggttcatgcagcaatttggattattcccatctcctccacagcatccaccatcctagagagatgatgaacatctgcacaagggtatttacaaagagtatttgcagaagctaaggaatctagattactaatatccagaacactccagctctgacgcctgtcccagcatcaacagcaggggcatcctgcctgcctgttgcccagagtggaggcctccgctacattccctcttgcttggctaacgtagattaaacaactcatggataaacaaataggagcaacaaggccactgaatttcaggaacttttctccataaaagctaggtcctactttatcaaaacctatcccttatgcccatttctcttcttcagtgctgcttcctcaggaagcgtctatgagggatattcccattggctctctcaagactcaagaggcttgacttccagatcagcaaggttctaggggcgtggctggtgtctcccaggctgggctctctgcaggaccctgccaaaggatgtccaagacgggtgctgagcccagcactgtgtccagccagtgtgcccaatggcctccctactgcttattaggcacttcttcccagaaaggtaaacacccttcactcctcactgtgggcctgttctggagaagtatgcaggtcagaccacccagcatctctgggaaaagacttgctcaggacctcttaggataccagtggcagagcacacacagagtctagaatcactaccacccagcaccgaggcactgcagggtggcagaggggcgcactcagctgactgatctgcagctcagggcttcagaagacagagtcctggagttgtgctgagatgaaaaagtaggggaaactcataggttctgcctcaggcacttttatcgggtagtcaattcctgaaaaagcaggctgggagcagtccttctgcaagtcagccacaggagacaccatgccatgctggcattttccagagtctgtttcacaactcgttgtcttctgcaagaaagcactcatgggatgctggaggtgtgaccttggagaagttgtaagcaggcaggcagtggcatcaggagagaaacaccccacccaccccaccacctggacacgctgctccgtgtgcagactcttcctgcattcacagctccagcactggacaccagacctgctccgtccattctgagcctccccccagccagccaccttgcacttcccctctatatttagaaagaaagaaaggaagaaagagaggtttcttagtgccttttctcacctttcttcttggagaaggagtgatgtagggaaatgccctggcctacctgaagtgaaagtcctgcatcccactcacctggccctctgaggaaggacatatttcacagaagcgccttttccagacaaagtgccagtgcattattacttagatctattttcttgataattcattggtgtgttaatgacataaattactgtgatgtacagtaatgcatcactgccctcaaggtctattgaggttggataagactacattttctcatccccaccctcctgagattcctactttactaaataggctaaggcttctgcactggtgcctttaaaaaaaaaagttttttttttagagtggtttaaggttcacagaaaaaactgagtggaagatgtagagaattcccaaatacccctatcccaacatacacgcacaacctttctcacttcagtatcctcaaaagtggcatatttgttacaactgatggacccacattgacacatcattatcacccaaagtccattaatttacatgaaggttcactcttggtgttgtacattccattggttttgacaaatgcatgattacaggtgttgacccttatgatatcttacagaaagagttatactgccctaaaaaacctctgtaccctgactattcatccctctgtttcccctaatcactggcaaccactagtctttttactgcctccatggttttgtcttttctagaatttcatagaatagatatcatacaatatgtagcttctaaagattgatttctttcacttagtagtagcaattaaggtttgtctatgtcttttcatagcttgatagctcctttcattttggcactgaattaacattccattatttggatgttctacagtttattcacctactgaaggacatcttggttgcatctaagttttggcaattatgagtaaggttgttgtaagcatgcctgtgcaggttttcatgtggcaataagttttaaattcctttgagtcagttccaaggtgtgtgatcactgaggtgcatgataagacatgttcagttttgtaagaaactgccaaattgtcttccacagtggttgtgcagtttgcattctcaccagcaatgaatgagagttcctgttgccccacatcctcaccagaatctgatgttgtcagtgttttggatttgaccattctaatagacctgtggtggtatttcactgttctttcaatttgcaattccctaatggcatatgatgtcgaacttatatgcttactggccatccatataccttctttggtgaggtagctgtgcaggtcttttacccattttttaatttagttgttcattgtcttattgctgagttttataagttctttgtatatttggataagtactttacaagatgtgtcttttgcaaatatttttctcccagtgtaccgcttgtctcctcattcatcgttattaaattttaatgaagtccagcttataattatttcttttatggatcatgcctttggtgttgcatctaaaaagtcatcatcattccaaggtcatctaggttttctcctatgtcatcttctaggagttttattgctttacacttaggtttatgattcattttgagttaattttgagaagtgtataaggtctgtgtttagattcatttttttttgtatgtgaatgtccaactgttgcagcaccatttattaaaaagacaatctttgctccatcgtatcgccttttcttctttgtgaaacatcagttgactgtatttatgttggtctatttctgggctctctattctgttccattgatctctttgtccattcttttgtccattctttttgtagtatggacagtgtccatactacactgtcttgataactgcagctttgtagtaaatcttgaaattgggtagtgtcagtcctctgactttgttctctattctccttcaatattgagttggctattctggatcttgttcttctccatataaaccttaggatcaatttgttgatagccacaaaataatttactgggattttgattgggattgcattgagtctacagttgggaacaactgacatcttgacatattcagtctccttattcatgaaaaagaaatatctctccatttgtttagttctttgattttgttcatcagagttttgtagtttttctcacataaatcttgtacacactttttagattcatacctaagtattacatttgttggagagtattaatgtaaaacgtaaatgataatgtgttttgaatttcaagttccacttatacattgctgttacatatgaaagtgattaacttttgtattgcctctgattctatcttctggaagagattgtggagaattgacataatttcttttttaaatgtttgataggatttaccagtgaatctatctgggcctggtgctttctgtgttaaaggttattaattaatgattcaatttcttcaatagttataggcctattcagattatctactttttgtatgagttttggtagcttacatctttcaaggaattgttttatttcatctaggttatcaagtatatgagcatagagttgttcttaatattccttcattatccatttaatgtacatgagctctatagtgagatctttttattttgatattagtaacttggatcttctcttttttttcttagttagcctggccagaggcttattaatttcattgatctttttaaggacccaaatttcagttatgttgattttctctattgattgtctgttttcaatgaaattgatttttgctccaaattttatttttcttcagcttactttgaatttaatttgcctttttttttctagttttctaaagtgggagcccagattgctgattttatttgtattttatttttattatttatttatttatttatttatttgaaatggagtctcactctgtcacccaggctggagtgcaatggcgcaatcttggctcactgcaacctccacttcctgggttcaagtgattctcctgcttcagcctcctgagtagctgggattacaggtgtgtgccaccatgcctggctaatttttgtatttttagtagaaacagggtttcaccatgttggtcaggctggtcttgaactcctgacctcgtgatccgcccgcctcatcctcccaaagtgctgggattacaggcatgagccgtcgtgcctggtggattattgatttttaatcttcctttctaatatatgcattcaatactataaatttccctctaagcattgttttcactgcatcttgcaaattttgataagctgtattttcaatttcatttaattcaaaatattttaaaatttcccttgagattttctttttgaccatgtgttcttttgaattgtgttgtttaatcttcaagcatttgggggttttccagctatctttctgttatcgatatctagtttaatttcattttggtttgaaagcagacattgtatgatctctattcatgcaatttaaatttgtaaatgtgtgtttcatagcacagaatgtggtccatctaggtgaatgctccacgtgagcttgagaaaaatgtcttttctgctgttgttggctaaagtagtctataaatgtcaattatatccaattaattgatggtgccgttgagtccaactatgtccttactgatttttggcctggtgctgtccatttctgatataagggtgttgaagtcttcacatataataatggattcatctatttgtctctgcagttccaccagatttgcctcatgtattttgaagctctgttgttaggtgcacacacattaaggactgttatatcttcttggagtattgattcctttattatttttaatgcccctctttttctctgataactgtttgctctgtccaaaattaatatgctacttccactttctttcgattagtatatcatggtccacctttctttatctacttagttttaatctatctgtgtcttttcatttaaagtaggtttcttgtagacaacatatagttgggtcttgttattttcatctactctaacaatctctgtcttttaaatggtgtatttagatcactgacatttaaggtaatcattgatatagttggattagtatctaccatatttgttattgttttctatttgtcgtccttattctttgtttctagttttgtctttcactcattttctgacttttgtggtttgaactgagcattatatataatttcatctcctttcctttcataaagtatcaattatacttccttttttctttttttttttttctggtagttgccctagagtttgcagtatacatttttaactaatccaagtccacttttaaataacactacaccgctttacaggtagtgattgtatcttataataacaaaatatttctaatttttccctcttgtttattttatcattgttgtcattcattttacttatacacaagcacatatatatatacatatgcacacataaacaaatgcatggttgctatgattgtcttgaacaaattgctatctgttagaccaattaagattaagaaaaataaaaatttttattttacctttacttgttcattctctcatgctcttcctttatgtagatctgagtttctggcctacatcattttccttctctttaaagaacttcttttaatatttcttacaagatgggtctactggcaacaaattatctcaagttttgtttgagaaaatatttctcactcgcttttgaaggatacttacggaggttacagaattttaggtgctttggttttttctttcaatactttaagtatttctctccatgcctcttgcttgcatggtttctgggaaaagtcagatataattttatatttgctcttctataggtgaggggtgttttcctttggcttctttcaagtcatttttctttacctttgattttttgaagtttgaatatcacatgccttggtatagtttttgtttggttttgggttttggtacttatcctggtttgtgttctctgaatttcctgactctgtggtttaaaatctgacattaattttgggaaattctcagtcatttttgtttcaaatattgcttcttttcctttctctttttcttcttttactgctgatattctcgttacacatatgttacatcttttgtagttatcacacagttcttatttgtttctgtttgttttcattcacttccttttctctgttttttggttttgaaagtttgcattgtcatatcctcaagctcagagattcttttctcagccatgtccagtctactaatgagcccaccgaaggtagtcttcaatttgttataagcgttttcaatctctagcatttctttttaattcttagaatttccgttctctgcttacattatccatctgtttttgtatgttatctattttttccattaaatctcttagcatactaatcatagctttataaaattcctcatttgttaattccaatattcctgtcctatttgactctggttctgctgtttgttcagtctcttcaaattgtgtttgcctttgactatgccttataatttttggttgaaaggtggacatgatgtactggctgaaaagacctcatataaataggcctttagttaatgtattggtaagatatgaaggagaagtatcctatagtcctaggattagtctcagttttttggtgagcttgtgccgctcacctgtgaacttcacaagcgcttctcagggttttttttctccgtttggtgggacaggatggctggagggggctgggcttgtgtatttcccttcccacaggtgaaagactaaaggtcctggggttgcgtatttcccctccccaaggtaggcgaggatctaatataacctcagaagtttaggctgcggtaaaataatttcttctgaggacaggcctttttaagaagaacagaatgctctggcatattccaaaatggttcatttttcccactccctaccagaaacacaaggagatttttctccaacatttactgtgaggacctggtggagatcctggaggtaaaactcacaaaggtgtagagcacccgctccatgactgcatccccctggagtttatatccatgtataaactccagcaattcatcagttagtccttacatcttcctatcctggcaaaggttcctgcagaggtttctgctctgatatgccgtgtctgcctgtctgtctctccaattttttggacaatgagttgtcctgtgacctcattcctctgatggatctaaaaacaactgttgattcttcagtttgttcagcctttttcttcttgtttagatgaaataaagactcctaagctgcttacatgccagaccagaaactggaagtcttgcttgtacctgtttaatggttcctccatttctttccttgtcaccagatagctgtggtcacttctcgccgtgagcagtgtgcccacctctagttgaccctccacacgctttctagtgtgtgctgtggacaggaaagctagtaaccgagtttgttagagctgtgtgtaaaataaaagtaaaaaggctctgaagaaacatctcggagacctccgatgagtaacatgcattagcttctgagcaccttttgtgtgtcaggcattttggctgctcagagctctcagtcttgctctgctctgcactgcagggtagctgaattgagggaggtaagttctgcatggtgaaatcaagagcgatttcaacttccaggagggaaggcaactgctatactcaaaaatccttctcttttgaaaaattaagaggactgattacattatatcactttgagcaggttcttatgaagtaaatagaggcaagattaacaatctctgggtctcaggaaacagtgagtaacttgggaagattatatagaggctactggaagaaatataccagcttcataatttatagttcccatttattgaataacagaaatgtgccaggcattgttctaaaagcttttcaagaagtacttaatttttataaacacagtaaggtagatattctaatgaaatcacctaataaaatcaccattttattaggttggtgcaaaaataattacagtttttcccatacttttaatggcaaaaccacagttacttttgcaccaacctaatagaaacaaggagacttgcccaaggtcgtgcatcaattaagtgcctcaaattgaacccaggtctgcagaatctgaatttgtgcttttaggcattttcatttaattccacacttgttaattcttcatcagcagcagcattaatcagagtgtggtgttttccatccttataaggtcctgtctccttgtttacccaccccttcttggattatacgattatacagacacagcactctttttcatgatgctccaaccctaaaggtgagtggaaagcacaggagtctgtaactcccctggacccagaatcaaactgaaatgagatggtttgatttggagtcaggattaacgtggcccaattgagaagtcaagtaaaacctggggggagattaagccaagaaaggagatgccagctctctgccttccttgccagatggcaggtgtgtgtatgtgtttatataatcaatgcccacacatccggctgtgacttctcactcagagttatatgaacattgcaggggttcacaaactgtctggagatctaattaccagtttcataagcccaacagagtgccagccacagaaagcagccaggagagggaaggaggaggggtgcaagtgctgagcaaggccacgttgttattaaatgctacattcagcacctgtgccatgggctgagcctgccagtctccaagggaaagctgccaagcccaaaggcactgccaagctcaaaggcactctcaggcggtgagcctcttccaggaagccggtctccagaccatcactggcagaaagtcccatgctattcataagaacccttccctgaataagaatggcagactctactccccatgccagatgtccccagagggaagactcactaactggtcatcttatcatcattgtttgtagaccagaggcccttggtctccctccccacagtgatttctgagtgttgccattttagaagcagagacactgatgttctggggtccccacttaccctggcaaaggtccggaagccctggaggatgggtctgtagcctgtgcagcggcacagatttcctgtgggccaaggaaaaaactgcaatgtcagtgcagggccctgggatgggtgaggagtttgtgactttgcttgcaactaagttgggtgctctctttaccaggctgcatattctgttacctctgtctggaaggcctcttggccttctcatatcctgacttcagaaaagttatcatgatttcaggaagtctttcctagaatggaagccttcctagaatgcccagactgagtcaggtacctctcctaagtgctcccacagtggctgatcacagcttcatcagttagcctatcagactacattacaaactctcctcttcagagtatgaactttttgagagtagagggtgtgtcttttatccctgtggcataggatgtgactaaaataactgaataaatgatggaaatggtgaatagatggggaggcttctctattcaattcagagaagcagacacattggtggtcttggccctgcagaatcctgttctggtgaaaactgagagggaaggaaatcatatcactagcccccgtggagttttctaaatgacgtcttcctgcaccagccatgcactgccaaccccactccaatactggtggaaggcagacagacacctcagaaatatggacacaaaggcaggagaccccaggaggtctccacaccaaccaggagttctcccaagtaagagagggttggctttctagcagatcttagtcaccaccttgttggggggcctgagcccttcctccaaagggtagtccctcatgcttctcaccctggcacttgccctgacctctgcagggcctcgtttgccattccacctcctaggctgtgcctgaaggcccataccttggaaggcattctcaatctcctccatggtgggctcgggctgattccggagcagtgtgtacatactcatgacgatgccaggggtgcagaacccgcactgggagccgtggcttttggcaattctctcctaaaagatacagatgacatagacacctgggatggcagaaccctcccaggctccccaaaggactcgactggagccagcacatgttgagagatagtgggggtagtaatcactgcacagagtcaagccccagtgccaccatttaccaactgtgaccttggccagtttccaagccctctgagtctaggttcttcatctgtatgatgaggaccatccttgtagttacctctagagctgcgatgaggattaactgagatattcatgtaaaacccttaacactgtacctgcatatagcaggcagtcagccagtgttagctatgactaggaaggtcccttcaaagaacagtgactatcataaccagaaggcagcttctgaatggattgggtgtggcatatgacagaaacagtcaaaggtgatgtctagatttttgtcttgagcaattgggtggatggctttgccattgactcagatgggagaagactggggaaggaagccattaggaaaagagtagggttttcttaagtttgagattagacatccgtattgagatgtcaaataggcaattggaaatgtaacttctgaggggaggtcaaagctgaagttgtaaatgagagtatagggatgaagaaggggaggggcccaggtcagggctcagggcactgcagcaattagagactgagcagaggaggagcaagtgtggggagagaaggaaaagccagaaccacagtgtcacagaaaccaagagaaaacaaataaatggacaagaagtggaatctggctctgaagcctatttgtagccaaaataagttgattaggaataagaacctgtaccattggatagggaggattttaggttgattatacagatacaacctaatttggtttggctgtgtcctcaccccaatctcatcttgaattgtagcccccataattcccatgtgttgcgagagggaccctgtgggagataactgaatcatgggggtggttcccccatcctgttctcatggtagtgaataaatctgacgaaatctgaagggtttctgttttcacttagctctcatttctcttgtctgccaccatgtaagatgtgcttttcaccttctgccatgattgtgaggcctccccagccatgtggaactgaatccattaaacttctctttctttgtaaattacccagtcttggttatgtctttatcagcagtgtgagaatagactaatacttgactcctatgtttaaactgtttattctttctttcatctgtttgtttcaaagaaaataacaagccttaattaaccctctcacgtctccttcaggttggacaagtttagtaatttcccctcttcctgcctaagaaacaaatctatagatgggaagcaatcccaccccgacctggctggcctcacatgactggcccaagatgccactccaaggaatagtaccagcctctccgcaggaggctccagctccatcgcctgaatgacatgtctcctcaaataatcaagggaggattaagacctgggccaagctctggtaacttcttttttttttttttttttttgagatggagtctcactctgtcgcccaggctggagtccagtggcacgatctcggctcactgcaagctccatctcccaggttcacgccattctcctgcctcagcctcctgagtatctgggactacaggcgcccgccactccgcctggctaattttttggtatttttagtagagatggggtttcaccatgttagccaggatagtctcgatctcccaaagaccccaagtttcctcaaacaaaatgctttggggacaatggccgttccttccaacagggctctactcccctttctttccactcagcctaacagcatcctgattgtctccccaaaccagtctaagattattactgcccatttgccccagaaatgtttcggatttcaatgcattttcaggtggtctgataccatcaaggagaaagccttgctcaggcactaaatctctgtcatcttatttagcacttgctaacctccagtctaatgaaagaggaggcctagcagtttacatttgtactatctgcgggtgggaggtaaggggtgcagaattaccattgcagggagtaagtgggcttataaacaaggggcacagataattaaaattcaaatctgggaaggctgggagtttcctaaacacactccagaacaaagtgaggaagctcttctgcatcccttcctccaagttctggactggtctagccaccagattcagttggcctcttgggtcccttcagatcatgcaatgttataaccaaccagctcacaggaaggagcttcaggcttgggtgtttcttcttttcacctcacggtacccagaggagatggggaggtggccagggtgaaatgccttcttagattaagcagtgaaactcttcccaacaacccaaagcaagtctgcaactttggcatgagcctccctgcagaggaaagagcctgatctcaagagcacagctccctttcctctgtttacctgcacaggatgcagcctcgtcttggtgcttcctattccttccacagttgtcactgcaacatggtgcaaggagcagatgggggccaggcaggcattggcagaaaagtggctagaaccccagattaaggtcattccatttattgtccactcagatcatcagaatgggcctgactgtgagctctggaggactttgtgaggctttatgttacgtctctccgctcccatttatgttcttgtctcttctaccagtgtcctcacctctccactgaagactctgggaaaggaacaaaggaagctctccttataggtaaagctgagcccctccagagtactgtgggatcaggcatcagagcatcctcagcctctgagcaggagcaacggagccagggtcactttcagtcacctcttactcagcctgacccaggaggctgagtcaagaggaaatttctctggcaggctgcagccttaaagcatgctcctgcctgcagggctgttccttagcttccaatcactttgcttccctgcatttcctcgcctctattgctttcatttctctgtggggaaagggggaggaaacccccaggcaacatgagacagcaagcccttagctagaacttccttgcattcttctgttattcatcactcattcacttacattcagcatcagttattgagtgccagacataagtcaggcactctgctgagggctgggaaaataaagatgaataagatgaaagctctgcccttcaacagactgcagtcaactgagaaaaccaaagtccatatgaaggtgcaatttaaatcttgttaaagtaaattaaaaaggagaccaggcctgaagactcagcagaggaaaccagttaggcctcacaagtgacctaaactgtgcttgatttgcagcagagtcttaacttgagctacttcttacgaatatctttatattaaaaaaaagccttacgatcaaccaatcagaagtagtcaacaaacttataactatagtactagggactttccagtgggatagaccaagtaaggcaattgtataattgtaaccaatcaaataatttctttgctttttgcctgtgtccatcctacaaaaacctcctgcttgcatttccctggtggagctcctgaactgcttctaatgtggagctgcttgagctcatgaactgttgttttctcaaataaactgtaaaaattgtatcatgcctgagtttacattgggaatgctgtgcacagggcactatgggaccagcacagtcaaggggcacctaacccagtcttgagagatccaggatggcttcctggagggggtgatatttttgcccagttgtaaagagctagtaagagttagtcagatagagaaatcctaggagaacttcccagcttaaacaaagaccaagcaattagtgggcctgtgtcattggtatttcacaattatctctgcttgaatggagtgctgggcccatggtgagaaagaaaactggagaagaaacctggggcatactgtgcagggccttgcccgctaagcaaagagattttgtcctgggggcaatgaagagctattgaagggctttatggaatgtgatataaatgtggattttagaaaagtcattttatcagcagttcggagcctggtcaatattataagcctagaagatacttgctaagagatcattctacagttttcctgtgcacagattctccataaaaacaggggctcacacatgcgcacatgcacatacacacatacactcatgcactccctcacaagctggtcctgcatcgcagcccccatgtgggtggtcagccagcaggcaaaggatacacgatcttgttctgcagacgatcatacttggagagcatcactgtgcaagccccgcagcccccctctccacagccgagcttggttccactcagccccactgggtggtcaagagttaaggagaatgaactcagggagaggagtctgctgggttgctaggaaatgcctgggcagagctgtgggcagagccattcattcccacacgtgctcaggcccctcaaccaaggaaggcagcaggcccactggcctccttattcagaggggctgcactgcaccctagggaggcagggaacacggccatctccactgcacagaagagcaaaggcatcagaaccccatggacagcacccaagtagcatctcttgggacatgagttctaggactggtcagtcctagagccttctcttgggttgaggtcttctatgtgtgagcaggtaaatcatacacctgagcatacggggcagttctcacatcactcccagctgggcacaccatgaagccacttgggccagaatgagacattgatctgttctgggacctctgagtccttgcttttcactctgaactttttgggctgataagtccccaagaatcaaaattagggctagaccagaggcttttgaatatttggtccaaaagatatgtgaatggaaattaaaatagagtggtttttttaggtctgggtccaatattgggcctcactcttacatatacttgcagaaagaccatctgctactttgagttttaaaagtgcctaactggtaagctattctagagaacagctattgtggaggtcactttccctgagtcacatggctgcttctccctcagacctgcaggcctctaagccacccactacctactgaagatggagggaactgaggatataatcgcctggtcacttctctcattttcaagacaaaatttaaaaacaatgatataacatcttatttttgaaaagcactttcacctagatacctgtttgacctccagaatgatttggttagcaggtaggaaagaaacttcctcacagatttaaaaaaaacaacaaactgagacccaagaggtaacgtgggccacacaagatgacacaggaacacgttaccctgccggtgtggccccatcacagccatcggactccagactgggtgagctcccttcatcacgctccttcctccccagcacacctgggaaggttttctgtgtcctagtcaggatatatgcagctctcagcaggtcaaacaactttgggggcacctgaagacgaatggtggcacctgaagatgaatggtggcagtacaaagtctagcaaggtcttcttccagcctggagacctttctggaagctagtgtaaaagtcaaggctggagttttctcccccatctggaactcccataaattgactctcagcacagatagccataagctgcaaggtcatcctacttatgtgccaactttcagttttgcatttcatttaagatgtgacacagccaattgctgataaggaatttctgaggcttctgggccttcaaaactacaatggaaatgattaaaaaattaaaatttgttttattattagaaagctaaaattgatctcaataatctctgagaatgagcttctcttcccagacctcccaggtagatgggctgtaaatggagttccatgcaatcacctgatccgatctagtgacactttcactccccagcaccaccaggtttatcttctgtgaacctccagatacacccacttaaggtaaaaaatccagaacaaagtacaccaaagccaaccactgtactgtctgataggaggggagcaaaccagagtgaaagcatgggctccagtctcacttctgtgcgtgttataataatctttgctgtccccaaatatgtcactggaaagacccactagacacccccgctaggagaaggagggttttgttgacagaggtcaggatgagcacagtcctgctcacaggccccctggagagttgccagtgcgggtgagaggttgggaacacagctctaggctttggtgcaatctccatcactatttccccagaacacactagcaaaaggcaggtcacttcacatatcaaggcctcagttcctcctctgtgaaaagggagtgttacgcttccatgggattcctgtggagattgaggtgagctgcacaaatcactttgaatcctgcctgtatataggaagtgctcattaaatattaactccaattattattatcgttttagttccagggtcccagaatacttccgatactcagaactaaaggtaaaggggcttttccagaagccccacccacactgagtgaagagcagcaccccagtctttctaaggagtccccccaccctccagggctccctgtttgctgtttctacaatgaatgctacctgtataggattcttacctcacgcatccttttcccaatagacacatgttcccttgcttccctccacctaggcagagctggaaacattccccaggaactccatttatgtattaagcaaatgtcacctaaggaaggcccccctcttcccacagaggaatgaccatgaagctcaccaaggctaatgaggacctttctacaggccctggattaaaccttggcattactagagtcttagcggggagacacctcgaagatcaccacaaacaatcctctcattcagtagctgagaatttcagattacaggtgcaactaaaatgcaagtgtcccaagtcctaatccagtgctctttcctccacacctcaaggccaccccaccagtcactaggaaacaatgtaaggcctacagaatcagtcaccattgccccccttctccgtcactcccactccaaagtcaggatacactttcttctcaggtaggccaaaagggttgtctctggatctgcatttttctccaccacctattaaaataaatgaaagaaaaatatatcataggtatacttagtcatctttctgcaattaatttcttccttcagtgtctcactcaataatttgtagagttagtaggaagtgtgatatagtttgcactctgcccctctaaatctcatgtttaattgtaatccccagtgttgaaggtggggcctagtgggaagcaatatgatcatgggggcagatttctcatgaatggcttagtgccatccccttagttgtgaattagttgtcacgagatatttaaaagtatgtggcatcacccccttctctctctctcttgctcttactggccatgtgatgtgcctgctcccactttgccttctgccatgagtaaaaactcctggaggcctccccagaagccaagcacatgctggtgtcatgcttgtacagcctgcagaactgtgagccaactaaatctcttttcttataattacccagcctcaggtgtttctttatagcaatgcatgaatggcctaatacaatgtgctaaatagatcatgaaaactaaggtatttttatggcaactccataagaatgaacctataaactacagccagacaatgtatatactcaaatccttaaattctaaaattgtacctcaatgctcaccttgggacccaccacagaacatgcaggcattgcaccttccacgctggctcgaccaaggccaaatccccttcaaataaaacctgtcatctcatttcaactgctagatcacacctgtgaatttcaggggcatctgagagcatggcatgcagatctcggactttgcctctttgagtatacaatctcagatcctgcatgtgactgtggaaggccattctgttggcctgtgctcagagcagagtgttggcatgtgatgcgtattagtcaacactaatacatgtcagaaatgaaagagaaatctcaaaccaaagatccatcactaggttcaataaggtggaaaaagtggtctagaaagtgcgatgtcagttcccactgtgaattgtcaaaggaaatctacaaaaaccgatttcagtactcttcacacattaccaaagcttaaaagggtgtatattattgggataataaagagaaagaattcatgataaggttttcgttggagggaactatactacccacaccttcctaaaggagaaggggaggaatatttgcctcccacctcaaacttagtgagggagcttgctttgtgctacataaaaatctaacatgccacctttgcagcataggggaagagataggcttaacaagaaattaataccgacaatgacaagtttaaactcctcattaaacttaagttggagaggtggctgtgctggggttggtatacactcccggagcttggtagagcagaggatgtggaagtgtcgcctatggatgtaatgcaagccattcatgagataaaaagagctggcttggaggtctttaaatcatttcccaaaatacaggatagagcattcaataaagagagactgtgtggagtggacttccccaaactggaggctgatggagaacagcagcctgagaaaagtgcatcactcatatcatgagacatgcatgcaaatattccctgtggtggcccttgaagatccttgaaagccatcacaagaagaatgaaaggtcagctccaaacacctaaaaggctcagaaagccggaagccatcttacaatagtaccaattaaaggagagctttcttgctatcctcaccccgccgtcctgaattgagactgtttggcaacttaaaaataaccataagattttttattgactaagagtaataaaaagttcatgaaactgccagaatttgtcctttgaataaagtttaaaggaaagtagatgaaattaattttcttatgtgattacaccccatgagtccagcttattcaatatcctggttacaaatcatagaagtaatcataaatgcacaaaatagcaatctttatcacctttcttgtagacaacattaagagcctcttagcttaccaccacattgttcatttctcccgtactgcagttctgcttttatcacatcacatcagttccctgctcagtgcttttcatgaccacccacatattcaaggtaacatccaagttccttaggctgtctttcaaggcccttttcaatatattcccaatcttcattttcagcctttctcccttctacttccctgccaagctggtcatcttagtgcactaaaaatacattttatatcttctaattcctgtgcctttgactatgccattcctcttccacctgcattttgacttatcagaagacttcaaacaatttcttcataaaggctttccttatcactccagccacaagtggattgctatagagaatgactgtgccactctcaaggtgtgacagcaggattaccatggtgcactccattgaacactctcaacaggataccaatgggtatcccaaaggaaaaacattttgtagggaagtgagttaaggaaatgttgggttaagcagattgctctggtaaaacttgagcatcaaaagaaataacagccataatgggctataatacattaaatacaattaaaacctatgagtccaaatagagtcaacaaacaaacaaatggaagatatggaaaagctcttcctggcagaagaatgtcatctaataaatatgattggccatcttgtaatcaacacaattgatccagttaagaatcatcaatggaaattagtacagccactatggagaacagtttgaagtttcccccaaaaattaagaatggagctaccatatgatccagcaatcccactgctgggtatatacacaaaagaaaggaagtcagtatataaaacagatacctgcactcctatgttttttgcagcattattcacaacagccaacatttggaagcaacctaagcgtccgtgaacagatgaatggataaagaaaatgtggtacacatacacactggagtgctatttagccataaaaaagaacgagatcctgtcatttgcaacaacatggatggatggagctggaggtcattacgttaagtgaaataagtcaggtacagaaagacaaacttcacatgttctcactgatttgtgggagctaaaaatcaaaacaattgaactcatggagatagagtagaaggatggtatcagaggctggaaagggtagtagggggtaagaggaaagtagggatggctaataggtacaaaaaaatagaaagaatgaaaaagacctagtgttggataacacaacagaataactacagtcaataataatttaactgtacatttaaaaataactaaaaaagtataattagatcatttgtaacacaaaggataaatgcttgaggagatgaataccacattttctatcatgtaattattacacattgcatgcctatatcaaagtatctcatgtaccccataaatatgtagatctactatgtacccccaaaaattaaaaattaaaggtctttccatctccccttcttctcttttcttctggtttttatgtaaatgttgcaatgagccatcagtgactatgagatcaagtgtaatacagaactcctaaaactcaacaactataaaacccaattcaaaaatgggcaaaggacttgaatagacatttctccaaagatctacaaatggccagcaaataaatgaaaagatgctgaacatcactaatcagaactataatgagatttcacctcatacccattaggatagctatgatcaacgaacaaacaaataaacagaaaataactgtttgcaaggacgtggagaaactggaacacctgtccactgttgatgggaatgcaaaatgatacagccactgtggaaaaataagtaggacagttccacaaaaaagtaaaaatagaaccagcatatgatccagcaattccacttctggatttatacccaaaataattgaagtcagggtctcagatatttatacacctgagttcatgacaacgttattcacagtagccaaactgtgaaagcaaccaaaatgtccatcaatagatgaatggataagcaaaatgtgatacatccatacaatggaatattattcaacctgagaaaggaaggaatttttgacatatgctacaacataggtgaacattatgctaaatgaaataagccagtcacaaaaagacatactgtatgattccccttaagtgaggtagtttagtcaaattcatagagacagaaaaaatgatggtttccagggactgggagaaaggtagaatagggagttattatttagtaaatttatagagtttgtcttaaaagatgaaagaagttatggaggtggacggtgatgatggttgcccaatattatgaatgtatgtaataccactgaactgtacacataaaaatgattaagatggtaaattttatgtattttaccacaataaaaattatttaaaaaaagaatatcaatggatactcaaattagtgggtgaaaatttgatgaacaagaatttgtatcattccaaattatcttctcacatagcctctattaattataaaggtaaagaaaagttaccttacagtgaagaaacgtggtggataacaccttagccaagtcaccaaagttcgcatcacaaaaaagacccaaaaactgacgttaaaaaaacaaacataatgacagaatgcagtgagaaaaacacattacttctgtggtattcctgccccccaaatgcagactctgaatctaattacaagaaagcataatacaattcaatgtgaggaacattctaaaaaaaaactggcctgttcttttcagaaacaccaatgtcatgaaaggaaagctgaggagctgttctagattagaggagactaaagacatggcaaccaactgcaaggcgtaatcttggattccgggctggggttggggagttataaatgccagtattgggaaaattggaatacatttgcataaagtttatagtattacaccaaagctaagtttcttgatttctataaatggactacagttttgtaagaatatatttattctggccaggcgcggtggctcacgcctgtaataccagcactttgggaggccgaggtgggtggatcacaggtcaggagttcaacatcagcctggccaagatggtagaaccccaactctactaaaaatacaaaaacttagccaggcacggtggtgggcgcctgtaatcccagctactcaggaggctgaggcagacaattgcttgaacccaggcggcaaggttgcagtgagccgagatcgcgccactgcactccagcctgggcgacacagtgaaaccctgtctcaggaaaaaaaaaaaaaaaaagaatatatttattcttaggataagagctaaaggaacatgatgtctgaaacttactgtcaaaaggttcagaaatctatcttatactatatattcatttatattaattatgtacattaatatatagaattatttacgtacttataatacatacatgtgtatctgtgtgtgtgtccagagtgagaaagagagaataataaagcaaatgtggcaaaacattaacagttggtaaagtacataaagggtatttagtatttccttgtattcttcttgcagtttttctttaaatataaaataattgtaaaatacaaagttagagaagtaatttatttactacaggatttctcaaagttttaaaaattcatccacttattccatccacactagttggacacctactgtataccatgcactgtgctaagtggtttaagaatatccaagaagagcatctcatgctgctagttttctgtgaaatacatttcagaaggtattactttgtctaattataatccatctctctaactagtatatgggctccagaatggcaaatgcctgatcttggagatcttattcccccagtgcatatcctgttgtctgaggcctcagaaggagcttgataaatgttgactatatggggagtgagcaagtgaatgatgagtaagtgagtgagtgagtgagtgagtgagtgaaagtcaccgtgacgatctctgtagctgacactcacttcttgtggggatcactcctggacacctttggctgcacccaacctgccagatcctcccagattcttccaggtgccacagtctcagctagacagagtgactactcagaaaagctagaatgctgccttgcaaaaaggctgtcattacaataaaaataaaatactggacagctctttccctttgactctgactctagaacaaaagaagatgtgaatgaaaacaatagtcatcaaggctcatcaccaccacagaaggccctagaggtattcgacttcttgcatcgaacaccttctgcaggaccccatttagtgaagccagagtcctggacagtggtacaaaacaaggagaggagtaggctcacatttaaaaaccaaacactgcatgttctcactcataggtaggaattgaacaatgagaacacttggacacaggaaggggaacatcacacaccggggcctgtcgtggggtggggggagaggggagggatagcattaggagatatacctaatgtaaatgacgagttaatgggtgcagcaaaccaacatggcacatgtgtacatatgtaacaagcctgcacgttgtccacatgtaccctagaacttaaagtataataataaaaaaaaagagtcactaagttcttacagcttctttggtaactactttgcacaattcctgtaacaaaaggtctagaatatcttctgaataaaaatgaggacaactttctcacagctgccattgtttacccaggaattcccttgcttggtcttgtttttacagcattgctttcacataattactttctgcattgcccctctacctttcttgcagtttctgaagatgctacatcattataaattacaaacatggatattcatcacagaaactggcagtagtagaagcttctagaaataataggatttgatgtgatggtaccatcgaaaaatttaaaattactctcctaaagtgaaagtaaaatgcaagggaaaataattttccccaagccagatttaccttgaaattcttctttctagatttagtgcataacagcaagccatccctgaagaagagcagaaacttatacttttacaggttaaccaatggtttggtttaataaataataaaacctcagagtaagacatgaccttggacgtcattgaatctagctgtttacccaatgtaaaaattactaataaaaattccagagatggctttgtgtaagtagctctcctagaaagccaattgcacaatggtttcctagatttctacaatgtaattgctgaaggaaagaagttgtttgaaatgctggatgcaaaatcttacacttgaaagctttgccctacttcttgggttggtaccaggtgccaaccctgaaaaggatgcagctcagagaggaaactctgaacccagaagaacatggctgtccccattccccagcacttcccaaaggcaccactcaaagagagtccatcaatctttggagcactgacgttgaaacagttcatgaaatttcttttacagtcacccaaacacatcctggaaatttaagacctaggagtccagtgaagcacattattgttcttgaaaattataccaaaagtcactcaaaattacatcaaaagtttctcaactcaatgcaaaaatgccaatatagaaagacaaataaaattgcccttctttgggggacactttgggcacattcatcacgcacagtccacacagtaagttacaatgtgcaactatgggactcttttactatccttttcattcctaagtgggaagttgaacaggtatgagcatctcagcagtgttgtaggagggcaaatggaggctagtgaccatgtaatatgcttgccccctctctctctgcaccacattaaaatttgcaaagattctcactcttgtccaagggctggtacccatgtcaccttccctaagtccctgtgtaccaataaggtaaattcaagtaggtaacagatttgcagcttacatgtagaactcactgtgtgtgggtggggagtggggggaatgcaggagatgccctttatgaaaaaaaaattgtggtttgccacaaggtgtcagtatatgtcacctcacagtgaatcaggactggctgttaaacctatatatataatatattagaatcaaaggctgcgtacatcttatatcctgataaaagcaggaaaacacattcctgttccttctctctgtaaagagagcaacgtaaattttaggatatatttgattaaagacagaaatagaagtgtggtgatgacctcaaatctcacctagaactcaactcccctttctcattctgtgccaatctccactactgcagagagttggcagctagctcacagatgcctctctgcttgcctctctctccctcattctttggcctctgagtatcttgtctgtgctctagccccgagaaggtcttcttccctaatgttaccaaaatgcagcgacacctttaaagcgagagagagaaagacagaacaagtaagaggggacaggaaagacagagaacaagatatggctctgccagaggacacatttcccctcccagggagaagggacacaaaaccaaaggtcagctcctacttacctttctgccattcacaaagaaaaccaatttgtctgctgtcattgtcacaggttggggtccccgaactccaggtacctcactcctaagagacactggcaggtagttatcactgctctgtgacctgaaagttacgcctcccaataaaatgaaataaggtccaccaatgggagggaaccagctcagagcttcagggcatgaagagttcttggcaaaagccactggtttacataatcaaggaagtgcaaacaatcacacacagcaaattacaatctccacacctgtgtcaaagagcacaggaaactacatccagatatcagtaaggttgttgacttggcactaggcgactgtgggtcttgggcgctgctcttatgaaacctgcttcgtcctcccacttgctgcaagacagagaaggggaagacagaggagggaaaggactattctcagagtcactgctaatagagctgattcacaccctctgtgtctacatttgtcattttaccattcaggtttacagcaacacagactgactgcatgaatgcaagagtcattctttcacagcctggtggagcagagaggtcacaggacatggagccccatgaacctgactcaaatcctggcatttgacctcagcatgttacttactaccttcagaactcagttgctttcatcctgtacaggatcatagaatgatatcaagaatagaagaatgagggacaaatgacattttgggagtgccttgtaaatttgcaaagaaccaaaacatgtatcactgttgaaaagacatcttcaacatctcaacaaataaaatcctaatagcaaactatttttgagatttgtcttttatttgtttctctcaggaaaatatccttgacaagttgtcagagtaactcataaaagtatttcaaaacaccaaataaattaaaatgctcataccacatagtcataggctacagtaacacatagctgaaaacctttccccatccaatatccattaactctcagtggaaacacagatgtgcacgtccactggagcagcactaaagggctctctgcagtccagcaccctcccaactgcccctaccagttctttagttcaacacacacacacacgcaaaaaaaaaaaaaaaaaaaaaaaaaaaaacacacagagaccagcattcactctggtcttcttctgtcctgtaatgacccatacagtggctcagccagccttccttaagtaagacacctcccctacaaccctagcaggctacctgagggggaagaaaggagtattaggcagatgtacttgatatagcaacagcttagagaaactgaagactgacaggacaaccacacaatcaacacaatgccccctctcaccacagccttaatttaaccaggagatgaaactttacttgttggttgaccaaatatcccagtttgccctggactatcctagttttagccttgaatccctgacaaatgcctcagagatcctagtaaatccttcagtccagggcaaactgggatggttggtcactataaaactggttgttggctgggcatggaggctcacacctataatcccagcactttcggaggccaaggtgggtggatcacctgaggtcaggaattcatgaccagcctggccaacatggtaaaacctcatctctactaaaaatacagaaattatctgggagcagtgggccacctgtaatcccagctactctggagactgaggcaggagaatcacttgaacctaggaggcggaggttgcagtgagctgaaatcatgccactgcactccagcctgggcgacagagtgagactccatctcaaaaacaaaaccgaaaccaaaaccggttgttaaatctgagagattccctaccccagaagccacttggcaatgtctggggatatattttattgtcacaactggggagggatgctactggcatttaatggatggaggccagtaatgccactaaacatcctacaaaccacaagacagtcccaccccaataaaatgaacaacaatgaatgtcaatagagccaagctggagaaattctgccctgaaagaaagaaggaaggagctggggagagagagagactgagcctagggcatgttttgtaattagtcaattcttccaaaccctcacacctctttgattgagaggcttttcctccatgcactaatctacccaatttaacaagccctccccttcctcctaggcattccccagccaatgctccaggaaaagctaaagggacgggctgaggaaagagctcaggctttggagttccataggctggcttgaatgttagctccaccacttctgtgtgccgcctttggcaaaaatctctctcttggcatcagtattctcatttacaaaacggaggtggccataattgcttggtaaggaccaactcttagctgaatgaaataaaacatagattaaatctgttgtccacaggagaaactaatgttggtgtgcttctccccactcagcaaatcttcaacccctctcttaactagaggtgaaattcctctctattactatggagcattgaaagataaaagtgaaataaattttcaataagggtttgtgttgtcatgcagaattttcagctctgtaataactagttgaaaccccaaatactgacatttgacaaaaacttgaattagtatgattacttattatttagcaaagtatttgccaccattttctttctctgtgactttatttctttaattaacattaaaatcatacacatttatcatgtataatatgatgtttttaaatatgtatacattgttaaatagctccattgagctgaataacatacatgttacctcacatatttatcatttcttctggtgaatacacttaaattgtcgtagagattttcaaaatatacatcgttattaagttacagtgaccatgttgcacaacagatctcttgaatttattccttctatctgactgaaattctgtattatttgacaagcctagctctatcgcccaggctagaatgtagtggcgtgatctcagctcactgcaacctccaactccctggttcaagtaattctcctgcctcagccccccgagtagctgggattacaggcatgtgccaccctcatgtttggttccaaaattctctagaccagttaaatggggcctctgtctgtttataacaaaggcatggagaggctgatgaaatttttcctaggaagaagtactctctttttctcatttgtcttgaacaagttcacaatctttgctcacagacccaccattgaagcactcccatttagccccaggtaatttttgtatttttagtagagacggggtttcaccatgttggccaggttggtcatgaactcctgacctcaggtgatctgcccaccttggcctcccaaagtgctgggattagacctatatttaggtgtctcaatgttgggtgcatatatatttacaattgtcatattctcttgagaaattgagccccttttcactatataataattttttgcctcattgtacagtttttgacttaaagtttattttatctgatatatgtatagccaacctgctcttttttggttttcattttcatggatattttttcccatcccttcgcttgcagtctatgtgtgtcctaaatgtgagatgagtctcttgtatgcagcttatagttgggtcttgttttatttatttatttttccattcagccactctatgtcctttgattaaaaaatttaatctatttacttttaaggtaattattaataggtaaggacttactactgccattttattgttttctggttgttttatagatcttttgttgcttttggcctattttgttttcttactttgtgattaagtgattttctctagtgttatgctgtgattgcttactttttatcttatgtgtatctactgtaggtttttcccttatggttaccacgaagcttacataaaacctcttacagttataacaggctatttaaagctgataacaacctaactttcattgcataaaaaaccctaaacttttgctccattctccctcacattttgtttttgaagctgcaatttacatctttttatattgtgtatctcttaacaaattattgtagtcattatttttaatagttttttctcttaaccttcatactaaatatataagcaatttacacaccaccattacagaattagagtgttctgaatttgactgtgtatttacttttaccactgagttttacactttcatatgtttttgtattactaattagtgttcttttctttcagcttgaagaacttcctttagcatttcttgtaagacaagcttagcgatgtaaacattctttccagtttttgtctgggaaagtctttatctctccttcttcatcgctccttcatttctccttcatttcagcttttgaggtacaataattttggttggcagagttttttcttcagcatcctgaatatatcatcccactatccctggcctgtaagtctctgctgataaatctattgctaatttcattggaactctctgatatgttatttgcttcttttttcttgctactttcaggatcctctctttggtttttaatggttggattataatgtgtcttggtatagttttgtttaattgaaccttattggagacatttgaccctctttacctgtgtatttatatctttccccatatttgtaaagttttctgctattatttctttaaataagctttatacctccattgtctctctcttctccatcttgagcttttatgactcaaaatttgtacttttgaggttgtcccataagacccataagcttttttaaaattcctttttatcattttttttctcctttggctgtatgttttcaaataacctgtcttctagttcacagattctttcttctgcttaatcagtattgcttttgatgctatctattgcatttttatttcattcattgtatttttcagctctataatttctgtctttttaaataatttcaatatcactgttaaatttcccattttggttgtgcattgtgtttcctgatttctttgaatttctttatattttcttgaagttggctgaacttccttaaaacaattattttgaaatccttgtcaagcagtttttatatctctatttccttggggtcagctactgggagattattcttttggtggtgttctatcaacttgctttttcatgtttctttctgccttctgttgatatctgagcatttaaagaagtagtgacttattccagtatttgcaaactggctttgtctgggaaagtttttcaccagtcagcccgtccagagatttggggcaggttgtctggtataatctgagagtgggctttctgctggagccttcaggaagactggcctgatgcctaggtcagcaggtgagtgggcctggggtcaggatccactggggtagacctattgattgaatccaagggcagtaggcctggagcctgagttggtgagggcaagcctggagcctatttccactgatgcttgatgtctgggtctgtaggcattgacctggtgctgggataagttttgaacctgaatgtgcaggggctggcttagggtgctagggtggaacctgaagctgtggggtcacacttggcaccagagtgggcttggaggtttaatccccaagtggattggagtctgggcccacggacacctgcctggctctgggttttactctagtggacccagtgttgggtccaaggcaaagtttagtgctcaattccctgtccctggatatctccttggagatcttggagagatatccaagtgaaggatatctctctccactgtgctgcctagggttggggaagtggtaacacagataatgtaaaactattcttcctaccctcttcaatgcatcttttctcatttctatgctgtacccaggtgctataatctctcagctggtattcttagctcttgtgaaggcatttttttttgcatagatatttgtttaaattgatgtttctgcaaaaggatgagtgctgaaaaatcttattccaccatcttgctgacatcagtctcttctttggtacttttcaaaatagtataaatgaagggaaaaaaatctaaagtcagaactttttccatactgaatatctactgtatatgcttttcacattaggatgaattctgaaattttggctgaagtaatggaattttaccacctggtaatagaccaactgtgatgtacattttattacattaacttaccttattctcctaagagatatcttggcttttaatatacactgcattggcatgtgaggctttaaaattcatagaaaatccagataagccctgaggccttctggacacagacctcttcccagtgggagccacactttcaggaaatcataaaagataagaaaagtaaaaatgctgccaagagtcataacttattttttgaagagtgagctccctcagggccaagtacttcctggaagaagatgattcaagaaagactatggagtgtttcctgaaaggctggtcagagctagaccagcatctgtggagactttagtgcttttgaattcatgccctggccttctgtgccctggctgtgtctctagctctctttagaagtcactgctggcctttatcctgcctctgcagcagcttcttcccagtctgctccgtcctttttcttttcaaccagatgtacattcttgtctgtaacctaagggcattcttgttcattttctttatttacaacaaagtttactttaaaagaaagaaaatgttttttcaatatattccattgttcagatttttttaaccaagactggtttcactcctacatatgctccactctggatgaaagatttttgccatattctcagagcattactactcaacacccaatactcctttgttctctcagacatctatattattaagtaatcctaataatagttcttgactatgaataacatttctttcacacatcttgatttcatttgatccttataatagccctgtgaggtaagtaaggaagttatttttatcttcctttttcagacaaaagcaagtgagagtcagagaggttgacttgccaactgtcgcacgacaagcaaatgccagtttctacatccgtcacccatttcccagcagaaaagttatctctctgatggttcttcactagtaaaaccaggattgttagcatagcatttatggcccttcttagtctggctgaaatccagctttctggttggtaaagtgtctttctctcttgcctagatagtgggcccctgagattaggagcagaacagtgtttaccactgtttcactggtgcctagcatagagccagatctatagaagcatcaaaaaatgtttgttgaattgtgtccacagtgcaagggatgagttatgttttcacaaatatctaagcgtctgccttttactaaacacagaagtttcttccgtcatttcatagattctcagcatcatttaacttcgtttaccagttccattctaactaaacttttgttagttaaccagctagtattccttaagataaaggtcacattacttcattactatagaggaaatcaatcaatcaagcaaatacacatctgggagaatcctcttaggaagatgagattataaaaaaaaatggacacagtcaaaactaaaagcatgtaaacttcagcctgggtcttcactgcaaatacacaaaggcccagggaatagaaaaggccctcgaagcaaatgtaaacccacttcaatctgtctgcatcatccttatgttttttataatgtatttttcactcaataaagtctgtcaccacagagtcacgtgtggcaacgaccatgtgggtttggtggctagctggacaaagtaaagtttctctttccactctgagctgctcttgcacaattcaggaaagtaagtccttacctcttcacttattcaaggatcaactcacatgtgatctgtagacaatatagaccaatgagtagccactggagaaaattattattatgactatttgcacccttaattccttcccctgatttatttttactattatcatctgaaatgatacatagtgcactcacttatatgtttaatgtctgtcttcctgcacccagcagaacgtaaatgtggcaggaatgtcaatcttcccaccaaatattcatgctctccttctctaatgaagagtttctgctgggaagtcactatccagccaggagctacattttgcagctcccttatatgtggctaaagccacatgattgaatattgatgaatgtaatatgggtaaaactgatgtgtacaatgcccaggctcccattctgtcttttctactgtctgacaactgatgtcaatgaccagggtgacgttggaagtcacaaattgaagacagcagagctttcaataaactcaagtgcttaaataaatataatgagctgaacatttccccctacccttgttgcttattgactttacaggaacaaaaaataaatttctattgtgcttgctcactgagatttctgggtttatctattattgcctctagtattacattcactaatacaataaattccacaaaggcagagatattatctgttttattcaatgctaaactctgcctggacatggttggcatactattatattcaagaagtatttgttgaataacaaatgaatgaatgaaaacgatatcagaaccaggttttagttaaacgcaaaggagcatagctcaaatgtctggcttggccctcatgcaaagctgtgtgtgcaaatggtatcactggggttcataggctcctcaggagaacttattttcttttcttttctttttttataaagtgtttcttttatttctgtttcttattttcaagccatcccgttcatgttgcaaaggcagtgtagtggaaagatcacccaactaggagactggagaccttcatttgaatcttgatcctgacactaacttgctggatgactttgaactagctacttaactattcagggtttcctcctacctgatgttggagagttgaacttgatgctgtctagaaagtccctcctaggtcaaatatttggtagttcatctgagtcttttctgtcttgtggctctaatccacacctgagtggaaccattcatttgatcacttccctttttcatccattcataccacaaacaggtgttaggtccttaggagaacttattttcatccccaggtcttcaaccttaagtgtccccattcccatactatgttttaaggatggattccagagcaacttctacactaggcaatatttacacatccatttactgatcaaccataacaaggctccgtcatatgacatatgtcaggcactatgctgggcactgagtaaactctagggacaaagaggcttaaagtgtatccttactgtatcttagaaataaaccatgagccaacattataaaaactgaacccaagctctttacttaccctcctaaacttcaccactccccagagcaaggatgctagtatgatttagataattgtcccacccaaatctcatgttgaaatgtaatcttcggtgttgaaggtggagcctggtgagaggtgtttaggtcatgggggcagatctctcacggcttggtgctgtcttcatgatagcgagtgagttatgagatccagctttttaaaagtgtgtggagactccctctctctctgttgctcccactctcaccatgtgtcgtgcctgctccccttagccttctgctatgattaaaagcttcctgaggcctctctagaagctgagcacatgctgtcaccatgcttcctgcagagctgaaacataagccaattaagcctcttttctttatcaattacccagtctcaggtatttctttgtagcgatgcaagaatggcctaacacagatgcaaaatgcaggctgatatattgatatatttgaaataagtgtaatatgaaaatttgagcacttcctccagatcgcttgggccaacttcctagttttattacaatggactctaagaagtcaattcagagcacaaaaggctacaggaagatcacctgctgttcctgttctaaatttgttcttgtactggaactctccacaggaactcagtatcgttaatgctgttattttctttgttttacttttaaaaagaaaagaacctcttttctcctgcaaaaagaagtccattaaactactgtttgcatccctaggcatataacccccaaaaggagcatattccccaaagcaatcagggacagagggcaagctgacaacctcagatctgttctctagagtaagtttagttttcccaacactcaaggagaggaaatggaaactggactgactttctccatagagtcttccctactgcaggaatcacttactggtggtttgatccatgcctggccaatattgtcttctactgatgggacatttccttccactctttttcacacttttggaaaatgtctgcccctttctccagagctttgaaagtaagttgatgtttggcatttatgggttaatatttgagattttggctatttgtgagtaattctgaaagttcatgacataatatttagcattttctgaaacataaattttatctcatgagctacaataacacagttgcctctcagcacactgagcaagccttgttgagaattttaaggggatttcttgtatcattagctttattttggtgcattttatgaggattgggtaaattaagacattcatatctctttattgatctagtaagtagcttaaagctcttttaggagactacaagttcttgctttcaatgcttccccagaaggcctccagcctgctggccaaggcaaaatcacctccatagtgagagacagtttgaggaggacaaaagtttattaagagtgtaatatgtgccaggcattccatatttatctcatttacttttcaaaaaatccctatgagagagatacattttttaataaataaagaagctggctggactcagagaagttgtcacaaaaagtcacatggctggtaaggtataatcaagactcgaacccaagcccctgtgattctagaatcttctgacagcaatagagagcagaggctgggctttcctagctggacaccatccaggatggcccctttacactgtataggcgtggggggcagaggaaaaaccatctcattgagtctcactaacgcagggttggcagcagcagtgagaaagtttggccttagaagaatcagagtgaggagagtagaagatgaaacagcgtgtagtgtgacacagcaggctccaaggctttcaggcctgtcttaaaaaaactcatggacgtggtttgtttctctgtttttaatgttacaatcacaataaagtgctttgaggaaggaaatcgaacaagaatcttgtgaaattctgcaaacccaaactaaaatgcagagtgtaaaaatgtcacagggaaagaaaagaaccagacggtgggaaatcgatagaatcttagctgtcattcatttgatagtttggctcggggagacctagagaagggccccaggttccaggtccactctgccagaagcagcagatggaacggaacttgttagccactgccaactccccccgggtccctgagcccaggatatgcagagaagggtgaaggcgcggcactcttgcagggtctgcccagtgcttggatttgctcctcattctctcaggaggaccaggggcttctggaaatcagtggtccctggtggcttggaagctccctgaaacatggaaggaagatggatctcaatggggaaggttttgaccctccatatgtcacgtctgtggatctgagcagaggaatcgatagacttagcacaatagcagaagagagggaaggcagaagacctgaaggaagagcagcagaggaggggcaggcataaagaatggtaaacatagaatggcaaccatagtcacctcagggatcagctcatggcctcctggtcaagcttcctctccctgtgattcttggctgtcttccatctgcagctaagtagccagaccagaatagtcaataattctagtgatctggcaactataattttctagtcttgatgagtatcggtattgtcactgtattaaacttcccctattcgtcatctccatctgatcatcattattattctaagaatcccatgtggaagtaggaactggggtgacaagaatctgggtgctggctgccccttgaatgcatcccatggccccatagccatgactgcggtgccagtgaagcagcagttcccaggaaatacatggattgccttgcctggggctgaatgggagtgcttcaatggtgggtctgtaagcaaagattgtgaacttgttcaggacaaatgagaaaaagagagtacttcttcctaggaaaaatttcatcagcctctccatgcctttgttataaacagacagaggccccatttaactggtctagagaattttggaaccaaacatgaggttgtgatgaaaccatggaaagagtcccagtctaggaaaagagagactcaggtgaaagccaaggatttgctcctctctctgtcacttttggcaagcccctttcccatctataaaacttcaaggacccttccagctctaacatttatggatattatgacataatacctgtgtgtgtgtgtgtgtgtgtgtgtgtgtgtgtgtgtgtgtgtgtgtgtgcatgtgtggtgtgtttgcatcctcctttctggtggcctttttattcacaccatctgatcctcacccatttctgagcaagttgggtccatgctacaggatattcccacttgtccagcattggaatagctggaatgctaaggaaaagagtataataccagattatgaaagttctgcagtccattttgtggttttttatttgttttttttttgagatggagtcttgctgtgttgcccaggctgaagtgcagtggtgcaatcttggctcactgcaacctctacctcctgagttcaagcgtttatcctacctcagcctcccgagtagctgggattacaggcatgcatcactacacctggctaatttttgtatttttggtagagcctggccttcaccatgttggctaggctggtcttgaactcctggcctcaagtgatccacatgtctcagcctcccaaagtgctgggcttataggcgtaaaccaccatgcccagactgtgcttgtcgttttcatgtaactgtttgaaccagtatttcctaatatagaatatccttgagtaatcctccttttcgtaagcctctgaaattttcttgatattcttgtagcatgacaaaatatactgtcatcctaagactcttgtccaccaagggatagagtgcattctctatccactgggaaatggaggtgataagaacacttcctgctgacaaagtctgatgcttctaccaactcagcccagtaactctgaaagtggactcaccaaagacagaagtggctcacagccccacctggaggcccagacaagaggtggctctgccctgggtctgctctttagagggctctactctggcatgcctgtggctatgcctctccccactgggtgagaagttcattgcgcctacggaatgtgaccattcagagcctatgtcactttctgtttacagcactccccgtggatcagggcccctgcccagtgacctccagctcactcccaaggcccagtctggccatttcccttggcctatcaccgcagaggggacctgtgcttctggtatgtccaccacttggctcccaagatgtatatctctaggtgccctggggtgacgactggggcagtgggcataccttagatatgtggaccatattatccacccatgtgcttgagagaggattgtcacagaatggggcaaagctagggatgagaagtcaagttagggaggggagacagtatggtgaggacaggggaaaccagttttctggagagtctgaaaatgatcaattataacctgatcttcagggttattatgaaagtatacttgtcaagtgaggagcatagaaattctgatttaacattttttaaagttagtttacaactgttaagaatgaaaacacctagctgatgagcttccatttgtacccttgccttgagccctgcaaatgtgggagagggcctggaaagtggtactgttcccacagcttgaataaatacaatcaaggaggacggaaagatgttgagaagttgcaaagatgcacagtttagggggaaatccctcctaaaactcaaagcaatgcaaacagaaggactccaaaggcactgaggattcacagagcccagcacaacccgccctggcctcagcacacaagcttgtgccatctggacccatgtggacccagcccaccttccagcctcatttcccactacctcacccacacaaaccatctttggccacaatagactactctttgctccctgaacttactgccagttttacacctcaatgcttttgcccaggtcatttgctcagcctagaactccctttcccctaataaaatcatgtaaagctcagcttaaatgcaaccagctcttaaaagcctatgaccttggactccccacacaaccacacctagggaaactcactggtctttcattcatgtccattgttattttatacctatgtctattatggcatatcacacagaaaccagatcttacttgtttttgaatccacattaacatgtagtagtggtcagtaaatacttgctcaatgacttctgctcagtaaagaaaagccactgattcttctcaaacagtctacctaaggttgcttccctctcacccggaagagaaagtcgtcttgtgcttattctcctcatcactcttctcctttttcttcctcttcgccattgttatgaccatgcactgtggtttaatatggttttcttgtttatttatatacatcaattcatggcagcttcatatatgtgatattgtaagtctcattttctcctgaagaaatagtttctgagagtgacgaagcagcagaactttcacttgaagcccacttgttagttctagaatcagcactccttctactccactagatccctgaggttcagacctgagcactcaggtgggtctcacgacagagcagctgatgcagggcctggtggaggatccacacagagatttaatcagcagtggattggggccaagaaggaagagtcaggaaggaaatccccaatgtgtgaaaaacaaaaccacaacaatcaacaatgaaaatccagggacagggaagtgagttccacctaaataaaccccaatcattggacatgctggcttaagtgaactaggactttccagaaaacgggaggtcacatgggagtgactcaaggtttcaacctctgagggcaatgattgctggaaactatctcacaaggaacacttctgaagggatttggaaagaatgcttgctaaaggaaggaagcagtccagaaatggacaaatgaatccataaggaagggctgagaaagggacaggtgggaaaagcggtctcggtgaagatgaaggaggaagtcagaaagtagttcaaaaaaaccaattctagcagacggaggatgagccaggcactcctgcccacctctgtggccttgtggtttcctgtggcatgatgccaacttaattctacacaagccaggtgagtcagtgctggcaagaagtcactgagaatgggccagaccatggacttgtcttccccaactccaccaaaagccctggaaagtgagacactctctctcatttcccgctgagaaaggagaagcccctctgcttgctgcttttcccctctcaaagctcttcctaggtttcctctttgccccttcaggaagcaaaggtctcacactcaagtcccttactgcttagccgtgcagtggggcagctatgattcacttttacattgtgttggaagcatggcgctgcatcagcatttgtagaaccagataaggaatacctacattaataccaacttgtgtctgtgaaggccagttttccagagctaaagaataaggcgtgagagtcagatatcaactgcaaaaatcagtcatttgtctgacctaaattaaagactcatcttcacgtgcacagaacccgccttctccctcaattagggcctggagatccatccctttcctgtcagcacccactgaaaagagaggaaacagcaaggaaagggtgggaagacactgcttctgtacaaagcttaacagaactcaggtgtgccattcaaaattccaccaggagcttcctcaaggcccaactatgacaggccttgaaatgtccagcagaaccacaagctgacaattagtcaccatcaagagccggtagatcagcttgagaaaagacacggcagcagccagcaggcacagtgggtggcaccgtctaagatgtggatgtctgtggcagccccagcatgtccccctaattatggtgtgctctttgactcaggagacatcacctacaattagttctgggacacgttctggggagaggggcctgcagcaggctttttctcttctgcagcacctgtggtacacagatagacactgggtgatacctaggaaggtctcgagccagcagctccaaccgagccctgtgcctccctggtttcctatgggggcccgaagcttgtttttgctggcacaacctatgcccgagtaaccgacaggaattgggaaagaaggctctgctgttttgactccaaaacttgcctctcagagctcttccattacacttgtaagaactaatttttgtcacaaaggaactattttcaggagactgaaaaatatccttcaataccagaccagaaggaagagctttcaaagaaaaagatcctagggatgagatttagagaaggagatattagagattagtagtggtctgtgcattttcagtaacatacagaatggaagggatagagagacagaggagaagaagaagaagcaagaattcaaatgtttgtagatctcaggttcacaactcactagctctgcatccattggcaagatctttatactctctgaccctatgtccccattatttaatggagacagtaatagtttccttacctggtggttgtaagaagacaatgtttgttaatgccaggattagagcaagtatcaagaagtgtttctgaaagcagaagttggagcttggcagtattttatacgtattttatgccactctcccaaagacttcctggccgtgtgcacctaccaataaagtaatgatgttctctcagcaccttctagggaaaaggttctgaatcccacattgagacacagcaatgaccaccagcaggcagagagagagagagagagcacgaactcctcctgtgaggcctgtcttgggccaaactgtggaagtaagtactccttcctatcacttgtggactaagtggtctcagagattggactaagtggtctcagatatccagggatctggctgggtgcggtggctcatgcctgtgaatccagcactttgggaggccgagacgggcggatcacaaggtcaggagatggagaccatcctggctaacacaataaaacccagtctctactaaaaatacaaaaaaattagctgggcgtggtggcgggtgcctgtagtcccagcttctcgggaggctgaggcaggagaatggcatgaacccaggaagcagagcttgcagtgagccgagattgcgccactgcactccagcctgggcgacagagcaagactccatctcaaaaaaaaaaaaaaaaaaaaaaaaagatatccagggattcaggacccttacagatcaggagatcaggtcctatccaataaaaatgcttagtggcccaaaggccagcagtatggatttgggttagaggatcaaagtataactgtattctcattctctctctttactaagacatacatatctaatatgcttaatgttttgttcctgattctttactgtcttactgcatttgggcccagaggccctgacttctcaagcctggagagattcaaccaaactaaacctgcctggaagtgatacatatgacttctcatattttgttggcagaaccagttgcagataactttaaggaggtatgtccatcagtcagcttagattgtgttaaactgtgggaatgatcacccaagtctcaagcatttatagaaatagtgattttttttttctctctcatacatcctgtggtcatctaataccctgggctccaggctgaaggagcagcctctatgtgagacaatgtcactctcattatagatagaaaagaaagtctgtgggctgatgtaatagctctaatgcttctgctcaggagtggcattcttcacttctacttgtggaccaaaatgagtttcatggtcaatatctgataccagagaagcataatcctcctatgtggaggggcaccacctctcatgtggccaagactgatggcaaaggtagggaagtagaataatcttatcacacagaggcagcagatactgggggcaaaacttaatctaacacagcaagaaagtataatcctatctataactcaaagtggaggggcatgggatatttgtgaatattagtgacatctaccattactagcactgtaaatgtaaacacagagggctatcgaatagaacttcgtcagagtaaaccatacaccctgcctggaggggatttgggacagttacacagaaaaacagacaattgatccaggcctgaggttggagaacttatcattatgtacctcatattcattcaacaaataattatgagcatctactagaggccaggaagtgcacccactgatatacaatggtaaacaaaacaggccttgtggagatcaaatatctctagagaaagctagcattaaataaatatatatttattgtaatcaacacacaaataaatatatatttattaatacaaactggcctacaggttacagtaggaaagactggcctctcagaactctttcagagacagaataaggccactttgaggaagtattgttggaattgagagttgactcagagttagccaggcaaaaagtggtggaaagaatgttccaggcagagcgaacaggttgtacagactcgctgagatgacaagagtttggtatacctgagggaccaatgagaggagggaaattactgtagcgagtgagtagaaaagcaattcaaggggaagttggtgaggaaagctaaagcatgcctgagatcatgttaagagttttagattgtgttttacatgacataagacgttgatagtattcagtggctgggggagtttgtgtgtgagcatgagacattgtcctatatccatttgtttaattacctggctaccacatggagagtggattgaagagaggcaggagttattcaggcaacagtcaggcaaaagatgatgtgacttgggttggacctgcggagatggacatggacatgtgcataataattttaagacatgttttaggggcagaactgatagcaatttgtgatgaattagaatatgttgggaggagcaatgagtcagaaaaaggtagcaagaaagatggagttggttcttcctaagtccaattcacccagaagagaaagaatgatgaaggggtgggaataagggaatcaaattttttcttgggacatgttcattgtgagatttctgtgagccctctgagatagaaatgtagagtaagttgttgaaagtgagagtctggggcctggaataaaggtccaggctacaaatgtttgtttaaggatcacagtatatagtaaaatccaaagtcatgggaatgggcggaatgcaaatttaaagcaagaagagaagaggattgtggactgcttgctccctaaataactcaaatattagagttcagttggggtagtggggagaaagggctgctggcaaaagagtctgagaagaccagaaagctgggagaaaacttgggggtctggtgttaaggaagccaagagatgaagcatgtttccggaaagaagtgtttaacagcctagactaccgcagaaaagtccagtgcgatgaggacactggctttggcagcacaaagtgcccttcgcaaaatccatttctatgaaatggaagaggcagaaaccaaaactgaatacagtgaggattaaatgagaggtgaggatgagactgcagacaactcttgcaagaagtgcagttaagggagacagagcatgggggcaatagctggggatgattaggataaagatggtaatgtacaaatgtctgaataattattggataaatccaatagagagtaaagatggaaatgttaacgatggaacaaaaccggctgatatggcaaaaagggggagggatcagagcacaaatggggagtctgactttgcagaggaaatgaaatctcttcccagaaacagtaatgaaggagaaaaattgggtggtgatgccaccaggtgtttgaatttggtagtggagagaaacaggtagagtttctgtattgtacactgtgggatttggggtgagggtggggtggtgtttgtgtgttttgtttttaattaatatgagacaaggtcgttagctgagaggaatacagggtaagatgaatacagctggaaaactggagaatgtacaaatattccttgaggagagtcaaagaatggacttatctcggctgtgtggtgactggcagtgccagtttcccatttgaggttggaaatcatgagcctagagtagtacttgttatcacagaagtgaaaagtcacatcaatctacccaattgtgggactgttgcacagtttcaactgcatggaggcaggcatggaaaaggcagtgaataggtttatgcagaattgagttgcaacaggcacatgtaataggaggaaagaggtgagagagttgagggtatctgcaagggagggcctatagtaatggtccattgacttgtacctgaatacaaggtactgtggagtgcttcatgaggccaaggagaatgtaatcggagaataggatatttgagtttgctacttaagcattggtaaaattataaatggctaccttttaatagagttatttccttcttttaaatttatataccattaaaggcacaaatcttaagtatacagttcaataatttttggcaaatatgtacactcgttttgcccccacaatttgtgtcattccagagagttctttcatcccttttccaatcaatccccactccctgcccccaacagtagcagctactgttcttatttctatcactatgcattacttctgtctgttatagaatttcatataaatggaatcatggagtatttattcttttgtatttggcttctttcactcagcatgtttttgagattcatttatttagtaattcatttttttattgctgaatagtattgcattgtaagaatacaccacaacttatttatccactcttctgttatgctgggtaacagaataggtgtgtgtttaacttcgtaagaaacttctaggtagtctttcaaggtgggcataacattttatactctcactggcaacatataagaattttagctactccacatcctgtctaatatttattgtcatcaatctctccttttaaccatttgagtagttgtcaagcggtgtcttgtggttttcattacttccctgattttgaacatgttttcattgcttattaacaatttctacatcttcttttgcacagtgtctgttttacattgagatttttgtctttgcattattgaactgtaaaaattctgtatatattctgaattcaagtacctgcttgaggtatacattcatcttaagcatcttttcccagtctgttgcttgcctagtcacttgcttaatgatgtttcttgatgagaaattttcaattttgttttagcacaacttatcaattattttatggttaatggttactctatttaagaaatttttttcactctgatggtagtttcttttggtgtgcagaagctctttagtttaattagatcccatttgtcaattttggcttctgttgccattgcttttggtgttttagacaggaagtccttgcccatgcctatgtcctgaatggtaatgcctaggttttctcctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcctcatttctgagggctctgttctgttgcattgatctatatctctgttttggtaccagtaccatgctgttttggttactgtagccttgcagtatagtttgaagtcaggtagcgtgatgcctccagctttgttcttttggcttaggattgacttggcgatgcgggctcttttttggttccatatgaactttaaagtagttttttccaattctgtgaagaaaggcattggtagcttgatggggatggcattgaatctatacattaccttgggcagtatggccattttcacgatattgattcttcctacccatgagcatggaatgttcttccatttgtttgtatcctcttttatttccttgagcagtggtttgtagttctccttgaagaggtccttcacgtcccttgtaagttggattcctaggtattttattctctttgaaacaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatatgacttccttttttcctaattgaataccctttatttccttctccggccaaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggaccatcagagttaacaggcaacctacaaaatgggagaaaattttcgcaacctactcatctgacaaaggactaatatccagaatctacaataaacttaaacaaatttacaagaaaaaatcaaacaaccccatcaaaaagtgggcaaaggacatgaacagatgcttctcaaaagaagacatttatgcagccaaaagacacatgaaaaaatgctcaccatcactggccatcagagaaatgcaaatcaaaaccacaatgagataccatctcacgccagttagaatggcaatcattaaaaagtcaggaaacaacaggtgctggagaggatgtggagaaataggaacacttttacactgttggtgggactgtaaactagttcaaccattgtggaagtcagtgcggcgattcctcagggatctagaactagaaataccatttgacccagccatcccattactggctatatacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaaggatgggttcatgtcctttgtagggacatggatgaaattggaaatcatcattctcagtaaactatcacaaggacaaaaaaccaaacaccgcatgatctcactcataagtgtgaattgaacaatgagaacacatggacacaggaagggaaacaacacactctggggtgttgtggggtggggggagcggggagggatagcattaggagatatacctaatgctaaatgacgagttaatgggtgcagcataccagcatggcacatgtatacatatataactaacctgcacattgtgcacatgtaccctaaaacttacagtataataataataaaataaaaaataaataaataaaaaataaaaataaataaaaaaataaataaataaatttttttctactccaagatcacaaaaatattctgttttcttataagtcttgaagttagaaaacaaaggttctccaaccctgttctttttcaagattgttttggatattctaggtcttttgaatttttatgtcagtgttaaaatcagcttctaaatttcaactgggattttgtttgatattatatttctatagaccaatttggggagaactaacatcttaacaacagtgagccttccggccgggcgcagtggctcacgcctgtaatcccagcactttgggaggccgaggtgggtggatcacgaggtcaggagatcgagaccatcctggctaacacggtgaaaccccatctctactaaaaatacaaaaaattagccgggcgaggtggcgggcgcctgtagtcccagctagttgggaggctgaggcaggagaatggcgagaaccctgaggggcggagcctgcagtgagccgagatcacgccactgcactccagcatgggcaacagcgagactccgtctcaaaaaaaaaaaaaacaaaaacaaaaacaaaaaaacaacagtgagccttctaattcatggacatggtatatcacttcatttacttaggtctttaatatctccacaatgccatggaatcttcaatgtaaaggacttgaagatcttcagttaaatttattcctaagtactttatatttttggtgttattataagtggtattgctttgtaaattttgtttcccaatgcttcattgctaatatatagaaatacaactgatttttgcatactgacctcataccctatgacattgataaattcacttgccctagttgtttttattagtctgagaataaagagttttaactatttatttccaatatttatgccttctatttctctgtgatgtccaccatattacactgattagaatttttggaacaatgttgagaagaagtggtgagagtagacatccttgccttgttcttgctcttagagggagcagaattattttttatacctgcctgattcctccccctaaacagtaagattctccagagtaggaatcacaacttattctccaccatttctgaaataaaaaagagtatgacatttcagaagcatttagtaaatatttattggtgtattaaaggaattacatacacatggcagaaatgcactaaggtctctgttttgattcctggccatatttggtgctgatcccttaaaatgaagtaggagctcataaccgggcagccactgataaaagaatgtttttttaagttagtagtttccaattctgagttttatgcaaatgtaatgttagaacgtctagtcatgtggagaggggtgggaagtggccattttgaccaggatgctaagtaagacacatgcataatctgattcttaggttccgagcacacaaagaactgtcaaaagcaaccacaggcagggcgcggtggctcacacctgtattcctagcacttggggaggctgaggcgggtggatcacttgaggtctgaagttcgaaaccagcctggccaatatggtgaaaccccatctctactaaaaatacaaaacaattagctgggtgcggtggcaggtgcctataatcccagctactcgggaggctgaggcaggggaatcacttgaacccgggaggtggaggttgcagtgagccgagatcgtgtcactgcacactgcactccagcctaggcgacagagtaagattccatcttaaaaaaaaaaaaaaaaaaaaaaaaaaacagaaagcaaccatagcattcagtttcaccaaccacaagtcccaaatatgcaaaactatgaagctggctaaaaagaataaaaaactggaaaattaggatttgtgggaaaatagattgactcattcaatactcatccacaaaatatcattacttatgaatcacggtgttattaaagctcgaccatctggttcagcagcaactgttgattcaaagatttagcaaaatgacaggtgatgataagtgtgaccaactactgagagttaatgccaagcattgtgctaagagcttcaaataccctacatagtattattcaccagcacttggagataggcattgcatccactttatagatgagtggccagagattaaatgatcatctcaaaccatgcaattcctgtatgctagagacaaggcccaacaagatctccattcaaagtgtgcaaacttaaccactaagctatacctccaaattccatgtcatggtgagggggtgttgtgaacatccttctccatcagccctaggacctggactgtcagtcccatgagatcagggaccatatctgtatgtcaccactctgacccgaagtctggaatagtgtctagcactaaataggcattctatcaaattaaaaagctaaatgacacacattatcagttaatcctaaccacaccctaatatttgtctgtttcacctctcaataatttaactttttaaaattaaaatcctccattctgatgctgaatgtgctcatttctcatggtaattctaggtaccttatcaatttttgctttatatttttgaaatatgttaaggtagcttttaggtacttaagctttttaagcattacttagagacctatttactcctaaagatgctttatgtcttaaagtctattttatctgagattaatatcttgttgtcagcgttttttgtttaggatttaggtatttcatcttttttctagcctttttacttttaaccttttcaggactttaagtttcaggcatgtttttataaaagcacgggcagaattttgtattactgttttcaaatccagtctaagtctattttaactggcatgtttaactcattttcactttactgattattaaaatatttgggcttgtttctaccattctactctgttttttttctatgacttttctcatttttaaaaatattccattcgtggcatgtttggtctggaagttttacactctacttcaattattttattgattgtctttgaatgttaccacttataggtgtttttgaaatttcactttgtttcatttaaatgttctgttcacttctgaaatagctgagcttttaaaattttcgccttttctaagaacaatttatcagaaacccagtgacaaaagtgtggcaaaagaacataactgttgctgtgttaagaaaagtattctgtgagtatgagagatataaacactgtgtgcaactatatgataacaaaaggggcaattcagcaagagcatataacaactttaaatatatatgcagccaacactggagtacccagatttataaagcaaatattattagagctaaagagagagataggcctttttaataccataatataggtggaaaccacaacaccccactttaagcattggaaaaagcttccaagcagaaaatcgacaaagaaatactagatttaatttgcactacagataaaatagccctgtagatatttacagaacatttcatccaaaagctgcagaatacgcattctgttcctcagcacatggatagaacacatgttaggtcacagaacaagtcttaaaacattcaacaaaattgaaacaatatcaggcacattctctgaccacaatggaataaaactggaaattagtaatgaggaattttggaaactatacaaacacatggaaattaaacaatatgctcctgaatgaccagtggttcaatggagaaattaagatggaaattgaaaattttcttgaaacaaatgataatgcaaatacaacatacaaaagcctatcagatatagcaaaatcagcaccaagagggaagtttatagctgtaagtgcctaaatcaaaaaaagaggaaaaacttcaaatgaataatctaatgatgcatcttaaagaactagacaaacaagagcaacccaaactgaaaattagaaaaagaacaataataataaagattggagcataaataaatgaaattaacataaaacaagaatacaaaagttcaacaaaacaaaaagttgtagttttttttaaataaagaaaagaggtttaactggctcatggtcctgcaggctttacaagcagcatggtgccaacatatgctcagcttctaggggggcctcaggaagcttaaaatcatggtggaaggcaaacagggagtaggcgtatcatatggtgaaagcaggagcaagagagagaaattgcgcagggattgttgccacatacttttaaatgaccagatcttgtgggaagtcactcactattgtgaagacaataccaagtcatgagagatccaccccccgacccaaacacctcccatcagccccacctcttgcattggagattacaattcaacgtgagatttgggtggggacaaatatccaaactgtatctcatggtgcctggaatatgatccaataacagaattagttaatcaataaatattcaatcttatctgggacttccatctttaaaaatctaccttatctactttatagtgtccttgaggatgcaacaaaggagttaatgaattcgagtatgttttatacaatctacattcctcaataaggtagtatgtaagctcttggaagaagtaaatctttactcatttattttattttgttttttatttttagtttttaaacttttattttaggtttggaggtacacatgaaggtttgttacataggcaaactcatgtcaccaggatctgttgtacagattatttaatcacccatgcatgaagcccagaacccaatagttttcttttctgcttgcctccctcctcctcccaccctccacccacaactagaccccaatgtctgttgttcccttctttgtgttcatgagttctcataatttagctatcacttaaaagtgagggcatgtggtatttggttttctgttcttgcattagtttgctaaggataatagcctccagctccatccatgttaccacgaaagacatgatctcattcttttttatgcctgcatagtattccatggtgtatatgtaccacattttctttatccaatcagtcattgatgaacatttaggttgattccatgtctttgttattgtgaatagtgctgcagttagcattcactttcaagtgtctttattgtagaatgatttatattcctagtaatgggattgttggatcaaatggtagttctgcttttggttctttgaggaatcatgatactgctttccacaatgattgaactaaactctcaccaacagtatcacaccagtcagaatggctattgtcaaaaagtcaaaaaataacagatgttggcaaggttgcagagaaaaggaaacacccacaactctttgagtctgggtagattgaggcgagtgtcctgatatcctaaagacaggcaataacaaattctggtaaggagtgaagaaaagggacctcttgtacactgttggttggaatgtaaattattacaaccactatggagaacagtttggaggtttctaaactaaaaattgtgctaccatatgatccagcatcccatgcagggcataaacccaaaagaaaggaaatcagtgtattgaagagatatactgatctcctatgtttgttgcagcactgtttacaatagctaagatttggaagcaacctaagtgtccatcaacagatgaatggataaataaaatgtggtacacatatacaatggagtactattcagccataaaaaaagaatgagaacctgtcatttgcaacaacatggatggaactggagatcattatattaagtgaaataagccagacacagaaagacaaacatcgcatgttctcacttattcgtgggatctaaaaatcaaaacaattgaattcatgaacgtatagagtagaaggatggttaccagaggccaggaagggcaggggtgtggtggggggaggtagagatggttaatgggtacaaaaaaacagaaagaatgaataagatctactatttgacagcacaatggggtagctgtagtcaataataacctaattgtgcaataataacctaattgtaaatactatttgcaactgtaaattgtatttattttaaaataacttaaacagtgtaatttgattgtttgtaactcaaaggataatggatattccattccccacaatgtgcttattccacaccacgtgcctgtatcaaaacatatcatgtaccccataatacatatacctactatgtactcacaaaaaattaatttttaaaaattcagcaaataaacacagtattgttgtagacattaaacaatattgattttttaaacttgaaaaaacccctgtattcaaaatgctagttcttataaaacaagaaatatctaggcctgaaattttaataagataaagaaatattgatttgccaagaaggaaaattatgcttttatctgaaaaaaaagtgatttttttaaaaggtaataggacttttgtaatctagtccaagttccttatttccagaaagtaaaaataatttgctcaaaatgttggctcatgagcatgagatacactgtgagagaatttcttttctgcaactattcatgattggagatgtagggaaaatctaagcataaaataataactgtgagaatgagactgtttcttacataaacctctccatccaagtgggacccgcagacaactcacaacaggcaacttgaagggaagccctggcagataaggaaagccatttgggtgatggttactgtcaattgactgatttgtatttgcaggtcacatgcctgcaaaccatgtagctaccactaaggtaacagtggtggtgcctccattatcagcaaaattcaaacaactattaattaatagttgaattttgaatagttgtttgaattaacaactaaaaattttcaagtagtagccagaggacctttcaactcctggagagctttttcttgtggtctctttattgaaacaacaaaacataacaaaataattaatctctaattgccgtcataaagttctgaggtatttctataaagaactgcacttccaaagtccatgaagaaaatctttcattactttctagacacagttactatacagataggagaatagtttaaaatggtgctttccaaactgatatttcgcagaataccagttctgatgggtatttaagaaatctttggaaagaagtgtcctagactcaaaatacacatatgaaatgctgggttaaacaatgtagtataatttcaatgcaggtcttctcagagacttttctgtgattaatgtgctttgtgtgaagggtttcctggttgattcaaacaacagaacatttttcttgtgagtgcttcccccacaatgtgattttttaacacgcaaacttttacaaaataacacaatattattcccactaagcttttttttattgtggtaaagtatacatgacataaaatttaccattttagccatttttaagtggacaggtgagtggcattgagtacattcacattgttgtgcaaccatcactatcatccgtctctagaacttgtttcacctttccaaatttatactctgtacccattaaatgataacttccaattccctcctccccctatcccctggcgaccatcattctactttctgtctctatgaattttaccactctatagagtcatgcagtatttgtccttttttgtgactgacttctttcacttagcgtaaagccctcaaggttcatccatattgtagcacgtgtcagaactttcttcctttttaagattgaataatctatcattggatagaccatattctgttcagccgtgcatctgtgatgggcacattggttgcttccacttttgggtattgtggaaaatgctgccataagtcactaagttttatttactataaatttgactctggccctattcaagaagtttaaaaaacttagtccaaaactttccttttacccacaaaatcctttctgatgaataagaatttttggctctgactaaggcacttaaaagctttagacagcctggtatcatgattttttataggcactctgtctcactctttcaagggaagcatttggcagcctcgtagaactttccagagagcacacatagctgtctgactatttccactcctcatgctcagctttgtcctcttctgtaacaagaaatcatttctaccacaggacttcactcacatgagtccgtagaagctctcatgtgggcaccaggcaagaagctacgtgacttaaccttaagaatctgtttgtttttttctaattggaagaagatattctcctatcaaaagaaagggcctttcatcaagtatttaagaccctagtatctttactaggctgaaattttattgctctccatcagaattcttttaagaattaaagaacaaagaggaggtactgtgctttcttttaagtcagagaagcacgaattgacgtgacctcgtgtacagtgagaagagtgtgcagggatgcttttagaaattaaaaggcaaccacattggccagtcagacaacatggggtggatgacaagagtctaagaaatgccagaggaaaagcttttcctctggcttctggaaagtcaagttattgacaattttcaagtggataagaagaatattaagaaggtgaaatatctgttctacatgcaagacacaaggctttacaatacattatcttctacttaaccccttccttctctgttaactgcatttattctggcccaagtttttgactgcattgattctggcccaagttttccaggccatcccaattgccctatcctttgagatttaaacaaaagtggattaaatgactctgtcatgcatatgacaagctctctccacccttctttcactatgattgctaggaattcttagagacttatgttaatatttctcctggtcatcacttggttcaactttctcctgtcacagaattcttgttctctgctgtatcttccctcttgcagctcttttcttctctaccttacataaacccaaacctggagcactcagtccctttttgaaaacattttcccaagcatcattcatacatggagatatgaagagtagggatgtagtgaagatcttggaatactagcagagaagtcacagtcctgagaaactccccaagattgaatatagaacttctcatctgccttctcttctctgttttgtgcatcttgctaggacctcttcccaacacaccctctattttttccttaggttattccttgtgtctttggtgaggggaggaagatggaaggaatcatgaggcagggtggggttggagaggtgctgtcctcacctcgtctgcttcgaagttgcccttgaacactcaaaattttgctttcgttatttgtgaagaatgatttagtcttctttgactgatgccaaccaatctaggaaattctccgagggctactctttcatgtcagaaaatagcacagccggatgctttgttaaatacagcctcttcttaaagacgtagagtttatttcttgtttatcaatattaagcctagtcttcctgactagagctcaccttagctcagctgttgcacacttttctgaagataatgagtgttaaacagaaattaggccaaagttctgtttgaggagaaaactcttcagattgagtctcttgttggcagattacttaggaaggcgtaatcagtgttcacattgcaatttacccccttgcctgcctgcacctccatgtttaggatcagaagggaaaatgatctgctttgaaagcacagaaaaagaggagcccagagacaccattttggaaaatgcattcaagcactgtccaggggagagggtgcccaggacccttggttaatctggtccagggggcaagtccttccctgtggtggctcttcttttgcttccgttgcctactgatatggtttggctgtgtccccacccaaatctcaatttgaattgtatctctcagaattcccatgtgtggtgggagggacccagggagaggtaattgaatcatgggggcaggtctttcccatgctactttcataatagtgaataagtctcatgagatctgatgggtttatcagaggtttctgcttttgcttcctcctcattttctcttgctcccaccatgttagaagtgcctttcacctcctgccatgattttgaggccttcccagccatgtggaactgtaagtccaattaaacctctttttcttcccagtctcaggtatgtctttattagcatcatgaaaacagactaatacacctactcaatgagaatcctttgaaaaattgagttctcatgtgtctcgatcacaaatcagcaaaagtgctggtcaggccaatatgcttctagtcttcctcataacacattcctcattgtaaataattaaaacagcatttgggttttataaatcttcttcttgatagctctgttagcattactgagcatctaacccctatcatctctagtatattgggtcctaagatcgcaagccaagggcctttactggaactcagtgtattcaccaaggtaaatgtcacttggcaatgtgaggcttcttcatgatgggtcaattggcctttcccaggcaacaactcttatgtctttttatgggttccattcttcggttcagaaagtagaaactactttgagaattttaagcaggaagggacttaattcagagaattagatattttcaaaatcattgtaggggcttaaggatcaggttctagactggtcctcctggaataatccccaggagtatagaactcatccatcatggaaacgactcctttgagactgtcactgtagctatagatacaaaaagtcactgccttgcttgctgcctctcatgcctaggaaattggacagtggacaccccaggctgtaattaagattagaagtcacagaggaggtagcatggggcaggatgtcaaagtagaaggcgccatcaatcatgctcccagaaggacaccaatttaacaactatctacacaccaaagaagtacgttcatgagaatcaaaacacaggtgagcactcatagtatctggttttaactttgcatcactgaaagaggtatcgaagaggtaggaaaagcagtactgaatcaccaatgccaccccttccccatatccagcagtgacagcatgatgcagagagcgattctatgttgggaagaaggagagtgcagcatttgtgagacattgaactcagttctgccctgttatagcagaaagcaaaattggaccaaactcagctgacacccacccatggagtgaacattcctagccagagaggaatcaccaatctcagtggtcagaacttgagttcccacaagcctttccatcatgatctaaagtgctctggggccctaaattaacttggatggcaatctaggccacaaagtctgaaccttctaggtgagtcctagtgctgaactaggtccagtgcctgtgtactgggtaggggaggagtgggaacatgacctactgagacatcagctagagtggctaagggagtggcatcacccctttcctaaccccaggctgcacagctcatggctccaaaagagctcccttccttctgcttgaggagaggagaggtaagagtggggaggtctttgttttgcacattggataccagctcagccacagcaggattacggcattggtcagaggcatgagacaccctttccaggtcctagctctcagatgatatttctacacataccctacaccagaaagggacctactgccttgaagagaaggacctacttctggcaggattcatcacctgctaactgaagaagccttgggccctgaataaccaccagcaatacccaggtagtacatcgtgggccttgggtgagactctgagactagctggattcaggtgagactcagcacattctgagctgtagtggccatggggcgagactccttctgcttgagaaaagtggagggaaaaataaagggagctctgtctttcacctcaggtaccagctaggccataggtgcgtagagcaccaagcaggctcttggagcccccaattccaggacctaggacttggatggcatttctggatctgctctggggcagagtggaacccactgccctgaacagtgagtcccaggcgaggcatcattcaccacaagctgactgaagagccatagggtctttaaggaacataggtggtagtctggtagcactctcagtgtgtctgtgttggtggtggccatgggatgaggctcctctgcctttggaaaggggagggaagagtgggaagaactatatgttgtggtttgggggacagctcaatcagagtacaacagaacactagatagacttctaaagttgttgacctggcttccagatggcacctctggacttgcctgaggcctggggtaacatgtcatcctggagggaaggacacaggcctggatggctttgccacctgctgatcacagagccctaaggcattgagcaagcataggcagtaatgaggtaatgattacaataggccttgggtgagacctaatgctgtattggcttgaggtcagaaccagcactgtcctagtggtggtggccataggggtgcttatgtcaccctgcacccagcttcggggtgggggggggagagagagagagagagagagagagagagagagacaaaggaaagaaagaaagaaaagaaagagagagagagagaagaaagaaagaaaagaaagaaagaaagaaagaaaaaagaaagaaagaaagaaaaaagaaagaaagaaagagaaagaaaaaagaaagaaagaaaaagaaagactccatttgtttgggagaaagtaaaggaagaaaacaagagtctatgtctggtaatccagggaatacttctggatcttttacaagaccatcaaggtagtacctctatgagtctgcaagaaccacagcattactgggcttgggatgtctcctaaagcagatatagctcagatcacaacacacaagtctttttgaatatctggaaagccttcccaagaagaatgggtacaaacaagcccagacagcaaagactgcaatgaatacccagtaattcttcaatacccagacacagatgaacatctacaagtctcaagaccttgcaggaaaacatgatctcaccaaatgaactaaataaggcaccagggacaatcttggagaaacagagataagttatctttcagatagagagttctagataattgttttcaggaaactcaaagaaattcaaaacaatacagggaaataattgagaattctatctgataaatttaacaaaataaagcagaaattctggagttgaaaaataaattgacacatggaaaaatgcatcaaagtttttaaatagcagaactgatcaagcaaaagaaagaattagtgagcttgaagacaggctatttgaaaatatatggtcaagggagacaaaagaaaaaagaatgaaaaacagtgacacacatctgcagcatgtagaaaatagcctcaaaagggtaaatctaagaattattggccttaaagaggagatatagaaagaaacagaggtataaagtttatttaaagggataataatgtagaatttcccaaacccagagaaatacatcaacattcaagcagaagaaggttataaaatattaagcagatttaatccaaagaagactaccttaagccatctaataattaaattcccaaaggtcaaggataaagaaaggatcctaaaagcgccaaaagtaaagaaatacataacatacaatggagcttgaatacattcagagcagactttttagtggaaaccttacaggccaggagagcatggcatgacatatttaaagggctgaaggaaaaaacttttattctagaatagtacatatagggaaaatatccttcaaatataaagaagaaataaagatattcccagacaaacaaaagctgaaggatttcatcaacaccagacacaccctgtaagaaatgctacagggagtacttcaattaggaagaaaaggagattaatgagcaataaaaaatcatttgaagatacaaactcactggtaatagtaagtacacagaaaaacactgaatattataacactgtaactataggttgtaaactactcttgtcctaactagaaagactaatcatgcaccaatcaaaaatcataactataacaacttttcaggacatagacaataccttaagatataaacaaaaacaatggaaacttgaaaaacagggggacaaagttaagatgtagagtttttactagttttctttttacttgtttgtttgcttatataaatggtattaagttgttaccaccttgaagtaatgggttataggatagcatttgcaagcctcatggtaacctcaaaccaaatgtcatacaatgaatacacaaaggattaaaaaccaagaaactaaagcatatcaccacagatatgattcactaaaaaagagagaggaagaaaagaaagaaggaagagaagaacgcaaaacaaacaaaaaacgaataataaaatgtcttcaggtagtcacagtcaaaacataattgacaaagaaatttggttatttctgtgatttacaataacttaacataataaccttaattattattaatagcatatactcaaacattagaattttttagaaaccccataccatgttggaacatatattaaaatttcttggtaaaatataacctgaagaagattaaacattatttttatcttggcattccacataactaaacatgtcaaataatcctatttacctctcttttggatgacccaggggccctctgtagcatccaaaagttagaggtcaaggaagacaaccttgaaactgaagtttgattttgggaagcctgttaaatatgttagaggcttaaaacatttgatattatgaaatagaattccagatttccataagtcatttacttagccaaaataatgactcaaaaaaaattttaaaggcaaaaacctttactcattaggaggaaagatttagctttccaaacaatctgtctgttgtcttttccttatttttttgagtagttgattcacaaagcaaacaaaaattttttattatcctttactattacatgaaaatctcattcaagggagagaaagcaaatttcaccctttcattagtctactattaatgtcaaccccaattttctaatgaaatattatagataattctatccaatcttaaccagtttgatcatgaggtaagattcttgtaaatcttttataacactttacaaatttttgttaaagagcagatcagtgccctaagaaatccttgttttattcttttattttaatgttcaatttagggaaaaaccatataatactcttttgaatttagtcaataggttcacatacaaaatttcttttgcaagattaatttttacaaactttccacaacttgtttaaaccttcagctttatctttatccggtttaaaacaatcctttaaccctctgaactaggcaaaaatttacattcccatgctttcttataatcttgtactaaaaacacattttactttccttgcacaccttgcatgtaaatctatgttcagtagtctcaattacatattataatggtaacccttagcaatttttaattttaatgtaaagcatggtaagttattttaattatgtactaggcacagacagggtctaactctttccagcacagttagggacattttgaattccctatgtccccaggtcttaccaaaccataaagcaagcaagttgaacaactttcaaaagccaaagaagcagtttataaccttaaagcatttaacaagcccagtatctgacctacataatttagaccacatatttacattttgaagacatttgtattttactaataatctttaaaagtgtttttatttctcaaaaattaaagtcacatgaactaaaagcattacagtttttcttttttgcatcaaaaaatatttaatctaagcatgtgttcttctctaagccaattaattagagcttcttttttatataaacatcacacacataacacatatataactacacagacagacagaagatccagtagttgtaagatttttcactggccaatctcctaattagattattggcctcggggtggagcccttcaacaaacagggtaagaaaacatgcagtttctatggcctaataagcggatatagctaaaagacaaaaacatattttgagagggatttagtcacttttaattcttggggatccgtgaggaaagcagaagtttttttccaaaacagggtcaatggtgcctcctctgctttttccagggagtcccaggccatcagaagttatcttagggcctctcatgcgtgcataaagagtagcaagacaaaattgagaaaaataatgcagttggctgagaagaacaaaactctttttcagtgaaacaagatccaagaagagaaaaacataaaacccttttaaatatacctatagcatggctatccacttttaattaagctgacttttaaccatagcactctttaagaaaatccttttaaatctcttgttacctgactttagccataccaagtggccaatatttctggcttttgaactttaccaaaagtaacctctcaggtgaaaccaacaaaccttaactaaggtatgatttaacagtgagtgtacaaggtattttcaaagagctggtaagcagtttttacaaaatctagaatctttaaaggtagttcagagaaaggaagatttaagaacggaagctggaagctaagggaggcaaagagaatcagcaaattgtaaaagcaacacagatatcagccagaaagtactcattccctaagccaggattgaacctgagccacaattgtaaaatggcaggcaccaaaagaaagtactgccacatggttacatggtcaagctcccaaggacataaaaaaagatggagacctcattcagtttttttcccttcagagacctgtagcaaagtttgttactgaccagcttgctgggatagtttcaaaagtgggattatggggtcctagacctgcattctatcctaaggtacccctctttctaatagaaagacatagaaagataaattcttagcacaaagtacaacagatttgttacaggttaagtctagcctcacacatccttttttcccattaatcaaaagtttacagaggatataaacagtgatttttatcattcattctaccagtttgcacagggagaggaaggccagaagtctggctagtttaaaaaaaaaaaaaaaaacaaaaaccttttacccttttgccagtatgtcaggcttctgggctcccttcccttagctgtggagcccttttgtgactctggagtcttgtaaagggggagcagacaaagaggttatttgcatactaaaaaacttgtccctcctaaatagatttgctcagttaggcctgtaattttttcctggctcatttttaagccaaaaagtttaagatatgggaaaattaacttttcccagtttgggggatgcaaccgagaggagtgtcctgttgtatggagagtagctgaaaatggttggttacccatctggaaagaggggaaacggtgtcctttagtgccttttttccccaagcaaatacccagggcatatgagggagagaaagaaaaagtgtcttctttcttctgtctttgtatccctgagtcccagcaaactccacagggtgctacccatgggtgccaatgtgactttcacccatgtggaatagggcgtcctagagagtaagaattatctgcactcacctacacattttctattctccctgctgttggtaacctcatctatgccatggatgctagcatgacctccatccatgaaatggtggggggcctcgttggcaggaattagtcatgctcacctgtgctgtgtcccttgaattccattgccatctgcctctggatccctcagatccagttttcctttctagggctttaacctgaagcttggaattgagtttgggacaaataactgcctcaggagggtgcatggactcactaaattaagtcccaggtggcccttgctaaactgcagacagcagccagtggggctgctcctttgctgcctctttatcataagctgaatgctaaggtaaagctgtagaactgggtcctcctcaaacaagggagagaaagggggacctggcccttcaaaaggaaaaaagatgcctttcaaaaggaaaaaagaaaaactctcacatagaaaagctccccatatttgcagggctatgttaacttctgacatggtagagaaaaagaaaaacacaacctaagtgtgggggtggggtaggtgcttgtgggaaaaagcctctcactgtatgcaaatgagtttcttctataggaaaaaaaaactcttaaacactgtaccctttttgcctctaagaacagacagaaaacacattgttctgaattacatttttgatgactgggccaagcacccattctagtcagtaatatctctgtagtttgcaacaacactcttaacattgtaaaagacaagataggtaccatgacagcccccaaaacaagaaggaaaatatcacagaaaggagtaagactgatatttccagctcccaagagtgacagaagggtcccctccagcatcttgtcctgtgtagttgtaccattcattcttaactagctaatcagaggttcagtgcttcatctgccttcagaaaaaagtctgaggacaagaagcctcagaaaaagtgaagcatcttggttcgcattcactcacccttcagggatcctgggcaagcctccaaaatgacacaggatttttcttggcccctttgccagactcacagcaggggtgccttatctacttggcctaccatgctcaccttcttgcagaagggagcacatgagcgagcaaggcaggatccggccagccactctgagcactgacacaggagcaagctccacgtgggtcccacagccagaccaggcatgtcaccttgagggcaatacagtggcatccagacatgggtgctcacgattttgaagccccatagtgggtgttagtgtgctaattagctcttttagttctgccgtccacagcccaatggacggtgacatgttagcagctcagttggcccctggatcaattgcatggagcagctgccctctggcaagggcaaagggccagtgtgacagcctttctgggtacccacactaggtgggtcttgagctcctgcccagcatccaagaatgaagtcatgctgatgggtgaagaagaattttattgagtgatggaacagctctcagtggagaggggatgttgggggaggtaccccacccctgcagtcaggtgggttttttgcctctcaatgtggctgggtctggggctttttatagactcacaacagggagtgtatgctgattggtttgtgagcatgcaagaaaatttaaagcaaagacaccactcaaaggtgggcacaacagtgtagaaaaccaattaggaaagggtaggtatatgtaaaataggtgaagggtgtggatcagaggaaagcatgccaaaaggaaagacacgttctcaatcagtccatggatttaacttgtagcttggctttcaggctttaaactgtcttcagcttggaggtgaggattcactgaggacctgctcttatctgcctaggcatttgactgcctcctgtcactatcaataataaagcagtcaattcagcaagaggatataacaattttaaatatatgtgcacccaacactggatcacccagatacataaagcaaatattattagagctagagagcaagacaggcctcaatacaataataactaaagactgcaacactccactttcagcattggaaagcccttccagacagaaaaccaacaaagaaacactggacttaatctgcactatagaccaaatggacctaatagatatttatggaacattttatccaatgtctgaaaaaatacacattcttttcctcagcacatggatcatcctcaaggacaaatccttgagagtgttgggtcacaaaacaggtcaaaacattcaacaaaattgaaataatatcaagcattttcactgaccacaatgcaacaacaagaggagaaatcaacaacaggaggagttttggaaactatacaaatacatggaaattcaacaatgtgctcctgaatgaccagtggggtcaatgaagaagttgaaaagaaaattgaaaattttcttgaaacaaatcatagaggaaacacaacataccaaagcctgtgagatacagcaaaagcagtactaagagggaagtttatagttataagtgcctacttcaaaaaagaagacaaacttcagataaacaatagaatgatacaccttaaagagctagaaaagcaagagcaaaccaaatcaaaaaatagaagaaaataaatattaataataaagattagagcagaaataagtgaaattgaaatgaaggaaatgatacaaaagatcaatgaaaaaaaagttgatttttttgaaaagttaaacaaaattgacaaacatttagccagactaataaagaaaaaaagagagaacatccaaaatcagaaaagaaaaaggagacattacaactgatttcacagaaattcaaaggaccactaccgtctactatgagcaattatatgccaataaattggaaagtccagaagaaatggacaaattcctacacagcttacacaacctacctaccatggttgaatttcttcatggctgagttttttcaagcatgaggaaatccaaaacctaaacataccaataacaagtaacaagatagaagccataacaaaaagtctcccagtaaagaaaagcctgggatctaatggcttcactgctgaattctaccaaacaattaaagaagaactaataccaattctactcaaactatttcaaaaaatagataagtagggaatacttccaaacttattatacgagggcagtattaccctaatacaaaaaccagacaaagatacaccataaaaagaaatctacaggccatatccccaatgactattgatgtaaaaattctcaacaaaatactagcaaactgaattcaagaatatattaaaaagatcattcatcatgaccaagtggcatttatcccacagatgcaaggatggttcaacatatgcaaattaatcaatgtgatatatcatatcaacagaatgaaggacaaaaaccatatgatcatttcaattgatgcagaaaaagcattccataaaattcaacatcccttcatgataaattcacttgaaaaactgggcatagaagaaacatacctcaccgtaataaaagccatcaatgacagacttaccactagtatcatactgaatagggaaaaactgaaagcctttcctctaagatctagaacacaacaagaatgcccactttcaccactgttattcaacatactactgaaagtcctagctagagccattagaaaaaaagaaatgtaggacatccaaattgaaaaggaagaagtcaaattatccttgtttgcagatgatataaccttatatttggaaatacctaaagactccatcgaaaaattgttagaactgataaacaaattcagtaaagttgcaggatacaaaatcaacatacaaaaatcagtagcgtttctatatcccaatagtgaacaatctgaaaaataaattttaaaagtaatccaatttgtgatagccacacataaaattaaatacctagaattaaccaaagaagtgaaagataccaacaatgaataaaaaacacaaatgaaataaattaaggaagacacaaaaaatggaaagatattccatgttcacacattggaagaatcaatattgttaaaatgtccacactacccaaagcaatctacggattaagtgcaaatcccttacaaaataccaatgacgttcttcatataaacacaaacaaacaattctaaaatttacatagagccacaaaagacccagaataaccaaaagtatcctaaacaaaaagaataaaactggaaaacttacattacctaactaaaaaatatactacagagctatagtaacaaaaagagcatggtactggcataaacacagactcatagatcaatggaacagaatagagaacacagaaacaaattcacacacctacagtgaacttggtacaaaggtacctagaatacatgctggggaaaagatagtctcttcaataaatggcactgagaaaattggatatccatatgcagaagaatgaaacttagacccctatctctcaccatatacaaaaataaaatcaaaatggactaaagacttaaatctaagaccttaaatggtgaaactagtacaagaaaacattggggaaaatctctaagacattagtcttggcaaaagtatcttgagcaatacctcatgagtacaggcaaccaaagcaaaaatgaacaaatggaatcacatcagattaaaaagcttctgaacagcaaaggatacaatcaacaaagtgaggagacaacccacagaatgcgagaaaatatttgcaaactacccatctgacaagagattaataaccagaatatataaggagctcaagtaactctacagtaaatagcctaataatccaatcaaaagatgggcaaaagatttgaatagacatttctcaaaagaatacatacaaatggcaaataggcatatgaaaatgtgctcaacatcactgatcatcagaaaaatggaaatcaaaaatacagtgagatataatctgtccccagttgaaatggcttatatccaaaagacaggcaataacaaatgctggcaaggatgtgaagaaaagtgaaccctatacactgctggtgggaatgtaaattagtacaaccactatggagaacagtttggaggctcctcaaaaagctaaaaattgagctaccatgtgattcagctatcccactgctgggtaaaaactcaaaagaaaggaaatcattctatcaaacagatagctgcactcctatgtttgttgcagcactgtttacaatagccaagatttggaagcaacctaagtgtgcatcaacagatgaatgaataaagaaaatgtggtaaatatacacaatggagtacttactattcagctgtaagaagaatgagattctgtcatttgccacaacatggatagaacaggaagccattatgttaagggaaataagccatgcatagaaagacaaacatcacatgtactcacttacttttgatatctaaaaatcaaaacaattgaactcatggagataaagactagaaggatggttaccagaggctagacaaagtagtgggctgctgggcggggtggggggagatagggatgtttaatgggtataaaaaatagaataaataagaactcgtatttgatagcacaacagggtgactatagtcaataacaatttaattgtacatttttaaataactaaaagagtataaatggattgtttgtaacacaaagaataaatgtgtgaggggatggataccctattttccatgatgtggttattaaacattgtctgcctatatcacaacatcacatttgctccataagtatatacacctactatgtagccacaaaaattaaaaataaaaaaattgtaaaaatgagaagaagtagtgtggacactaccacttcttctacctccacgaagctggggactggaactttagagcaatccgtaggagtgtcacaggtttctacaaccttcttgcaggaaaattttacttacatttcacctctaactttctaaatattatatgtgacaaattgtatgattgatataactgaattcacatcctaaactctgccacagagaaatctgggaaatgtagtttttagtttttcaacctctccaatgagaagactgctgaaatggaggctgagaggcccaatccagagcattcagcacaggtattattatccccattttgcagaagaattctgcaagatgagagtcaaagagtgcaggtaacttaaacaagtccatacttactaagtggaagaattgggatttgaaaatagatgtctaactcatatttattttactctaccactctaatattcacatacctgggcaattcattttttcaaaagtccttatattgtgaacctggagtaactgctgaagtccagttacaatcctctgtggagtcttacatcttcctggtatcactacacatgtgcaggatccaggaatgcagaggaggaaagaggaatgaatatactaataccagtcgttataacaatgctatgcctcctccatggattcactcatttatgctgaactccacaggtgtatctctgacttctctatctgatatctactctttcccatccttctgagtctcaatccctgagagtgttttcagtcattccattccctgtatattccttccagcctctgtgaaacttacatactgatttcagcttaagcttctggatgtgtgttattcacatactcctcctgtgaatgactggcctcccattgtcatgataactttcttggcccttgttcttctctgactgagagtcacctatgaccatagatgacatcagtagtatctgaacaaattaggtcagagataggctaggccaaatctacctaccctattagccatggaaggagtttgaattttattctaaacgtgttaagaattcattagaggggagtgtcatgatatgactatgtgttaaaagaccattcaggttgctgtatacagaaaaaaccatatgtggggtgtgtgtgtgtgtgtgtgtgtgtgtgtgtgtgtgtgtgtgtaaaaatagaaatacagagacctgttaagatgccaccctgataagaaatgatgatggtgtatgcagtgggtttaaaggtggtcgtcccaatgatatgtctacatcctaactcctggaacttgtgactgtgactttatttggaaattaagtctttacagatgtaatcaagttaaggatctcaaggtgaggtaatcctggattatcctgatgggccctaaatctaatgacaagtgtccttataagagatggaagacaaagagatagtggagaaagccatgtgaaggttggagcagacaattatgtaatggagctacaaccaagggatgtttaggcccaccgaagctggaagaagcagggaggaagtcctccctagatctttcagagagagaatgtagccctaccaacatctttttttcagacatctatcctccagaactgtttgagaacaaatttctgttgttttaacccacccagtttgtagtaatttgttatggcaaccctaggaaactaataaagtatattatttatctattgttaaataacaaattatccccaaaatttaaagcttaaaataataaacatttattatctcacatatttatattccagaagtcacttagctgagtaattctggttcagggtttctcatgaagctacagccaaggtgtcagccagggctgacattatctgaaggcttgacttgggctgatggatccacttccaggatgggtcactcacatggctgttgacagaaagtctcagttcctcaccacttggatttctccaaagggcacctgcacatcgttctgacatggcagctggttttccccagaacaagcgatttcacagccctctcttccaccacattgcatccattagaaatgaatcactaagtataactcacattcaagagcatgagaattaaaatccaaattttgaagggagagaagcaaataattttcaaatttgaaaacaaccacagtggcacagaataagatggttaacagtggagattagggtgaataaaaagatttggaatatattttgaagacatagttgaataattgtaagtgaggtatgaaagaaagaagagttaaaatgcctccaaaaatttgacctgaacaaccagataaatggcaatatcatttaatgggagatgaaggggtttggaaaatggtggttgatcaagttctgccctggacctgttaaatttatgatgtttattaaatattcaagctgaccttttgagtagacagatttacaagtctggaagtaagggaagatgtcaagacttgagatataaatttaggagttaccagcatacagatgatatttaaaatcatgccattatttgagatcacttggaaaatgaaaaaaaaagaaatcttaagattgaattctgggggactccaggatttaatagcaggagcataaaaagaaactaacaagcagtagccagagaggtaagagaaaaaacagagtgtggtattccaaaatcaaagtgaagacatggttttgagaaaaaagaagtgttgttgagagttgagtaagttaaggaaagagaattgactcttgatgatagcaagatggaatggaggtggtggaggacagaatgggaagtgaagatgtggagaaaaaaagcatagacaagcctttctaggagagttgcttttaaggaagccacagacatggaacataaactagaattggtgtaggggcaaggagagtttctaacaggagagatccttgtatggaagcaggggctgctcaccctggggcagaaagtaggctcctgcagattggttggtggatctggtggtgataagatgaggcagttctctttgtattgcttctgttttctcactcaaataagaggtgatatcatcagtggagagtaggcagagggttaggggtagaggtttgccaaggggaggagatgaggacaagttgactcagagtaggagagcaattgatgagggaaatgaaatagagtgaatggggcccatttgaaatgtgtggacatcaatttagagcaagatcagtctgcaggatagtgtaaaaactcggagaaagccaaatgtcagatttacccagggctgagggtttgccagataagtgaatggggtgagggggacatagcaagagaattaccagtgtgagcaaggaactattatatttacagtgttattgacagttcatggaaccatgtaagataaggagggaagtgagcccatgaggggagatgggaggatgaaaagcagaaaagtggtggagtcagtggatcttgatatggtcagagaattgtgctagtgggttttttgaggtaggtcagaggtaagtttttggaagaaaattaacttttgtgatgataaattttgtttgatttaggatattctaggacaagggtcagaaaaccacagcctgcaaaccaaatcttgacctccttctgttttcgtaaataaaattttattggaatatagagccatgctcattaattaatgtattgtctatgcattctttagtgatacaaagacagagttgaatatctcccactgtatgggcagcaaagtcaaaaaaatttgctctctggccctttgcagaaaatgtttgctgacccaatggcccttcccacacaaatccctataaattaaatcagcccccagccttcctcaccacccccatcataccaggggttttggtgtgtctactttgcaggtgcctcaagcatgtgttttatctgcctgttggagtaatccatccaggtgttctgctaacatcagcaggcaagccctctgccccctctgatgtagaacacagcactgactgtaatcccagctactttgggaggattgcttgagaccaggagttcaagaccagcctggaaaacaaagcaagaccctgtaactaaaaataaaaaataaaaagaagatagaacaaaagcacagctttgtcagtgccaggataaggatgaggtaggagaaacacttgccttgggcctaaaatttgagggagtgcccccaaaattcagtaattaagacaaaaattattttaatgcaattttttttgaaaaacaaaatcaatggaaaaaaatccaggataaacaaaatatcagaatttaaaaataaagacaggatccaacaagggccatgccaagccttattttttaatgattgatatttttccggaagtaaattttagagatactattgatgtttttgcttccatcagaggtaggaaagtcaaattataataaatagattcttttatggaatacaaataaaatatttaaatttgcaataatgttgtaagttgtaatatatttgccaatcaatttttcaatatttttcaacttctttagtattctaaaatataatatcattaaaagacagatgagaacatgttgataggggtgcacattgtttctttagctccaggcacccataagtctctgcatggtgctggctttggtatatggggattaatgtaactcagctgcagcaggggtgacagagatggaggggacaggtccaaaggccccagaagccatggctgcggctctttaaagcccttcttaggccaagggggctccagccacagaaagcagtgagtgaaatcagatgaggaaaagaagaaacaggtagaaattagagtcacagaaaggacaggcaagaaacctgcagggctgggtgagtgcttttcaggaggctcatgatccagtgttgggaagtgagaacaaaagccagcaaaacaggtttcacgtcactaagcaatttgctgtggtaagacagcaattagaacagcccacacacacccagcctgggtctgatttcctgtcaagggtaggtggtgtgcttccttcaaaccagtcattttcttctctaatgccctgctctgcaggtggaaaaagatcaggatggcttaagtttcaggagcttttctccctaccctttctccaacactttcccttcctacaaattcccaccactccaggatttcttctctcctttcattgtaacccttctctgttctccatatctgcaccctttcttctgtctgtgggaaaaatggcaatagagtgggggccaatgtatgactttaactaacgtaccaataaattggatccttacatttaattctttaacagattttccatcctctaagctttgaaaagcatttggaaatgggaagtggaggtcattgtagaaatttaagaataagactcttatttacaaaaactgctttaaaggaaggaagatgatacgtgtttaccagctttgggcattgactactgatacagtttggctgtgtccccacccaaatctcatcttgaattgtagcgcccccaattcccacgtgtaatgggagggacctggtgggaggtaattgaatcatgggggtgagtctttcccatgttgttttcatgatagtgaataagtctcaagaaatttgatggttttataaaggggagtttccctgcacaagctctcttctcttgtccgctgccatgtgagatgtgactttcaccttcttccatgattgtgaggcctccccagccacatgaactgtgagtccattaaacttctttcttttgtaaattgcccagtctcgggtatgtctttatcagcagcatgaaaacagactaatacaactactacaccctcagtacatcaacatttcattcctgtacaaatataatccaagaattctctgagaatttccttgcagtcatcaagggaggaagccctagaaggagagatgaaacctcttgatactcagcagaatggtgagattagactttgccaccataaatattagatactttccaaacacgctatttgaaatgggaactgataacatacattcgaaagaggttacatatttgcccaacaaatattaaatatctataaaaattcacagtatttgtccaagagagtaacatattgaagctctatgaaagagtcagttgttttttccagggcatccaatgatgaaggtctctataagagtgaaagtgtgtgtccagaggaataaaacattaaggcgctcagttggttgagatttttcttttttcttttttttttttagatggggtctcgctctgttgcccagaccggagtgcagtggcgccatcgtggctcactgcaagctctgcctcttgggttcacgccactctcctgcctcagcctccggagtagctgggactacaggcgcctgccaccacgcccggctaattttttgtatttttagtagagacggggtttcaccatattggccaggtggatctcgatctcctgacctcatgatccgcccgtctaggcctcccaaagtgctggccaccgtgcccagcggagatttttatcttttataattaacgactggcatgggaaaattgttgggttattttgggggatttttttggctttgtttgttgttgttgttttgttggcaaattgaaatgtaaggtcatgccccacatgtaccacatttaagtgtgtaactctaactcatttaccaagaaacctgtaagtccagatgtgaattaggttgaaagcaagagaagactctgcaattaatccaattagtgaaagctgtccagccacttggatataatctggaagatttagtgatgcatactgtgtttgtggcagataaggacactgtatggaatctctggctaaccctagtagtagtacaaacctctaaggttttaaagcaaagccatgtgatcctcttcaaataatcctttgagaaacagcttctggcttactgctgagctctagttgagactgaatgcctgaccacagaacccaatgtcattcagtcactgctgctcattagtagctggatattatctgaagcccaggttatagcagtggacatccagagcagcataccataaatgagtagaaagctggatgaacagctggctcagtctccagcagcacctgctcccactagatggctgctgcaattgtcatcatatctgattaagtttttaaaaacgcacagtcattctgcaagacccatctgtcttctggccaggtcaataggcacaataagaggggatatgggaggaatcaccatccctgcatctttcaagtctttggctggggcactgactcttgtagttcatcaggtgtatgacattcactttggtttaccatcccagggacttttgcttgaatctttctaccttagtagtcctcagtccataaatcagggactcaacataataattctgccagttacccgtagatcaattccaatcatgcattcaaaaacgttggaagtaatgctgaggaagactcgaagactttgtagacccaccgtgagacggatttagaccaaaactccgtctgtcttccacctccacaagcccccactcttgcagatcatggatgcatggatattatttcaggtcaccagagattaacattaattcaaatgtattatctacaattactaaagatattgtatttccctttcttcaagtcattgtcatcccgatatgtcgatgcaggtccttcgggggaatcttgcaggaatatttacactatagaactgtggtggtgtcgcgagcacctcctcaaggaggttccatctctccttcactcaaaagactttaagtttttgaattagcttgccagagattagggtgataggacacaactctactgtggtgacaaactgacaatatcaattcctgttgtccaggtcgcaaatatttctgattgtaagtactactccgactggttgcccatctacaaatcctaaagacactgaccaaatagccacattgggtcacattgggtcacagcattctgattcctgctccaccattctaaccatttcagtaactgacccagtgtccctggtacttaagtgctgccacatggtctcagccactctggggtgtcccataatagtggcatctatcactttcacttgcagctggcaggagacagacaccacagagctttatggaatgattatgcttctcttgtcaatgcatttctttttctttccttttttttttttttttttggacagagtcttgctctgttgcccaggctggagtgcagtggtgctatcttggctcactgcaacttctgcctcctgggttcaaatgattatactgccttaggctcctgagtagtggggattacaggtacacaccaccacactcagctaatttttgtatttttagtagagatggagtttctccatgttggccaggctggtctcaaactcctggcctcaggtgatccacctgcctcggcctcccaaagtgctgggattacaggtgtgagccactgcacccggcctgcatttcttaatactctaggccttcttgcagacacaatgaaggaaatttcacttgagaaatttatttcaacattcttctccctaagcctttggattctttcctttccattgtaccagaaaagttatggcaccttaacttcatggaattaggctacagtcaactccaggtttcagtcaactaaacaaacaaactgacagtaaccacttcagccactcaaaataatgcatagatttcaaaagttctagcaatggaatccatttcaataaatgcagtttgatccaacattatgtgctatcatccttggtagctagtactgtatcagtcagggtttaggcaggaaaagaaaaccatcttaggtattttaagcacaaaggaatttaataccatggatattattttaaagtgtaaaaaaagactagagaaacaaaatggaaagaaggaaagagaagtaccaccacccagagatcaagtgctgcaagaagccactgccacctgtgttggttttctaaggctgccataacaaagctctacagactgggtggcttaaacaatagaaatttattttctcacagtcctgatagccagaagtctgagatcaacggttggtttctcctaaggtcggtctccttgacttgtagatggtctttgtatcagtctgagttctccagggaaacagaaccaatgggatggatgaaaagtttaatagagagagaaaaacagagattacaaagaataggctcatgtggctgtggaggctgagaagccctaagatcttcagtcagcaagctagagacccagaaaagcagacggtcttgttccagtccaagtccaaaggtccgagaacttatgcaactgtgttagttccagcccacgtctatgtctgaaggcaggagaagactgatgtcccggctcaaagacagtcaagccaagagtggattctcctttactccaccttttgctctactcaggccttcagtggattgcataaggccacctacactgggcagggaaatctgctttactcagtctactgattcaaatgttaatttcatccagaaacacctttgcagacacacctagaataatatttaaccaaatatctgggcaccccatgatccagtcaaggtgacacatgaaattaaccatcagagccatcttttccttgtatcttctcttggtcttccttctgtatacatctgtgtccaaattttctcttcttataaagacatcagtcatactgaggtagggcccactctagtgacctcgttttaacttaatcacctctttaaagactctgtctccaaatacagtcacattctgacatagcaggggttacacctcaatatgtgaactttgggggacacaatttagtctataacccctgaaggaggccacagaaatctgcttcacaactcactctttcttacaggagactgtgctggtctgagttccatctccacaggagtctgcacagccattcaaaggcccctggaatccacactcactagagtccaggcttctctctctctccatgctgctgtgctctctctacaggaaactattacctctattaatgccaccaaggtgcatgggagccaacagtcagtgctatcataagtgagatcacagcccatggcattctggagccacctccatggccaccacgagtgactctgctggagacgccatcactgccaaaaatggggtagcttctttctccttgcttgtaatcttgcatgagtgtctcccttggcggaatgttgctgcaagtctactggcaacagaatctgacttgcagcccctgcaacacaggagagaacatagaagggcagccatgcatctgagcaccaacagggagtgtctggcacagaagctttcccaaaaacattacatttgagcagaaacctgaagaacaaaggagcaagctgagcaaggcacaaaactagagcattgccagcagaggggctagcagttgcaaaccactgaggtggaatcagccttattagtttaagaaatccagaagactcaaactagtgtacctggaatggaatggatgaggaatagtagtaagagattaaatcagagagatagttgggggaccagaccacgaaagaccttgtaacttgagtgacaatataacttgccatacaaaccaaaacattttgagaaagagaatgaaggaggtggtactactaatacttatactgggacaacaggcataaaacaaattatcccagaccagtcaagacataaccactctacttataagccattgtaaggatttcttttcttttaagctgagtgacaagggaagacattggaggttttaacaacagtgatgtgatctgacttacatttttaaagaaccactatgggttttatgctaagaatgggctgtaaaggggccaagggtcagagcagttagaagcttactgcaatcatcaaggtaaatggtcgtggtggctggaagcgggtgatagctgaggaggtggttagcagagggatttgttgatgaataagatacagggtacaggaggagcaattcttaacacaaaagctagagtggcctgggtccatgaacctcttctcttctctctctacactcatacccatagagatatcacccaatttcatggatttcaatgccatacatttctgtatatttacctctgctcatgatatccaactcgtatatagtatctctaagacttgtagatccaactgtcttcccaaatgttttactcaaataactatatcaaagttattctacttcagactgaacttgtttctcttctactttttcaaaagattccctcctctgatattcctccataacagtaaattgatagtctttcaatcaattgctcaggccaaaaaaagtcttgacataatctttgacttctctctttttctcacatataacacccaacccatcagcaataatattagctctaccttaaaacataatctaaacctaaccactttttatgctctccatcactaccacccttgtacttgccaccaccctgcctcaactaccacagccctagctctctggctgatttccttagttttacatttgagccctggttttctattgtccacatgacaaggaaaggcattctttcaaaacaaaagtcgggtcatgtctggtatctttccactccccctccttactgtatagaacatattgccttctccatcactcaccattgacatctggctaaagcaaggaacaaaaaaacaaggcttctaaactcttcaaaattatcaaagcataagccttggccttcaggaggtttgcagaactccttgggccccagatttgattatcagacttttaaacagaaatttcttagcctttcatcttcttagcctttgaaccccacacctcccttgcaccagtttctcaacagacccctgaattggtcataattctcaaactttatggcatgaaatatgataagatatacaaatatgtgattatagtcagttctccataaatactttcttgtttccttccctactcccttcccctaatatttatttactttttctttcttcttattttattccccatttcttcagagtcaactttgtgtacattcacacaaaggagaccttgtccaaataaagtgaaaattgaagtacatgcccaagttgtttagagactctcaaaccttacttttaatgatgtgaatggagactctcaggttaaagcagcaaactgtgctatttgaggccagcttgattctttggcttctcttgagttgaggagacctagttggtattcccctacctgtccagcctaagttaatataaggtgaccaatttcttctgttgctaaaagaaatgagatctctaaaatcggtggctcagagaggggaattcagtgtggagctgatttcattagataagatacttaaatttcagtgcctgcagagaaactctattttgttgaaatagaaatgtatttggctcacaccatatatttatttctgtaatatggcttagtacagtggagaagagaaaaaaatactatatgtggaccttttaaaagaaatctattcttaaaatgtgctcctcattttatgataggaaactggggagcagtaggtaaactttggtaagggaatgaagacctgaagatattaggttcctggagacctttgtatctagaaaatatgattgtaactacaaccagaaagttgcaagcagacatggttgctggggtgatttgcatcctagttttatcaaggtggaatcctgattacacctataaaatgttataagggaaatgagagattaaacagatcatctaccctttaatagcagttttcttcttttataatctattcctacatgttattcattccctgatttaaaaatatagtacttttttgtttggggttttcaaaaacacagttttctgttttgttcaggctcagattgtgtagccttggggtccctgttataggaaaggctgagactgccaaaccataatcaatgtttctaaagcctggcaccatttcttccctgcaggcacagctcaggaacgtgatgaatctccaagaaagatgaatgactgctcagttttctcagggcttgactgcactcccactagaataagtctgtagtgtagaacagtgacacatagttcctatcaaaactaatgacctgaagagctttattcagcaacaactcatctgactcaaacaaatgagctggaccaagagagcaaaaatcactgtgcatatgtgggtgactcaataattgagcacccatggggtttttccatggtccttgaactaatattttctaactaagctctctttctaaacactgtgtaagtacaaactaatcagacagcttattttccactttggtaattaacaacagcaggggacacagagagctaccagagatactaaaaggaaccagtcttcaatcacggggaacttgactttgttttcctgtacttagaggctgatttggagaaatgtaaagtccacactttctatactatcacaacatgtatctatatttttggtatatgtaatgaataattctgcaacatttaaaaaatcagcatgttaactctaaggcacaccttactacacagtctgtgagaataacaaaaaagctaagcatgcccctgagaccccaaagttggggagcagctgtggtcccataccagtcactgacatggtcaacacaggatcacaaaacatcaaaaagggagtatgaattcgccttggggccaccaagttttagagagaaaatgagtaactcaaggacattttcctggggggtcacaccaatatttgggagggaaataggaagagaagtggagactgagaattaatagtccaagaagtagaaggcaaaccaagagagagaaaaatgggacaccaaaatagaagaaggggttaaggaggagtgatcaggtgagggaacatggttttccagacgaagtggttctctagccccacttgaactttgagatggttgtagttccaactggcagctttattgcaagcttgtgagaaaccctgagccagcaccacccagctgagtctctcccaaatttctgatccccagaaaatgtttgttattgtaaattgctaagtattagaggtaattagttacatagcaatagacacctaatacagcaacagccatttcagtagagcaatggggtggaatccaggacacattgggctaaatagtgatttagaaaagaggaaattggaaaaggaaatgtagaattctttcataaatcttgactgtgaggaatttatgagtaatgacaaaaatagcaaggatttggcaccggggaaagagtttgattgtttttgttctttaatgggaaccatatttttattttgagaggaaaaagccaatagataacagggtttgaagataaagatcctgtgggtatcttgatgctgatgccatcacagtgatgaggaaggggatggagtggtgcaggttactggaacagtaggaggggaagaagtgaaaccctaatggctccagcatttataactctatctcttgctggctctaggtcattctgtaagcaagctatctctaagttgcctagtcttttcaagtttgaagaactcttaggtgctcctaactgtccaaccaggggccttggatatcaaactgtaagacaggaatgaactcacaatatggacactttggttatgttttaggcatttaatttcatctgatcaaagctagaatttcttatggtctaagagcataagagacacgctgttctggggtggtttgctactgaaggtggaaggaccctatgggaactacaattaagtccttcagtaaaagttatgggcccatgattccaatgccatcaattcggattttaggataattccctcccagcctgagctttgaatcttttcatgcttttgcttaatgttttcctccacctggtatgctaggctctgcatggtcaaattgtaaccagttcagagctcacacacttcattctttgtttcctaatgctgcctgctggttttgacatctcttttctctgattcctgtagtgttttctttgtgcctcttattttttgtgttgtgcctttttttttaagtcacttatcttcttataataatgccccagttgctctatcaacacctctgactcagaggccaagttacattgacctcagtattcttaatacttggcatagcacctagcatataatactctgtctgagacatcgtatataaaatgcatttgatgtagtacctgatggatagtaggttctccttgaacttctgccttcccttttgattggttggaaggacgaataactgtttgtatagacggatttctgagctgatcaatggagaaagacactctggcagttttgcctgtccttgaagcactcaagtaagtaaaatgctgtataccttaggaatatgttacttcattttttcatatctgtagggaacacttgggactaaacaattgcactgaagattattttcaatagtattaaaaattattttctgacagttagctgtcatgattgagaactggtttaaggcactctaattatgaagatccagtatgtctgcagtttcagttcccggtttcagagacccctgtggctgggcaagtgttcataccataacacaaaaaagctttggttaaatttcatcctgtgaaacatgtatattcattatgttggtagcctttcacttttctcagaaacaattacttgtgtttataattttgttcttattcagacagatctcatcttttagctttgaagtaggggagaaaagcacagagtacctagaagtcctgaggtataaaaggaagggaaggaaaacctgtactaatgaacacaagcctactgttatgaagtgccaactctaccacacacttggcgtctacaatgtcacttcgaccctcatcccaacaccataaggcaaatattgtgatccttattttacaaatataaaatctaatgatgttgagttatttgctcaaagttacacagctaaaaagcagctcagttaggatttgaatctttgatatcttacttcaaagcttcagcctttgccactataccagactgtatttgtagctcatggatatgagtagaacaccttcccggtacttttattagattgcagtatatttacggagcctttgaaactcagtctttttaaaaaactgtctcataaatgtagttttctcatttactttttatgatgaactatttttaacttagagaaaactatagggaataacacaagctgtgtatctacatacacatcgacagctttaacaaagtctgatgatttaccatttttgctcccaaaatgcgtctcaaaaaaaaacagctagattgagcctttcatcccataataattgtacattcagtattcctattccatgaattgcctattcaagttctttgccattttggaattatcattttgtaggagttttggacatatgtattgcaaataggtcctttcagactatggcttacatttaccttctctacagtattcttttttcaacagaagctttatttctttaaagatagtgttatcaatgatatcctttcttgtcaattcttagtgattcttgaaagaaattcttgcatatctctttatttaaaagccttttattttaggtacatgtgaacgtttgttatataggtaatttcatgtcatgggggtttgtggtacagattatttcatcaaccaggtattaagctcagtacccaatagttatcttttctactcatcttcctcctgccatccttcactctcaattagatcccagtgtctgttgttcccttctttgtgttcatgggtcctcatcatttagctcccacttgtaagtgaaaacatgcagtatttggttttctcttcctgcattagtttgctaagaataatggcctttagctccacccatgttcccagaaaagacatgatttcatttttttatggtgcagagtattccatggtgtatatgtaccacattatctgtatccagtctgtcattggtgggcatttagatgattctatgtctttgttactgtaaatagtgctgcaatatacattcatgtgcatgtagaatgatttattcctctgaatatgtacccagtaatgggattgctgagtcgaatactagttctgcttttggctctttgaggaattgctatactgctttccacaatggttgaactaatttacactcccagcaagtgtataagtgttgccttttctctgcaacctggccagtatatgttttgttttgtttttactttttggtaatagccattctgactggtgcgagatggtatctcattgtggttttgatttgcaaatctctaatgactagtgatgttagtatttttttcatatgcttgttggctgcatgtttgtcttcttttgaaaagtgtctgctcatatcctttgcccactttttaatggggttgtttgttttcctcttataaatttaagttccttacagatattgaatattggacctttgtcagatgcatagtttgcaaatattttatcccattctgtaggatgtttgtttattctgcttatagtttcttttgctatgcagaagctctttagtttaattagatcccacacatcaatctttgcttttgttgtgatagatttgatggctctgtcatgagatgtttacccattcttatgtccaagatggtattgcctaggttgtcttccagagttttcatagttttgggttttacatttatatctttaatccatcttcagttgatttttgtgtatgatgtaaaaaagaggtccagcttcaatcttccgcatctggctagccacttatcccagcaccatttattgaatagggagtcttttccccattgcttgtttttgtcagctttgtcgaagatcaggtggtcataggtgtctagccttatttctggtctctctattctgttccactggtctatgtgccgttttttgtaccagtaccacattgctttggttatgggatccctgtagtgtagtttgaagttgggtaacatgatgcctccagttttgtcctttttgcttacgatttccttggctattcagactcttttttggtcccataagaattttaaaatagttttttctagttctgtgaagaatgtcattgtagtttgatgataacattcaatctgtaaattgctttgggcagcatggccattttcatgatattaattattcctattcatgagcatggaaaatttgtcatttatttgtgtcttctctgatttctttcagtggtgttttgtaattctcattgtagagctctttcacctccctggttagctgtattcctgggcattttttgtgtgtgtggcaattgtgaatgagatttccttcctgatttgactcttggcttgactattgttggtgtataggaatgctagtaatttttgtacattgattttgtgtcctgaaactttgccgaagttgtttatcagctgaagcagcttttgggcagagactatgagattttccagatatagaatcatgtcatctccaaacaaagatagtttaatttcctctcttcgtatttgtatgccatttatttgcttctcttgcctgattcctctggccagaacttccaatactatgttgaataggagtggtgagagttggcatccttgtcttatgccaattttcatggggaatgcttccagcatttgcccatttagtatgatgttggctatgagtttatcatagatggctcttattattttaagacatgttcctttaatgcttcttttattgagagttcttaacataaagggatgtagaattttattgaaagccttttctgtgtctattgagataatcaacgtggtttttgtctttagttctgtttatgtcatgagtcacatttattgatttgcatatgttgaaccaaccttgcatccaggggatgaagcctacttgatcatggtggattagctttttgatgtgctgctggattcagtttcccaatattttgttgagagtttttgcattcatgttcatcaaggatattggcctgaatttttctttttttgttgtgtccctgccaaattttagtaccaggatggtgactgcctcatagaatgagttggagagaaggccctcctcctctattttttggtatagtttcagtaggaatgataacagctcttctttgtacatctggtagaattcagctgtgaatccaccaggtcctggacttttgttggttagtgggctatttattactgattcaattctgaagctcattattggtctcttcagggaatcaatttcttcctgacgcagccttgggaggatgtatatgtccaggaatttatccatctcttctaggttttctagtttgtgtgcaaagaggtattcatagtggtttctgatggttatttttatttctgtgtgcttactgacaacattccctacattatatttaatcgtgtttatttggatcattctctcttttcttctttattagtctagctagcagcctattttattttttttaaaaaaaaaaaaacatactcctggttttattttaaatgttttgaaatttttttatctgtttccttagtttagctctgattttggttatttcttttcttctcctatctttgtggttgatttgttcttgcttctctaattctttcagttgtgatgtaagttgttagtttgagaacttcctaactttttgatatgggcatttagtgtgtattttagtatgaatttccctcttgacactgccttaactgtgtcccctagattctggtatgttgtatccttgttctcattagtttcttggtttctgccttaattttgtcatttacccaaaagtcattcaggagcatgttgtttaatttctatgtaattgcatgattttgagcaattttttcagtcttgacttctgtttttatcatgctatggtctgagagtatgtntggtatgatttggttcttttggatttgctgcggattgggttatgtccaattacgtggtggattttaaagcatgtgccatgtggtgatgagaagaatgtatattctgttgtttttgggtgaagagttctgtagaggtctatcagatccatttggaccaatgttgagttcaggtcttaaatatctttattacttttctgccttgatgatttgtcacatactgttggtggagtgttgaagtctcccactattactgtgtgggagaccatgtctctttgtaggtctctaagaacttgctttatgaatctgggtgctcctgttttgggtgcatatatacttaggatagctaggtcttcttgttgaattgcaccctttaccactatgtaatgcctttctttgtcttttttgatctttgttggtttgaagtctgttttgtctgaaattaggattgtgacccctgctttttttctgtttcccatttgcttggtacattttcctccatccctttattgtgggcctaggggtgtcattacatatgagatgggtctcttgaagacaggataccattgggtctttctttttattcggcttaccactccatgccttttaagtggggcatttagcctatttacattcaagattagtataggtatgtgttcattttatcctgtaattgtgttgttagttggttattatgttggtttgtttgtgtggttgctttacagtgtcactggtctgcatgtttacatgtgttctttattagctggtagcaataattcctttctatatttagcactcctttcaaaatctcttgtaaggcaggtctggtggtaacgaactccctcaatatttgtttatctgaaaagaatcttatttgtcctttgtttaggtagcttagttaggcttcaaccaaattcttggttgaagattttttttctttaggaatgttgaatataagcttccaatctcttctgacttatagggtttcagctgagaggtctgctattagcctgatggagttccctttgcaggtgacctgccctttctctctagctccctttaatattctttcccttatttcaaccctggaaaatctaacagttatgtgtattgcagatgatcttcttgtataaaatcttacagaagttctctgtattttctgaatttgactgttagcctctgtggcaaggttggggaagttttcatggatggtatcctgaaatatgtttttcaagttgttttctttctcccctcaccctttcaaggttgccagtgattcatagatttggcctgtttacctaatccatacttctcagaggttttgttcattcctttttaatcctttttctttatatttgtgtggctgtcttatttcagtaagccagtcttcaagttctgagattctttcctcaacttggtttattctactgttagtacttgtgattgcattgaaaaattcttgtgttattcagctctgtcagattaattagggtcttttttatatcggctattttgtccttcagctcctgtattgttctattgcaattcttagtttctttgaattgggttttgccatcttcctgaatcttgatgatcttcactcctatccatattctgaattctatttctgtcatttcagccagttcagcctgggtaagaactcttattgaaaaactggtgcaatcatttggaagatgtatgacactctggccatttgagttaccagagtacttgcattggttctttctcatctctctgtgtggatggttttttaactgcacgtagactgagtacagtcaatagacttgttttctggttattttctcagggccaaggctttgtgcaggatctttatttgaagctgactttctgtcttcggttttagacatgaaaccgcagggtatggtagcaaggtatttttggtgttgaagctttgggatgtgatccagtaggtggcacttaggtgtattagtcagttggtggactcttgcttggttgtgtgcccatccttccacccgtgttttctcacagttgcagccatgtttcctctcaatgctctgaaagtgtggtttcctctcccccttgagtgctggctgtagattgcagcttggtgctcctgggctgcccacagccactctggaacaaactcagtgttcatgttccttccctaacttgtaggcagcagaggaagcgaccttagtaatggttgtggccaagggtcatttgcttgtctcctgggggctccaccccaaggaaatgcagttcagcaattgctcagtgcaatcagccaggatggagggtctgtgctgtgggcccaagctaagagttccctgtctggagacaagcagtaggggtgagacccatggggcatggacttgcctcctctccttgggttgactgcagtttgttggaggtgtggataaggcacttaaggtatttgcttcttcgttagtctgagggtagcaaggcagctacactgcagaggcagtggcaaagagactttcagatgccccctgggggctgtgtccagggagtttccaagctgctactggctcaatagctctggttagaggtggctagaggcccaggcctggaggacctgcttggtgaggagatatgggaatgggcacccatgtaacagcctggccacttttccatagaacttctgcaatatgctggggccctgctccagtccctagtcaccttggactttccagtacctgaaggtaacaacagtgaaggctgcaaagcagtaaaaatagcagcctgcctctccgtctgggatctccctcccagggagatatggaccttttaccatctcaaacacaggcgtaggaggtagctggagaccctggctgggagttcctgcccagtgaggaggaatgggattgggggcctgctttaaaaagtctggccacattttcatagagcaactgtgctgtgcgaagggactgcttctgcctgcagttgccttggactctctgaggcctgaagtctggatggctaagtcgcccaaacagcaaggatggtggcctgtccctccttctgagagcactgtcccaggaaggttctgaatctctgttggccaaaaaacaccggcagggatggctggaggccccagtgggaggttctgcctagtgagaaggaaggagatcgaggacccgtttaaactaagcagtctgacccgttttcgtatagcagttgcactgtgctgaggtacccgcttccgccccctgctcaccttggactctccaaagcctgaaggctggaatagctcagttgcctaaacagcaaagatggcctcctgcccctcccactgagagcgctgtctcagagaggtgcaacactgttactcctggctgacaggaattacaagccagtgggtcttaatcctgtgaggtgccgtggaagtggggcctgcagactgtcactgctcagccccctggattcagcccctttcctaggggtacataaggagtctaaccactcactttgcaagagtgcatctgtttttgcagggaaacccataaagcccaggtctctaaggctcccaggtctctaaggctcctaggtctctaaggctgagcagctgctctgcagagactccatgtagctacatgtgtgggactgaaggccctggtggagtgggttcacgaggggatctcgtgaaccgaggattgcaaaaatccatgggagaagtgtgggttcccagggtcgcacattcactcaccacttccctaggtaggggaggttgccctggctccacgctgctcccggtgggccatcatcctgccttgcttttcttccttctccttgggtgaacttgtttccttgattagttccaatgcctgtacctggatattttagttgaggttgctgtatttcctcaccccttccgttcttctccatgagagcccacacactagctgctcctagcaagccatcttcttctttcatatctcaaagtcataaatatattcttttatttttgagacagagtctcactatgctgtccaagcaggtctcaaactgctgtgctcaagtgatcgtactgcctccacctcccaggtaactgggattataggtgtgcaccagcacaactggcagactatattctatagtttcttctacaaatcacctttcacacatttaggaatttaatctatctgtaacttacttttttgtgggaagtgttactattctagctttttcccaaatggacaattagtcagttgtcccagaaaaatatattgtagtacctatttttctcccatgtcttataagagctgccattttgaaatgagttcctcatcatcatcatgaatttgttatttgtttcagtgtctgtattctgttccagcaacataattatttctctctaagtaaatagtatgtttatcttaagatctataccttcaaaataagttgtatttttgcttagaaaatacctctagactcttcacaattatctttgctcttattcaccttttttgtttcatatgaattttaggatcatctcataaagtcacacgaaatatcctgctggggtttttctcagaaatgcactgaatttatgaagggatatgtacagacttgacatatttgtattattgagtcttatcatctaaaaacacagtatgtctctccatttattcaggaataatttggccctcaatatgtttagtaatgttctctataaagggcttgtacatttttcatctttaataaaatttattcctaaatatcttttcagttttcttgctactgtgaatggcatgtcattctactacacgttgattactgctagtgtaagaaaaggctattaatttttgtatgtaaatcttttcaccaacaaatttgctggattctttttttatttccacttatttgctttcaatatttttgaattttctatgtatacaataatacacctaaaaataaagatctttttgtattttttatttcagttcctgtaccttatattttcttgtcctccttaatttactatgactaatactatactaaattgtaaagacaagcacacttttcttacttctgagttttagctattaaatatggtgcatgatgtagtatttaaaggacattattcatcaagttaagagaattcctttcattcctagtttagtaagagcttctttttagtcactaatctgtattaaaaattttcaaatgctttttacatatgttttaacaccatcatatagcatttctattaatctgttaatgtaaaggattacattaatagattttgactgtatatagtattacgcatatatggtacgcaaacatcttgagatttttgtctatacctataagttgactatttactattttaatatcaaggttattccagcctcataaaataagccatgtagcatttcatttaaaaaaatgtacataagatagaaatcatctgtcccttggaagttcagtaaaacttgcctgtaaatcattctgggtaggatatcttttgggtgtggagattttaactagcaattaatttaaataatggtcattgttagtgtttcagctttggccattataaacaatgtaactatattaatcattctgggcctcagtttcatcatttatacctactccacaccatttttattttttttcatttttatttttatttatttatttatttattgagacagagtcttgctttgttgtccaggctggagtgcagtggcactatctcagctcactgcaacctctgcctcctgagttcaagcaattctcctgcctcagcctccaagtagctgggattacaggtgcacatcaccatgcctgactaatttgtttgtatttttagtagagatggggtttcacaacgctggccaggctggtttcaaactcctgacctcaagtgatccacccaccttggcctcccaaagtgctaggattacaagcatgagccatcgctcccgacctattattcattttttttttttgagacgtagtctcgctctgttgcccaggctggagtgcagtggcacgatctcagctcactgcaacctccgcctcccagattcaaacgatttttctgcctcagcctcccaactagctgcaactacacctgcttgccatcatgtctggctaatttttgtatttttagtagagacagggtttcaccatattggccaggctgatctcgaactcctgacctcatgatctgcccacgctggcctcccaaagtgctgggattacaggtgcgagccaccacacttggcccctattattcatttttaaatctttctttttgagacaattttgattttttatttaaaatttttcatatttattggcataaaagttttgttatttgtcatattacttttttatttgtaactatgtctcctttattgttaaaaaatatacatatttttgcaagatggccgaataggaacagctccagtctgcagctcccagtgagatcaacacagaagatgggtgatttctgcatttccaactaaggtacctggttcatctcactcagactggttggacactgggtgcagcccatggagggcaagctgaagcagggggggcatctcctcacccaggaagcacaaggggtggagggatttccccttcctagccaagggaagctgggacagactataactggagaaacaatacactcctgaccaaatactgtgctattcccacagtcttagcaaccggcagaccaggagataccctcccatgcctggccgggcaggtcccacacccacagagcttgcttactgctaatacagtagtctgagatcaacctgtgatgctgcagcttggcagggggaggggcatcagccattgctgaggcttgagtagctcacagtgtaaacaaagcatcctggaagctgaaactgggaggagctcactgcagcacagcaaggcctactgcctctctagattccacctccgggggcagggcatagcagaacaaaaggcagcagacagcttctgcagacttaaacatccctgtgtgacagctctgaagacagcagtggttctctcagcatggcattcaagctctgagaacagtcagattggctcctcaagctggaccatgacccccatgtagcctgcctgggagatacttcccagtaggggccaacagacacctcaaacagatgggtggccctctgggatgaagcttccagaggaaggatcaagcagcaatatttgcttttctgcagcctccactggtgatacctaggcaaacaggttctagagtggacctccagcaaactccaacagacctgcagcagaggggcctgactgttagaaggaaaactaacaaacagaaaggaatagcatcaacatcaacagaaaggacatccacagcaaaaccccatctgtaggtcaccaatatcaaagaccaaaggtagataaaaccacaaagatggggagaaaccagagcagaaaagctgaaaattccaaaaaccagagagtctcttctcctacaaaggatcgcagctccttaccagcaagggaacaaaactgaatggagattgagtttgacaagttgacagaagtaggtttcagaaggtcagtaataacaaacttctccgagataaaggagcatattctaacccatcgcaaggaagctaaaaaccttgacaaaaggttagacaaatggctaactagaataaacagtgtagagaagaccttaaattacctgatggagctgaaaaccacagcacaaggacttcgtaacacatacacaagcttcaatagccgatttgatcaagtggaagaaaggatatcagtgattgaagatcaaattaatgaaataaagtgagaaaacaagaatagaaaaaaaaaagagtaaaagaaatgaacaaagcctccaagaaatatgggactatgtgaaaagaccaaatatatgtttgattggtgtactggaaagtgatgaggagaatggaaccaagttagaaaacactcttcaggatattatccaggagaacttccctaacatagcaaggcagaccaacattcaaattcaggaaatacatagaacaccacaaagatactcctcgagaagagcaaccccaagacatataattgttagattcaccaaggttgaaatgaagggaaaaaagtgttaagggcagccagagagaaagctcaggttacccacaaagggaagcccatcagactaacagcggatccctcagcagaaaccctacaagccagaagagagtgggggccaatattcaacattcttaaagaaaagaattttcaacccagaatctcatatccagccaaactaagcttcataagtgaaggagaaataaaaatcctttacagacaagcaaatgctgagacattttgtcaccaccaggcctgccttacaagagctcctgaaggaggcactaaacatggaaaggagcaaccggtaccagccacttcaaaaacatgctaaattgtaaagaccatcaacgctatgaagaaactgcatcaattaacaggcaaaataaccagctaacatcataatgacaggatcaaattcaaacataaaaatattaaccttaaatataaatgggctaaatgctccaattaaaagacacagactggcaaattggataaggagtcaagaaccatcgatgtgctgtattcaggagacccatctcacatgcaaagacacacacaggctcaaaataaagggatggaggaagatctaccaagcaaatggaaagcaaaaaaaaaagtaggggttgcaatcctagtctctgataaaacagacttcaaaccaacaaagatcaaaagagacaaagaaggtcactacataatggtaaagggatcaattcaacaagaagagctaactatcctaaatatatatgcacccaatataggagcacccagattcataaagcaagtccttagagacctacaaagagacttagactcccacacaataataatgggagactttaacaccacactgtcaatattagacaaatcaacgagacagaaggtcaacaaggatatccaggacttgaactcagctctgtatcaagcagacctgatagacatctacagaactctccatcccaaatcaacagaatatacatttttctcagcaccacattgcacttattctaaaattgaccacataattggaagtaaaacacttctaaacaaatgtaaaagaacagaaatcacaacaaactgtctctcagaccacagtgcaatcaaattagaactcaggattaagaaactcacttaaaaccccacaactacatggaaactgaacaacctgctcctgaatgactactgggtacataacgaaatgaaggcagaataaagatgtcctttgaaaccaatgagagcaaagacacaatggaccagaatctctgggacacatttaaagcagagtgtagagggaaatttatagcactaaatgcccacaagagaaagtaggaagatctaaaattgacaccctaacatcacaattaaaagaactagagaagcaagagcaaacaaattcaaaagctagcagaaggcaagaaataactaagatcagaacagaactgaaggagatagagacttgaaaaaccctttaaaaaatcaatgaatctttatagcaccaggatttataatcctttgggtatatacccagtaatgggaaggctgggtcaaatggtatttctagttctagatcctggaggaatcaccacactgtcacatgtatgtttattctggcactattcacaatagcaaagacttggaaccaacccaaatgtccatcaatgatagactggattaaaaaaatgtggcacatatacaccatgaaatactatgcggccataaaaaaggatgagttcatgtcctttgtggggacatgggtgaagctggaaaccatcattctgagcaaactatcacaaggacagaaaaccaaacaccacatgttccccctcatagtaggaattgaacaaagagagcacttggacacaggatgggggacatcacatactggggcctgtcatggtgtggagggagcagggaggaatagcattagaagatatacctaatgtaaatgatgagttaatgtgtgcagcacaccaacatgacacatgtatacatacataacaaacctgcacattgtgtacatgtactctagaacttaaagtataataataataataaatcaatgaatccaggagctgttttttctaaaagatcaacaaaatagatagatcactaacaagactaataaagaagagaagagagaagaatcaaatagatgcaataaaaaatgataaaggggatatcaccaccaatcccacagaaataaaactactatcagagaatactataaacaactctatgcaaataaactagaaaatctagaagaaatcaataaattcctggacgcatactccctcccaagactaaaccaggaagaagttgaatctcctaatagaccaataacaggttctgaaattgaggcaataattaagagcctaccaaccaaaaaaagtctaggaccagacggattcacagccaaattctaccagaggtacaaagaggagctggtaccattccttcagaaactattccaaccaatagaaaaacagggaatcctccctgactcattttatgaggctggcatcatcctgataccaaagcctggcagagacacacacacaaaaaagagaattttaggccaatatccctgatgaatatcgatgcaaaaatcctcaatataatactggcaaaccgaatccagaagcatatcaaacagcttatccaccacaatcaagtcagcttcatccctgggatgcaaggctggttcaacatatgcaaatcaataaacataatccatcacataaacagaaccaatgacaaaaaccacatgattatctcaacagatgcagaaaaggcctttgacaaaattcaacagcgcttcatgccaaaaactcttaataaactaggtattgttggaacgtatctcaaacaagaaaaggatgccctctctcaccactcctattccacatagtgttggaggttcaggccagggcaatcagacaagagaaagaaataaagggtattcacttaggaaaagaggaaatcaaatagtctctgtttgcagatgacatgattgtatatttagaaaaccccatcatctcagcccaaaatctccttaagctaataagcaacttcagcaaagtctcaagatacaaaatcaacttgcaaaaatcacaagcattcctatacaccaataacagacaaacagagagccaaatcatgagtgaactcccattcacaattgcttccaagagaataaaatacctaggaatccaacttacaagggatgtgaaggacctcttcaaggagaactacaaaccactgctcaacgaaataatagaggacacaaacaaatgaaagaacattccatgttcatgggtaggaagaatcaatatcatgaaaatggccatactgcccaaggtaagttatagattcaatgctctctgtatcaagctgccactgacttccttcacagatttggaaaaaactactttaaagttcatatggaaccaaaaaacagcctgtgtagccaagacaaccctaagcaaaaagaacaaagctggaggcatcacgctatgtgacttcaaactgtactacaagactacaataaccaaaacagcatggtactggtaccaaaacagagatatagaccaacggaacagaacagagacctcagaaataataccacacatctacaaccatctgatctttgacaaacctgacaaaaacaagaaatggggaaaggattcccctatttaacaaatggtgctgggaaactggctagcaatgtggaaaggattccctatttaataaatggtgctgggaaactggctagcaatatgagaaagctgaaactgcatcccttccttacaccatatacaaaagttaactcaagattggttaaagacttaaatgtaagacctaagaccataaaaaccctagaagaaaacctaggcaatatcattcaggacataggcatgggcaaaggcttcatgactaaaacaccaaaagcaatggcaacaaaagctaaaatagacaaaggggatctaattaaactaaagagcttctacacagcaaaagaaactatcatcagagtgaacaggcaacgtacagaatgggagaaaattgttgcaatctacccatctgacaaagggctaatatccagaatctacaaagaacttaaacaaatttacaagaaaaaatcaaacaaccccatcaaaaagtgggcaaaggatatgaacagacacttctcaaaagaagacatttatgcagccaacagacacatgaaaaaatgctcaccatcactggccaccagagaaatgtaaatcaaaaccacaatgagataccatctcacaccagttagaatggcgatcattaaaaagtcaggaaacgacaggtgctggagaggatgtggagtaataagaatgcttttacactgttggtgggagtggaaattagttcaaccattgtggaagacagtgtggcaattcctcaaggatctagaaatagaaataccatttgacccagcaatcccattactgggtatatacccaaaggattataaatcatgctactataaagacacatgcacacgtatgtttattgtggcactatccacaatagcaaagtcttggaaccaatccaaatgtccatcaatgatagactggattaagacaatgtggcacatatacaccatggaatactatgcagccataaaaaaggatgagttcatgtcctttgcagacacatggatgaagctggaaaccatcattctcagcaaactaacacaagaacagaaacccaaacaccgcatgttctcactcataggttggagttaaacaataagaacacatggacacaggacagggaacatcacaccctggggcctgtcggggtggggagcagggggagggatagcattaggagaaatagctaatgtaaatgacgagttgatgggtgtagcaaaccaacatggcacatgtatacctatgtaacaaacctgcaagttgtgcacaagtaccctggaacttaaagtataaataataaaaaaaatatatatatacgtatttttttacttcccccatggtcagtcttgcttgaggtttgtctagtttgtctcttcaaataactgatttttagtattgttaagtctaagttttgtttattttcataattcattacttaattatttcctcttttctgtgtttacacagggtttctacataaatatcagtagcaactttatttgtagcagacaaaatgtggaaacaattcaaacacccatcaacaagtgaatgaacaacagattgtggtatcctaatttgtcattgaaatactactcatgtaaaaaaactctattaatacacaaaacagcatagccataactcaaaaacattatgctatttcctaagtgaaaaataaagtttatattgcataatcctattcatatgaaatttcagaaaagacaaactaatcaagagtgacaaaaacatcaatgattgattgaagttgagatgagtatggggtcattactgactggtaaggggtaagagagtgatgaaaatattctatatctgatttattagtctgttttcacattgctgataaagacatacctggaggagccaagatggctgaataggaacagctccggtctacagctcccagcatgagcgacgcaaaagacaggtgatttctgcatttccatctgaggtaccgggttcatctcactagggagtgccagacagtgggcgcaagacagtgggtggagcgcaccgtgtgcgagccgaagcagggcgaggcaaggggtgacagacagcacctggaaagtcgcgtcactcccacccgcatactgtgcttttccgacgggcttaggaaatggcgcaccaggagattatacccggcacctggctcggagggtcctacgcccacggagtctcgctgattgctagcacagcagtctgagatcaaactgcaaggcgcagcgaggctgggggaggggcacccgccattgcccaggcttgcttaggtaatcaaagcagctgggaagctggaactgggtggagcccaccacagctcaaggaggcctgcctgcctccataggctccacctctaggggcagggcacagacaaacaaaaagacagcagtaacctctgcagacttaaatgtccctgtctgacagctttgaagagagcagtggttctcccagcatgcagctggagatctgagaaggggcagactgcctcctcaagtgggtccctgacccctgacccccgagcagcctaactgggaggcaccccccggtaggggcagactgacacctcacacggccaggtcctcctctgagacaaaacttccagaggaacgatcagacagcagcattcgcagttcacgaaaatccactgttctgcagacacgctgctgatacccaggcaaacagggcctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaaaatgaggaaaaaacagagcagaaaaactggaaactctaaaaagcagagcacctctcctcctccaaaggaacgcagttcctcaccagcaatggaacaaagctggacggagaatgactttgacgagttgagagaagaaggtttcagacgatcaaactactccaagctacaggaggaaattgaaaccaaaggccaagaagttgaaaacttggaaaaaaatttagacaaatgtataactagaataaccaatatagagaagtgcttaaaggagctgatggagctgaaagccaaggctcgagaactacatgaagaatgcagaagcctcaggagccgatgcgatcaactggaagaaagggtatcagtaatggaagatgaaatgaatgaaatgaagcaagaagggaagtttagagaaaaaagaataaaaagaaatgaacaaagcctccaagaaatatgggactatgtgaaaagaccaaatctacctccgattgatgtacctgaaagtgacagggagaatggaaccaagttggaaaacactctgcaggatgttatccaggagaacttccccaacctagcaaggcaggccaacattcagattcaggaaatacagagaatgccacaaagatactcctcgagaagagcaactccaagacacataattgtcagattcaccaaagttgaaatgaaggaaaaaatgttgagggcagccagagagaaaggtcggcttacccacaaagggaagcccatcagaataacagcagatctcttggcagaaactctacaagccagaagagagtggggaccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccatcgagactaagaagaaactgcatcaactaacgagcaaaataaccagctaacatcatcatgacaggatcaaattcaaacataacaatattaactttaaatgtaaatgtgctaaatgccccaattaaaagacacagactggcaaattggataaggactcaagacccatcagtgtgctatattcaggaaaccaatctcacatgcagagacacacacaggctcaaaatgaaaggatggaggaagatctaccaagcaaatggaaaacaaaaaaaggcaggggttgcaatcctagtctctgacaaaacagactttaaaccaacaaagatcaaaagagacaaagaaggccattacataatggtaaagggatcaattcagcaagaagagctaactatcctaaatatatatgcacccaatacaggagcacccagattcataaagcaagtcctgagtgacctacaaagagacttagactcccacacaataataatggcagactttaacaccccactgtcaacattagacagattgacgagacagaaagttaacaaggatacccaggaattgaactcagctctgcactaagcggacctaatagacatctacagaactctccccccaaatcaacagaatatacatttttttcagcaccacacctattccaaaattgaccacatagttggaagtaaagctctcctcagcaaatgtaaaagaacagaaattataacaaactatctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaccaacgagaacaaagacacaacataccagcatctctgggacacatgcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggagatagagacacaaaaaactcttcaaaaaatcaatgaatccaggagctgttttttgaaaggatcaacaaaactgatagaccgctagcaagactaataaagaagaaaagagagaagaatcaaataaacgcaataaaaaatgataaaggggatatcaccaccgatcccacagaaatacaaactaccatcagagaatactacaaacacctctccgcaaataaactagaaaatctagaagaaatggataaattcctcgacacatacactctcccaagactaaaccagaaagaagttgaatctctgaatagaccaataacaggagctgaaattgtgccaataatcaacagcttaccaaccaaaaagagttcaggactagatggattcacagccgaattctaccagaggtacaaggaggaactggtaccattccttctgaaactattccaatgaatagaaaaagagggaatcctccctaactcattttatgaggccagcatcatcctgataccaaagccgggcagagacacaacaaaaaaagagaattttagaccaatatccttgatgaacattgatgcaaaaatcctcaataaaatactagcaaaccaaatccagcagcacatcaaaaagcttatccaccacgatcaagtgggcttcatccctgggatgcaaggctgattcaatatatgcatatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatccccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatgtatagattcaatgccatccccatcaagctaccaatgcctttcttcacagaattggaaaaaactactttaaagttcatatggaaccaaaaaagagcccgcatcatcaagtcaatcctaagcccaaagaacaaagctggaggcatcacgctacctgacttcaaactatactgcaaggctacagtaaccaaaacagcatggtactggtaccaaaacagaaatatagatcaatgcaacagaacagagccctcagaaataatgccacatatctacaactatctgatctttgacaaacctgacaaaaacaagcaatggggaaaggatcccctatttaataaatggtgctgggaaaactggctagccatatgtagaaagctgaaactggatcccttccttacaccttacacaaaaattaattcaagatggattaaagacttaaacattaggcctaaaaccataaaaaccctagaagaaagcctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtggacaggcaacctacagaatgggagaaaattttcacaacctactcatctgacaaagggctaatatccagaatctacaatgaactcaaacaaatttacaagaaaaaatcaaacaaccccatcaaaaagtgggcaaagcatatgaacagatgcttctcaaaagaagacatttatgcagccaaaagacacgtgaaaaaatgctcatcatcactggccatcagagaaatgcaaatcaaaaccacaatgagataccatctcacgccagttagaatggcaatcattaaaaagtcaggaaacaacaggtgctggagaggatgtggagaaataagaacacttttacactgttggtggggctgtgaactagttcaaccattgtggaagtcagtgcggcgattcctcagggatctagaactagaaataccatttgacccagccatcccattactgggtatataaccaaaggactataaatcgtgctgctataaagacacatgcacacgtatgtttattgtggcactattcacaatagcaaagacttggaaccaacccaaatgtccaacaatgatagattggattaagaaaatgtggcacatatacaccatggaatactatgcagccataaaaaaggatgggttcatgtcctttgtagggacatggatgaaattggaaatcatcattctcagtaaactatcgcaagaacaaaaaaccaaacaccacatgttctcactcatagatgggaattgaacaatgagaacacatggacacaggaaggggaacatcacactctggggcctgttgtgggggggaggaaggggggagattgcattttgagaaatatcttatgttaatgacgagttgatggtggtagcaaaacaacatggtgcatggttacctatgatacaaacctgctagttgtggaccatttccctggaacttaaagtttgaataataaaaaaaatatatatatacctgtttttttacttcccccatggtcaaccttgcttgaggtttgtctattgggctttttcaaagaactgaattttagtattgttatactttaagttttgtttatttagataaataattacttaattatttgctagtttttgtgtttacacagggttctcttacataaattttctgagcttatttctattagtctcagataaaatgtggcaatttttgtaaccatatttatcacttgattgaacaccgaatagtgggatcctaattttgtaattgaaatactatcttaggaataaaaacctttttttaattacactgaaccaactatagccatgttttcgataaacattgttgttatatcccttaagtgaacaaataaaggcttattatggggttgattcctatttctttttaaaaatttatataaaacactttcgtaatttaggggggtactttaccctgtttatagatttgatggggcactgtgaatatgatcttattgggtttaatttccttgaatggtaatagtggcgtaaataataacgggttgatatctttgtctcattatctccagtagaataatgctaattgttaaacattgttctaataataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcttctcctccacacatcacatacatctcacgccactcacaaccccaatcattaaaaactcaccaaacaacaactcctccacaccatctccacaactaacaacacttttacactcttcctccccctctcaactacttcaaccattctccaactcactccccccattcctcacccatctacaactacaaataccatttcacccacccatcccattactccctatataaccaaaccactataaatcctcctcctataaacacacatccacacctatctttattctcccactattcacaataccaaacacttccaaccaacccaaatctccaacaatcatacattccattaacaaaatctcccacatatacaccatccaatactatccacccataaaaaaccatcccttcatctcctttctacccacatccatcaaattccaaatcatcattctcactaaactatcccaacaacaaaaaaccaaacaccacatcttctcactcatacatcccaattcaacaatcacaacacatccacacaccaaccccaacatcacactctcccgcctcttctcccctccccccaccccccacccccaacattaccaaatatacctaatgctaaatcaccacttaatgggtgcagcacaccagcatggcacatgtatacatatgtaactaacctgcctgttgtgcacatgtaccctaaaacttaaagtataataataataatttaaaaaaaaaaagaattttttaatcaaaagttaaaaaaaaaaagacatacctgagactgggtaatttacaaggaaaaagaggcttaatggattcacagttccacgtggctggggaggcctaacaatcatgacacaaggtgaaaggcatgtctaacatggtagcagacaagagagaataacagagcttgtgcagggaaactcccctttataaaaccatcagacctcgtgagacttattcactatcatgagaacagcacaggaaagacctgcccccatgattcaattacctcccacccaccaagtccctcccatgacacgggggaattgtgggagcttccattcaaggtgagatttgggtggggacacagccaaaccatatcatctgggttgttgtggtggttccataggtacatacattttcaaaactcatcaaactgtacacttaaaactagtgtattttattatgtgtaaattataccttcataagcttatttttaaaaactacaatgagataccttttctcacccactggaatggttaatattaaaaagactgacaatacaaatgtcgagaatgtggagcaacattctcatacactgctgatgagagtgtaaaatggtgcattcacattggaaaactcattggtgatttctagtaaagataaacgcatgccttccttcttatctagaagtatatatctaagagaaatgcatatatatttacaaaaagacttttccaaaaatgttcatagctgctttttctcacagtagtcaaaaatggaaaacaactcaaatgttcaacaaataaaagaagataaataaattgtggtgttccagaccatgaaataatatgcatcattaaaacaataatgaattacttatacacacaagcccatggatgactctgtatataattctatacctgtgtgaatctgctttggcagtgtataactggtcacatgtttagcagctttgaatacaagccctccttttctaccatccttcttgggttttggtattcattgtcttgtgagtccatttttttgtatggcttataaggtcatcctggagtttcgtcttgtttggaaaccccatttcctatcccccaaccagctggaaaggtttggataccatgataataaagcacatacaaatggacttaggtgacctctgagtcagatatcaacaagaaaatcccttcattgcttagactttgaggtactcttccttgattttatctctcttcacctttcctcacctgggaggcagaagatagggagtcgcccaaggcaaggggatcaaaaaatctcctctacctgcttttgatgtcagaattagccctgtctgaagctgagcgatcagcccagctcaccaagtatttgagagaaaaactggaatagtacatacaatgtgtttgcctggagtttttctctgcatagttacctgtgatggtcaaagtgactaaccttcagggatcctgggagctggcaaaagatcatcacagtcgaacaaatagctgacctataaattgattctcattccctagtctcgtgttcattattacaatacaaacaccatgaagacaaaaaagccgtgccccaagccccttagagttgtccagctctcttcccaagcactttttttccttgtctatgccagaaggcactggattcggcagtctcttgcccattcaaaaagtcctaaactgacacttctgaagaggatcaactagcaaaccagcattagactgtactctttatttcaggctacatcagaatgaggcatccattgataaatggttatgatcaaaagaaagacttggagaatcagttgtccaactgattataattttctttgcacaaaatatggattcaatttctggtattgaagaccaactcagtagaaagaagccttagagggttatgtcagatttccctttattagatcctttgctctccttttgtctccacataagcttcagatatatgctggagaaaaccttcagtaagccatgaagtgccctttgaacatccgtccctcctggttgcagtattctgagcagataagacaggcaattaacttggtacacagataaagttggggcaggaagcccggcatgattttaggctcttggtgaaggagaaggtaaaacaactcaccttatagaagagagaaaacatgttacaagtacacacataaccccactcactaccccattgggtatagtcttgttcagtcctacatttctagaagggaacagctctgctgtttatacctgtgggaggcatactggggcctagtctaccacaggtattagatctacatgtggttagcaggaaagtgtccataaatttgcagatccttcaggaattcaccctatgtttatacctagaatttagagttgagttcaaggctgatgagcataagtttagcccaaattcaactgaacctgagattatggatcccgccctaatttaagggtaagaaaaacagaacagcaaagatcaagagaacaagagtgagttcaaggaattctggagcaacctatcaaattaacagtatttacttagccctgtgtggctccacacaatgctttgtgttaaaggattcttaagtgtgagacatgggccctggaccacagaggggacaagacatgcacccatgagaagatcaagaaatcatgctaggtagcgcataattcaggaccaagttgtgtgtgattgttggtgaacacattaacaacaaatcagcaaatggagagagtctgtggccttcctccagagatcagggaagctttaaaggagggactgaggcttaagcagcattcttaaaaaggatttggattagctgagaagaaatggagagagggagacattcttgctttggctggaaaaggaacaaaagcttgggagggaggagtgagtgcaaaacattcacgtgacaagaaggaagtagagaaagagtgaggcaaggttcataagataagagccaaaccatggagggtcttgtaagctgatgagtttgtttgatttaatgtgttaagaaatgcaacactgtattaataagtctatccatttagttgctgacagtgcagggtcaagtgaggcacctgaggtaaacaaagtacttgcctgcagtgcaaaatttaagggggcaccataaaactcagtaatcaagataaacaatattttaatgcagcatttaaaagataagattcatgtagaaaatccataattaataaaatatcaagattttaaagaaagacagcatcagtaacagtggcatgctaagccatattaaagcctgagaaaaaaggaaaactaagtaatactaactttgtcctctttttggaaactcaaaacacatattagtatattaggggctttgaaaagtactgcaaaaagttctattcaactctttagtactacatatcccaaatgcatttaaccacacatttttgcaggcaaaatctttagaatatttttcaggacaagctaatatattttactattttttgactgataaagaaaccaaggcattgagagtcagcaagatctttctagttaactaggaataaataaatgaaaaatgttgtgagagtatcagttcttttcttgtataaataagtgtggtataatgaatagcttttaacctttaattattttttacaaaccttaggtaactataattacaaattaattgagaactgtctataaatatgattgcataaattgtaaggaattgtgttaaatctgtgctgacttcaaggtaaaaaacaatacccttcactgtatgggaaatgagcatctaaaaaactgaccttgctgccaacaggagttataagatctggacaaaatacaaaaacatctacacgagactctggagactgaacaaaagcaagcagtttttggaggagagctaaagctacagcaaggaacaccatggaacacaatgagttttcacttcatgtggctttcctctgaaggtaataactagaagacgaatcaataagaagaatctgaacaacaggaaaaaagtgaacagagcctcactgatctatggaacaacttcaaaagatctagcatatgtggaaatgtagtcaataaaggaaaggagaaaaataataggacagtaaacatatttcaagaaatcatagccaaaaatttccgaaatctggttaatgacttaaatttacagattaaaccaattccatgaatctcaaacaggataaatttgaaagaatcatacttaggcacatcgtggtcaaacagctgaaaaccaaagatagagagaaaattatgacatcaccccaagaaaatgacccactatattcaacactatttgaataatcatggcttctcatcagaaacaaaggaagcatacagtaaaataatatctttaaagcattagtagaaaaaacaaacctattaactaagaatttcatgttctgcaaaaatgtcttttaagaatgaagctgatataaagatattttcaaataatgaaaaactaagggtattcattgccaccagacttgtaccacaagaaatgttatactgagttttgtaggctgaagggaaatgataccacaggaaaattcagaaaagaataaacataacgatatttataaaagactatttcttctctcaatttatttataatacagacgactgtttagagacaaacttttagcattgccttatagaatttacaatgtatatatatctaatacatatagtaaccataatatagagaatggtagaggcataaatgaatagacctaaataattgcaaggattatatattttaaataaagtggtataagactaactttaaattactaactctaagttaacttaccctatgaaaggctaaccatagtacatcaactagaaagattacaccaagaaatattgctaaaaatctaatacagaacattaaaattgaatggtaaaatacatatataatgcaaaagaaggcagaaagagaatagcaaaagaaaaatgggcaaagagaacaaccaaataaataataaattggtaggactaaatccaatcatgtcagtaatttcattaaatgctaatgtactaagcatgccaaagattatcagaatggattattttaaaggcaagattaaatttatgttgtctacaagaaacatgttttaaatatgaagacatagactaaatataaagatggacagtaaatagaagaaaaaagaaataccatgtaaatagcttaagaagattaaaattgatatattaaaatcagataaaacagactatcagataaagagtaaaaattacagtattatcaaagataaagagagcccttcataatgataacattatctattggggcctttttagctcaagtaattggtaagatttaataatcaaaaatgtgtatacacataataatagagcttcaaaatacaagaagtgaaaattgatacaactaaggcaaaataaacaataaaaaaattatagtaggaaaatttaacacccttctctcaggaattgatagaacaactagacaaaaaaaatcaacaaaatgtgatatctcattgtacttttgatttgcaattttctggtgattagtggtgttcagtatcttttcagatattttttggccacttttatgtcttctttggaaaaatgtttaagtcctttgtccattatttaatggggttatttgttcttttgctattgagttatatgagttccttatatattttggatattaactccttattagataaatagcttgtaattattttcttccattatgtcagttgtcttttcattttgccaagtccaaaaaatcattgccgagatggaaacagaaaaacaacagagaaaaatcaatgaaacaaaaagctggtcttagaagagatcaataaaattgatgaccctgtagcaagattgaccaagggagaaaaaaagaaaacacagacatcaaaagaaaaataggaggatataacagacaattctatgtccaaaaatttgataatttacataattatttcaatgtcttgaaagatataaactaccagaactcactgaagaagaaataaataactcagataatactatatttattttaaattggatttgcaattaaaaaccttccaaaaaagaaaactacaggcctagattgtttcactggtgaattctacaaaacatttaaggaagaaataatattaattgtataccatctctttaagaaaacaggagagagacaacttcttaactaattttatgtggccagcattaccttaatactcaaactagacaaagacattactagaaaacaaaactatagaccaatatccctcatgaacataaatgcaaaaattctcaaaaaaaattaagaaatcaaatccagcaataactacatataataatatatcataaccaataggggtttatacaaggtttggttcaatattccaaaatcaatcaatgtaagtcacaatattaacagactaaagaagaaaaaccatatgattatgtcaatagatacacaaaaatatttggtaaaattcaacatctgtttatcataaaaaaaaaaaactttcaggaatctaaaaaaataaggagacttccatactgatagatggcatatcacacacacacacacacacatacacacaacatacaacaaacaacaactatagctattaacgttgaaaagctaagtgcttttctcctaaccttagaaacaaggtaatgatgccccctatcaccactcctattcaatattttacaaaaactccagccaatgtaacaagattttttttaaaagatgattgaaaataaataaaactccctctgaaacattatttttcctctaaaacattccaaaaatcaattttcaaaaggttcatagaactaataagtgagtttgtcagggttgcaggatacacaatcaaggtacaaagatcaattgcatttctataggctagcacagaattccaaaaatatagagttcaaaatttacaaaacagtcccaattacaataacatacaaaaaatgaactagttaggtgtcaatcctacaaaatatgtatagaatttgtatgcagaaaactacaacacattgataaaagaaaacaagatctaaataaatggagagacatatgatgttcatggaatggaagatttaatcttgataagatgccaattctccccagattgagcaatagttacaatgcaatacaaatcaaaatctcaaagatctatttcatagataataaggagctaaatctaaaacttacatggaaagacaaaggaattaatacagccagaacagttttgaaaaagaaaaagttggaccacccacactacttaatatcaaaactcgtaagtttaaagttatcaatatattgtggtattcgtaaaaaatatacacatacagatcagtcatataaaataaaaaatgcagaaatagattctacaaatatagtcaacagatttttggcaaatgtgcaaaagcaaaccaatacagaagagttcctcttttcaacaaatgatgttgaagcaattgggtagtcatcaggaaaaatacaagaacagaaagttaacctcaatctgtatcttacatgttacacaaacattaactcaaaatgcgccatagaataaaattaaaaagtgtatctataaagcatctaaaagaaaacaaataagaaaatctttataaccttgagttaagcaaagagttatttagctataacaccagacgtatgatccataaaagaaataaattaataaattagactccatttaaattaaaattttttacctgttaaaaacactcttacacgaatgaaaagacaaggcacaggctggtagaaaatattttcaatagatacatttgactgaacacttgtattcaaaatatgtaaatagctctcaaaactcaacagtagattcagctcagtggctcaggcccttaatctcagcagtttgggaggttgagatgggaggatctcttgagcccagtttaagaccaggctgggcaacatagtgagacccttgtctctacaaaaatggttaaaattagccaggtgtggtggtgaacacctgtagtcccagctactcaagaggctgaggtgagaggatttcttgagcccaggagattgaggttgcagtaatccatgattgtgccactgcactccaacctgagaccctgtcaaaacaaacaaacaaaaaatctcagcaataagaaaacgacacaatttttttaaatgaggaaagatctagacacttcactaatgaggaaatatggatggcaaataagcatacgagaagatgcccaacatcattacacattaaggaaatgcaaatttaagacaaaaaattactactacatacctattagggttgctaaagaaaaaggcaatatcaagtgcttgtgaatatgcagaacaattggaactctcatacattgttgactgaaatggaaaattatgcaggtactttggaaaaactggttggcagtttcttagaaacatatgcatacctaatccagcaatctcacttctatgtgtttacccaagaaatttatttatttatccatgaaatgtatgtttgctaaaaatctatacacaaatattcatagaagctttatttataattgtcaaaaactagaaacaactcaagtatccgtcaacatgtgaaagaataaataaaatgtggtacactttgagatacttaatgcagtattacttagaaaaacagggaataaactactgatacaatcaattacatgaattaatcttataatttttacagtgagtgaaggaatccacatataatagagtgcatacttaagattccatttaggtaaaatgcaaactaatacaagagggagttgaaaagtttgtgaacagaattgaatgaaaagataaaatagaaaatgtgaactttatttctcaacataagttccatcaaagtcatgacacatttttttgtgatggtatcagacatttagttcatccctaaagaactgaaagtcctgggaatttaaacaatgtcaatactgtgttttgttttgttttaacactgttagctgaagaaaaatgggtatcctttacagacttttttaagattaggaaacaaaaagaagtcaggagccaaatcaggactgtaagcctaacaatttcccatcaaaactcttgcaaaattgtccttgttggatgagaagaatgagcaagagcattgtcatgatgaaggactctctggtgaagctttcctgggtgtccttctgccaaagctttggctaactttctcaaaacattttcataatgagcagatgttaccattatctgaccctccggaaagtcagcaagcaaaacaccttgagcatcccccaaaaaaccattaccatgacctttgctcttgactggtccaattttgttttgactggaccatttccacctgttggctgccattatgttgcttgtcctttgtctttaggatcatattggtaaagccatgttttatctcctgttataattcttcaaagaaatgcttcaggatcttgatcccattgtttaaaatgtccattgaaagctctgctcttggccccagcttatgtgggcatctttcagtcagaatatgtaagctgaaccaattgagatgtctatggtgttagctattgttcatgctgttaatcatcggtcctcttctattagagtggaacaagattcttttttccctgacaaattgatgtgatggtctgctactgcaggcttcatcttcaatatcatcttgtcccttcttaaaatgagttacccatttgtaactgtggatttctttggggcattgcctccttaaacattttgtgaagcatcaatgatttcacccttcttccacccaagcttcagcatcaagtggatgttcgttcttgcttcaattttaggagaattcatgttgctgtgatagggggtctttcaaacccatgtctttcttatctttcttagtgcctcaaactagatcctgttcagatatgttataactacctggtacaagtttattttggcacaaaaaatattttaaatccattataggttttccataatatgcattttctgtgaattatttgaagactccacatatatactgaagaaaagaaaatcagtggttgtctacaaccatgggtgaaggggagaatggactgtggtatgaagaagtttttaaagttaaggaaatatcctgtatcttgattgtagtggttgtgacatgggtgtatacaagtgtcaaactcattgtattgtatacttgaaatagatgcagtttattgtaaataaataacttcttatcaaatagattaaagaaatttctaatatcatttttctctcttatgatgtttttctttctcctaaaagtaaatgaaacagaaaatttttcctgcctaatgaagtgatttgcataatgaagtcactgatatatgacccttctagagtttctgaccagccattatagtttcatctgttttcccccacctgctcccttgaatgtgaataaagtgtttgagcattgaccccacttctgtaggcactgtccatccccctaccacaaagagccagctctccccagagatgcttccttgtgtcgcccaggtgattgttcaccacacttgactcctagaatagctgtggcccagaatttggaagttagtgctccaggagatagagttttcctttgatttgaactaaacttcttgagtcctgcatttttttactgactcatattcagatgttactggctctgccttggagcttactgcaactgaattattaatgcctcagaaaattctacacagacctggattgattcccataaaccacatgaactacaggccaggttggcccaggcaaactggtgaaccaggaattatacattcaatgcctggcacttagagttataaatctagaaggagccttagagagcccaagtccaaactcaggcctctgttcaacctgagcttccccagcaagtcatcctccaggctctctggaacactccagtgatgaggagttcacaatcagatgtgttgtcttctttgcagttaattaaatatctctcctctgaagtttactccttgttaccttcctggcctccccagtctctggggtgcccagagttcaaacctcaatcccacttgctcatgttcccatctgtgcacctaagcagtccctactaccagagggcaccccaagtgccactcagccccttccctctgcagccttctcccctgcttctgtttcctcaccttgttctctgccctgggacaagggatcaaccaaaccatttaatccctgccaagacgcatttaacttagagcaatttcaggtcacctggtgctttaacttacgtaaaagtctctgtctcccaaaaagagtgccagggtaggaacttttgaccccacgggtggctagaaaggaagacatttgtgtcataggactcttttagacttctttgaatcaaactgcaagaagaggtagaaagttagcttttacaagatataagccaacaacactgtcctcagtgtttaatgtgcataagaagcatctggcccactcccttaattaagatccatgggcaatcccctctgtattagtctgttctcacattgctataaagaactacctgagactgggtaatttatgaggaaaagaggtttaattgactcacagttccacaggcttaacaggaagcatgcctgggaagcctcaggaaacttacaattatagtggaaggtgaaagggaagcaagcacgtcttaccatggtgaagcaagagagagtgaaggggaacgtgccacaagccttcaaacaaccagatctcatgagaactcactcactatcatgagaacagcaagggggaaatccacccccatgatccaatcacctcccaccaggcccctttcctgatgtgtggggattacaatttgacatgagatttgggtggggacatagagccaaaccacatcaccctctatgggagttcctcaagaaaatgacacttgtaatgagacggtttgtcacaagatgtttcctaatgtagtggaattctgtgtagaccttaaatataaagctgaaaatgcaacataatcataggacaggttgaatttaggcaccagaatgagagttgaaatgtggaactgtgcttgtttgtgtgtgtgtgtttgtgtgtgtgtgtgtgtgtttaaagggttagtgtattactattttttttttttttttttttgagatagagtcttgttctgtcacccaggctggagtgcagtggtgcgatctcggctcactgcaagccccgcctcccgggttcacaccattctcctgccttagcctcgccagtagctgggactacaggggcccgctaccatgcccggctaattttttgtatttctttagtagagacggggtttcaccatgttagccaggatggtcttgatctcctgacctcgtgatccgcccttctcggcctcccaaagtgctgggattacaggcatgagccaccgtgcccagccaggttagtgtattacttatgaccgagcagcccagcctgaaggcctggccacacttgacaagtggccaacctatgccaaaaagaaggagccaaatgaccgtctgtccaggactgcctgaggcatcaggacatgcacctcatccagtggccactgccaatcttccaccacacctgccaggacctgcctggacactctgctctatgcttgactggatgataccaggcccagcccccttagagatccatacactgatgcaaacaccaccaccttctttatcatgagcaggagtcatgtattaattacctagaatggcaagatctagcctttaaaatcccattcagcttgccatcctttcttttattcctcccaggtctcaggatgatgggaagcagcagtaaagtttgtacatgttttagccatgtttaggagtccttttctctccaagtacccccacatttagagaaaggaaaatttgcttctagctcttcccatagtataaatatttactaagctctcattttatgccaggcacccatgcaaatactgatgacacagcagaggacaaaacacacaagtccttgccttcgggggcttatagtctagtggggaaagacagagaatgaacacataaactaggaactgtcttgtgtattagacggtgtaagtgctttgaaaaccattatagggataaggcagaaagtgtaccaagggtaggagtggggcactatgttgaacaggatgggcaggaaagacctttcttacaacgcggtatttgagcaggcacctgaaggaagtgagaggtgagccacgtgagtgtctgaaagaagagcgttctaggcagaggagtgagcatgtgcaaagatcctagggctgagggggttttgaggatcttccaggaagtcagcatggtagtggacagtgggccacatggagagcaacaggagataaagtcagagaggtaatggagcccagattctgtagagctttgtaggccactgcaaagacttactcttttgctctgggtgagatgggagcccaaatactgttttgaagatgatgcgaaaaggtttacaagtacttataaaagtatcactctgactgcttgctgtgttgagaatacactatggggaagcaagtatggaagtggggagatcagttgagaaacttttatgacaattctgagagatagtggtggctctgaaaaggtgggataaagtgtggtgagaacatgactaaatgtcaaagtagatcagacagaataggagcaccttggcaattctgatggaggggtccagaaacaatactttgaaaagcacaaccatagggcaactgttggagggaaagttcctggctctaggtgctctgctagactgtctggtgttggggactgtcacagtcctgagcctccaagtttgtgcatcagtctcatagagcacagaaacaaaattactgacccaggaagcaggctcacagctccagcccctctctgccctgtggctggacccctttgagtcacaactgaaacaatgggtataaaagtccagccttcatcctagaaggtttaatgtgagtaccacttcgaatgatgtgtatgagtggtcttagataaggtatggacctcaaattagtcccattagctgggcagagggtggatatttcaccataaattcattaatgtggaccttgaagaccttccatctttatgcaaatgttccttcagtgaaatgcaaatatcccctggatacaatcagaccttgtgctgtcaacaactaacatagtttggatattctttaacaggtaacctctttcttctggcatcataccagaaagtatgatgccagaagaaagaggataatcatttgctcacattagatttcacccacttcacagttttccagatgaggactaactgtctgctttctctttatgcatttgcttaagaaatcttctgtctcaatttatctctctctctctctcccctcccccttctgccccaccccacccttatgggactctaattacacatatttttttctctctttgattcagtttggataaatctattgatctgtcttcaagtttactgattttttactgtatccaggctgccaagcccattaattctttatctcttgatgttgtggggagatttgtcagcatttcccttggaatttgtttagtttttgtctttctgctgacattcttcatctgctcatgcatgttcaccaccttttcctctagatccttctatatattaatgataattagtttaatgtccctatctgatagttctaatatctggaccacttctttgtctcattctgttgactgctttatctcgtcacagtggattatctttttgttttttgccttgttttatgtatgtgtatgtgtgttcatactttttattcaacgccaaacataaaggaacagtagagactgaggtaaatagtatttatacccagaattaagcttgccttttctaccagatcataagttgggggctgggggaacaggctagatttggggtttgttttactgaattaacttgtaatgcatcacactcctcagattctttccacgatgagctgctgctgccttgtgcttactgtgaggcctggagggccagaggggctattccttgtttcttctctactctcagctctcagcatgcctgtgccacatgcgtggttctctctgtgtgctccccagcagtagagaccaactcatcccggtttgcggggaacttttgcagtttaagcatggaaagtcctgtgtcccaggaaacccctcagtctggggcagaactgggtgcttggtcaactgagtatctgaggctcccagggattctaaactcatgctaggccccactcaactattgataatttgttgaaatttcccttcttttcttctttgctcttgctcactattgggtgtgaggtgtatgctggacttaggatagttcctaggcgcccctactccagcctcagtcttaggtgagtcctaaggggctcggccactatggtgtggaattctcagcattcctgcaccatatcccacactctgcagccaaatgctggactgtgggggagtcttagtcaggagggacccgtagtgatgcagacctcttctttgtagctctgcaggcttctgtccagattgggtttcctctcccctccttgaggacagacagcttctgcatctacccctccatcagcatcagtgtaacattgcctgagactggggccatttcccgatgtccatgcagtagcctgctaatgcttgctccttggaacaaggctcttggtcagagttgctggatttgctgccttctccccacccacccccttagaagaaatagtttttgtttctacccctttctcagtgacagtatagcaggggatggggcagtttcctgaatgccctcttttctggttcttttttgctttatcccctcccctagagtcagtggacctttgcctgtgtcttagagaaggagggtttcgtatccctctcccagaggcttgcaggttttgctttctataacagaaagccctggaagaaggtgggtgatatagtttggctgtgaccccacccgaatctcaacttgaattgtatctttcagaattcccacgtgctgtgtgagggacccgggggaggtaattgaatcatgggggccagtctttcccgtgctattctcgtgatagtgatattctcatttgtctcttgccaccaccatgtaaggaatgcctttcaccccccaccatgattctgaggcctccctagccatatataactgtaagtccaattaaacctctttttgttcccactttcaggtatgtctttatcagcagtgtgaaaatgaactcatacagtaaattagtagcagtagagtggagcattgctgaaaagatacccaaaaatgtggaattggaactgggtaacaggcagaggttggaacagtttggagggctcagaagaagacaggaaaatgtgggaaagtttggaacctcctaaaaacttgttgaatggctttgcccaaaatgctgatagcaatgtggacaataaggtccaggctggggtggtctcagatggagatgagaaacttattgggaactagactaaaggtgactcttgttatgttttagcaaagagactggaggcattttgcccccgtcctagagatttgtggaacttgagaaagatgatttaggatatctggtggaagaaatttctaagcaacaaggcattcaagagatgacttgggtactattaaaggcattcagttttacaaaggatgcagagcacaaaagtttagaaaatttgcagcctgacaatgtgatagaaaagaaaaacccattttctggggagatattcaagccagctgtagaaattttcataaatagcaaggagcctaatgttaatccccaagaccatggggaaaatgtctctaggccacgtcacagaccttcacagcagctcctcccatcacaggcctggaggcccaggaggaaaaagtggcttcaagggctgggcccagggtccctacactgtgtgcagcctagggacttggtgtcctgtgttccagctgctccaaccatggctgaaaggggccaatgtacagctcagaatgtggccttagagggtaaaaactccaagccttggcaccttccatgtgatgttgagcctgcaggtgcacagaagccaagaactgaggtttgggaacctctgcatagatttcagaagatgtatggaaacacctggatgcccaggcaagtttgctgcaggggcagggctcttatggagaacctctgatagggcagtgtggaagggaaatgtggggtcaaagacccacacagagtccctactggggcactgcctagtggagctgtgagaagagggccactgttctccagatcccagaattttagatccaccaacagcttgcaccacgtgcctggaaaagccacagatactcaacaccagctcgtgaagtcagccggaaaggaggctgtaccctgcaaagccacaggggtggagctgcccaagaccatgggaacccacctcttgcatcagcgttacctggatgcgagacctggagtcaacggagatcattttggagctttaaaatttgactgacctgctggattctggacttgcatgggccctgtaacccctttgttttggccaatttctcccattcagaatggctgtatttaccgaatacctgtacccacattgtatctaggaagtaactagctttcttttgattttacaggctcctaggtagaagggacttgctttgtctcaaatgagtatttggactgtggactttgggttaatgctgaaatgaattaacactttgggggactgttgggaaggtatgattggttttgaaatgtgaggacatgagatttggaggggccaggggtgggatgatatggtttggctgtgtccccacctaaatctcaacttgaattgtatctcccagaattcccacatgttgtaggagggacccaggggcaggtaattgaatcatgggggctggtctttcccatgctattctcgtgatagtgaataagtctcacgagatctgatgggtttatcagggatttccgcttttgctttttcctcatttttctctttccacagccatgattctgaggcctccccagccatgtggaactgtaagtccaattaaacctctttttgttcccagtttcaggtatgtctttatcagcagcatgaaaacgaactaatacagtgggcttttgtaactatgcaccaccaaagaagggccctctcagatccccttccctgtccccaacccacctcataagctccaggtggaggtctgggtaaaagacctggcaaccagactaaggtgaccaggtcatcctggtctgcctaggacttttccagtttgagcacagaaagtcctgtgtcccaggaaactcctcatcctggggcagatctggatgcttgttcagccaagtgtctgagtctcccagggattctaatctcatgctaggttccactcagctattgataattcattgaaatttctgttgttttcttctttcccactcttatggccattacctcttcctcccatactccgctgaaagtgaaacggtttgtgtgtttcctctgaaattcagttcttctggttgctctcctatctcagttcattaaaaggctcaaaaagttataatcttatatactatctggttttttctcatttttagagtaggaatggttatctggtggctttctacaccctaagtggaaaaaaaacctcctcatcccctttgcttctaaagaattgagctgcgcattagaatgttgtccttgtggaaagacattataagaagctgcacaaagtgacccctgcatttattgtaaagatgctctcatgaacatagttccccacatcacacagtgtagaaatttatcatgagtctcagtaccggtaatagttgtgtttccctggtcaagttgtttttcttttgtgaatgttgtggatttagcaactggtaatttccttctgtactttggagactcaggacccaatttatgtttagatttagccactgtacatgatcttccaagggcatttttgcattttaactttatctctggctttattttactttttactcctatttctacttcccctcacttacttatctgttcagagcttatcctgttataaaccatcataaagaattattttaatgaaatagtatctgaaaggcaacttgtaacaaatgaaagcactaatacattgacaaaatttaattgattttacggtattgctttctagtcaacactgtaaaaacgcttctctataaggaaggatccttttttggggagtgcgtctggagtaaaggaaaacaaaggccttgaaaaggggaaccctggcagttgcttattcttctggatgctcccatcttcccattggcctcagccgacttggatgctgccacacgctctaagagcaattacttcacctctttctcacaatgtcactactacgcagaactaaaactatctttacgaggtgagcagacagaaatacaattatttatggtgaagcacagccaaatggcttgtgttttttaaaagtcagcttcttcttttatgaaatggagctctaacaagtgtttattctctctgtcagagggaggtcttttcctgggaggataaagaagggaccaggcttgtgcagcctggacacaggaaagggaggaagcccactctgtcagtgggaggcccctctctctcaagggccttccattgccaaccctcccttagaccctcgctcattactcccctccttcctccactttctctgttgtcctcctcctcccagccagcttgccatgtcggaagggatattcgctatccctccaataaagaatctagattgttactgcattgagcaaaaccaaaccctcaacccaaaaagacaggactaaagaaactaacacagcttggtgcatactttaaccttctccagttatttattttattcatccaaatctcaagctaaggttgatggggagaaatgaggcacaatgcaaataacacagaactctttaagatcacaactccatggacttgtacaaagaataaacaaatgtcttacttagaaattaaatccactcgatggcttattaaatcacccaagaactcacattgccacccggctctatgcctctttcatcataggatagtgtagatgctataaaataatcagcatccttctccagaaaaattcactttacatttgccgttaccctccttgttttccctgcatggacctcagctcacagcttattagagaaccaaaaggccaagcgggaaaagaaatgaatcttcatgagcctattccttcatgtgccaagagcttgctcccctgcttcttagtgagattgccatgaggtaaccacaaaaatccaagagagctattatcaaacttcagggttgtaaaaccacggatttatttatttgttcctgaaagggtctaagccgcctaaatagctgtttaattgcgtatttctcattagagctcctttttccttttagaatacagtggagccactgttgttctttatgaaagtaagcattagggataagggggtttatgacctgaaaccttttttccatgctgaacacacatgttgtcttgactacaccaatgagggaaaactctctattctgtcaaataggtttatgaaagggcatgagcctggtgctcccacggagcgagggaagcctcacacacaaacaggcatgggacaataggtgtataaactgaactatgcaacagcacttaagctctggctatttttctcctgcatgagctctgtagaaatccagatggcagccctaaaggctgtgccttaagcagaagaagcatacatctgaccctcaaagggacaaaatgagatggctgctctgaccagctctgtaccagctgtgaggaggccttttaactctgtgggtctcagtgtcactacctataatgtgaagtggtaggaatagctgatgtctgaggtctgcttcagctctttaagtctaaattctgaaaaacaaacaaaactcaacattttcttcaaggttggcaggaaaacgcctcttccgtgaaagcttcagcaagaccaagatagagtatcttgtgagctaggacactgttagattattttagccaaaaaacagtccatggaaacctcaattaactataattttgttgcaccctatttttaaaagtgggaagaaatatgtttagagatgagcacatgttcagacctttactgtatttaatccacatacatatcctagccctaaacaatgacaaactgtcattgaacacaacagccctagaacactgagaatacctgaattatcaagggaaggtttcagctttcatagagttcacgctactctaccctatattcagattaagaagttccacgatcatgctaacttgaaaggtccacgatcaggcaacaggactggggttggacctaattaagtcaaggttggactaaatactattttagaaagcgccctcttgtggcaaaaagtgaaattgccaaatggcggttttgtcctgagactgagtactgccatttattgtatatttatttcatctcaaggaccggcctggatgttttacatggtagtaaaataaaggacttaagcaaggtagttttcaatgtcatggagagaactggaagtcttttatgtcacagagctcaagctacacctgaagatttacttcaccaagtgtgttcattccccctgtgtattcctcagcaccaggagtggcatctaacctcatgacgttttcctgcacctttattgtacttccttgtagttctgaattgtggctgagaggctgtataagtcatacttctttatttccagcacacagcccctaatttcatgaagagagaagagaagaaaggaaacgacactacagacagggtgaatgggaatgagggacaggcgggacagggaagcacaccccaataccttgtgaaaatctccagaagtcccaggatattttaattcaaacaaaactgcttaacatccatgatttaaaggtatttaatgaacaacaaaaacacttatttatatgattgcaatttgcatttttcagtaatctacatcatcctcagacctttcaagtttcctatgtgacttatatagtgagtttctgtgcttagtaccactggtgctcatttgtcaaaacagtttgctaaatattgacaatgcattccgcaaacataggcctgagaagacaaatatttccatgtattccaattacaagcgttcggccccttccttagagagtccatatctcagcactcatgctggggtgaccccttcacaagagtttgcaaactcaaatgcttactagctacgtagttccagttctggtgtggaaatgtgggctctgtatgttcagatcctccaactttttaaatgaaactagaatgctagagttttatgaaggaatctcctgatttttaagtttttgaaactttgtaaaaaaaaaaaaaactatatgtctgagccaaacaaaacaggttttctgcccagacgtgcccctctgtctgcaattttcagtctctgcctgcaggtcctttgagggaggcattcaggctgcccctaggagacaccttcttgaacaggtcctgagaactacaaggaagaagctccaggaaaggaaagttgcttggggcttctgctgtacttcatattgttgtggacatctggtggaggcaagcagcatgtaacctcatcattaattctctttgttttacactactcattatttggatattgccactagtttccaaaaacatgagagtttgcaatgtctattgtaaaactgttctctatcctcttagtagccatccagggtcatgttgttctctactctctcataagccacccaggttcatgcctttttgtttgtggttattaaaacctggccttcaagaatagccataccagttttccggggattgtgaaatcttctggaaaacagaggcactcatcaactaagacactgcacaaatttgaaatgaggtcaatgcatcagtatcttttcagcactatgaggagagggctcctgtattcaaggtctacctaataatttctcatctttcctaattaaccaagaaaaaggaagccatgactggggttttcatttgggagtgggtttgctctgggtctttgtggcttcagagtttaaatttctgctactctgttacatgtataaaatgcatacctttaataaggtctataagtactgccttcaagtcaaaaaattcttgattacagagttgtcctgcattgacagggagtgggtatgaagccacatgtacttggattgcccggtgaaagacataggagaagtttgtactttctcagagcaatagctaagaagcaactgtcgccatttggaaaagtggctttttgaagcttcagttggggatcaggataggggtccctggaagggtaggagtaaactctaagcagacaccactcagaatccccaggccagctggcagaacgccaggagacctactattacatatatacgggactattatatcatgaaaattacagtttcagcagcttgacagttttcatcagcattgtgggagctctgctcctttttaatttggttcctttaaaagatgaatggaataagggctttccgagatttggggtagtcctcaaacatcttgaggtagaacctaaaagacaagaaaggaataattgtaaatataatggagcagtggctgacagctgaggtttgctcttaccaaatctttgttacaagtcaacctacagttattttgggcctgactatttcgatggtcacttatgattcttatttctccttcccacagcctatttcttgtaaatgttgaagcttcttttgctgggaaatgaaaagtaacaggcagagggtagtggtgatggctgtgcaatattatgaatgtacctaatgccactgaattttacaattaaaaacggctaaagtggtaaaatttttgttacgtatatcctaccagaaaaaaaaatgtagtatctagaaggaggtacttgtttggattcagctgggaaatacagggaaccaaagactatgggcaaagagaaccagcaatgttcccaggaaaatatcccttcatgaggcctgggaatgccagcaaattgtcaccatgtatcatgggttgaattttgtctcgtcaaaagatatgttgaagtcctaacccccagtaactgagagggtaatttttttttttctgaaactaggaccattgcagataaaattaagatgaggtcataatggagcagggtgtgcccttaatccaatataactgtgtcctaaaaagaagaggagaagagacaaagagactgagacagagacacacaggagagaaggccatgtgaagacggaggcagagatcagagtgatgcagctataagccacggaacaccaagggttgccggccaccatcagaagctaaaaagaggcaaggaagaattcttccctagagccgtcacgggggcctggccctgcctacgcctcgatttcaaaattctagcctccagaactatgaaaggacaaatctgtgttgttttaagccgcccagtttgtggtaatgtattgcagcagccacaggagacgaatgcatcttataagaagcctgtctgcttaagttgccaggctgtcttcctaactagttgatgctggcggtcctcaaggcataatcaagatgacacactgtattaaagtaccttagtttgaattagggggcaaataataagttacaaaaggtggctggttttcggtactgtgatttgagaagtctggtgggctgcctccgcccgtgctgcctctgatgtgagtgcctggctttgttttatagaagccttcacaaagtcctgttagcctattaaaaactatgccttctggcccttctctgggaggtctgacatcacaggatgaggcctcaatttgggttttgttgttgcagcagctggaaacgtctggtggaattaccatccctcccctaaccaagcacagtagagtccctccttcccagggaccctccaagtgctgagtgatgccttctcttctcccattcccgctctgcctctggtgggcagcagacccagcctgaaatggtaagaactgttatgactcttttatgggctaggaaccctctgccacccctcctcacagagtctaggaggtggtaggaataggtcactagctgttgcttcattcatttcagaactgttgtcctcgaacaattctaatcagaaaaaaaggaactcattcttagttaaatcttcaaaactaggcattgagtcataaccccagggtcctggttccaagaccactcattccctgtttgagtatccatagtctccagtaattataggctttctctttccacaaaagccattttagggaaaggatctgacatttacacttggcaagttaaagcctgataacaacctaatatattacctttcacttccagcaatacttttagttaattcttttgtccccactccaccccaggttagtggattagtgaagctttaggccagaccttcagagggagggttctgaaacacctgcaatccctggcatttcccagcagatagggcagtcctaagattgccccatacatgggatttcttgtcctaccttccccagaatccagggttggccttggttatgatttatagagggtgggtgtcagggaaggaaggcagtaccaaaataaaccctggcattgcagagattccaggggaaataatccttctggagttccagggctctgtgattacctgaactgttagcaccaaatcttgttgccaaaaatagcagccacatagtcaccaagatagtactttttcccagtggttctctagcctgctgtgcctcagaacatctgtggaggccaggcgtgatggctttgcctgtaatcccagccctttgggaggccgaggcaggcagatcacttgaggtcaggagttcaaggacagcctggccaacatggtgaaacttgtctctactaaaaatgcaaaaagttagctgggcatggtggtgggcctgtagtctcagccatttggaaggctgaggtgggagaatcacttgaacctgggaggtgaaggctgcagtgaggcaagatcgccccattgcacttcagcctgggcatcagagtgagactccaactcaaaaataaataaataaataaataaataaataaatatctgtggagctttggaaagtgctggccatggtcccacctctggagcacacttccagaaatgtggtgggaggggatgaaactgaaggtggaaatggaagcggcttcttccgcttcttgaggctttatctaagcatctccaggtaagcctgcctggtgggcacagagcctgggtcagctaacccaagaaggtgcaaggcacttctcgctggacagccttcttcaacaagacaggcacaggaccttcccggccgtcacctcagttgcctctgtttacatggacttatgtttgttcttagaaaaaattttattactgctactctcatccagctaacttccaacttcaatacaagcccagcaagtcagaatatgctaacccagattatagtatcaaccttcccttaaaaaattaaatatcttcggtttctcaatcttcctctgcgggttaaaagcctgtttggagaagaagaaagctacgtgaatgctgccgcttttattgaaaaatttacctatggtggtgaaaagctcgcagcccaaggaaacaaagtgagaaaaatgcaaatgcaagtgctgggagggaccaagtggccagggcatagccgatccattcaatgatctcaccgaggaaattggctccagaaacatacgtaaacaagccacctgcgtgcagaagaatcggaaggtcaatcattgcaactgaatcattttgacattaaacccatctgtgttgttccaaaatacacaaaggcagcaagaacaaatgtggggctggaggctccctccatagtcataggagtttggtggaatcctcttggggagaaggggaaacaaagcaacaacagcctgttgcctggagaacattctggagttgcgaagagtggcctcaactgcttaacgggctctatccaaatctctaacaactgctggaccactagctttgggtaggataagggagaggtgtaggaggtctggtttttgttttgttctgttaaggaaggtttttgggccacctcttacctccccgctcctttcctggacacacacacgttcacattcacagtcccaaaatgtgaaactgcacactacattaaaataataaaaatctgaactcacgggagaaggaatttagattctcttatgggatttgcccctccccacccttctgcaaagcactctcctctgttcatgtttaaagcagagagtaggagctgcaggtatttgtcctgctgtaggctggtgaagtcggcttctagattttaaatgtttcattttctatccaaccaggtatttcttctctcaggactgtatctagaaatcagcatatttctaatgatattaaatatatccacactaaattttattacccacattaaactggggatgtttcaaccgaaacaattttgttctttctacagttacataaaaatactttgttttaaatcattctctattataattcaaaagttggaaactaatcttggcaactggttttcaagtgctttctctgctcttctttatttatctagttatggagtgaatgtttttaaaatcaaagccccttagagttgaatctttcttgaagatgagactgcgtcagtggttcccaacctgtgattccctacgccctgggaggaaccacggatctaaagcaaagggcctataaattttctatgaagacagtaaacggcacatcttaacctcctaaattatttttgtttgatgtagatactgttaggatattaacaacattcaaattcatttgaatctgttactgaattcatagtaactttgtcattaatttcttaatcaatgactattaatgtgcactaacatcatgtcataattgaggaaattttttgatgtaaataaagggttgtatttacatcaaaaacggtggaagccaaggacctacacaaatacccatctaaacctactgaaggatgacttggactgatttgctcccatctgcgtatatttgtcaatctcataccctggtttctttggagcagttaggattacaaacatgctcacctttatctccaaaaatgcacttgtgcttgtaaggcctcccatcctaagttttgattaagtaaatatagttctctacacctttaaaagtatatatgaatggcaggaaatacgcaagttctagccttaactgctcacaagataagtctagatcaattggaggggacacatttattggccaagcattcagcatcatttgcaacctagaaaggatcagccctctgtacatgacaaccttacctactgcaatgagggtgtaggtagccgattccaaccctactcaaatctcccactctctcccaccttccgggtattgcggtctcgcaccttcctgagggctctggtagctctctggagcttctgggttcagattagaaatgcagaggtactgtgatgggactgggtttgcaggggaagtcaagagcaagctgagaggtattgtatcattcgtgccctcactgtcccctctccatctgctaccatagcatcatccctgggacaggctccagggaagagtgagagtctgggggcaggggagacattaccttgtggaatcctgtagctgatttctccaggcttcctgagctggcgcaatatatagtcactatgaatgtttattcccattcccaaaataaataagaagacaccttgacaaagaagagagaaaggagaaattttttttaaatgtgtccagattgtggtgcttttttcacaaactaagctaaaatgaaaggaggggcatttaatttctaaatctaagaatggtcctaagacgtggcagaaagtggggagggcaatgagtcctggtcctgaatggggagcactgggtgtgctgtttcctagacttgggctgaaagtacacagtggcaccactgatggagacagattagaaaagagaggagagcaggaggtagcaccattgtccagtatttaaatagataaacaaacaaatgcatggatcataatagtaagcctttagctcattcacaaacagtcaaatcgaggtttcatatctcaacagctgattccagccccttttcttttgccatcccccactacagaggttgcactgagaaagggggtcacatgagctagttccaccaataagatgtaaagtgaagtcttggttgggggacttccttggaaatcgtttgcttttctgataaaaggtgcaggcaagaccggtgcccctacttcgtctttcttcctgtcttgattgccagatgtaatgccttgagctacagtcaacatcttgcaaccatgaagtgatgaataagaggaccacaggtaaacatgctaagaataggggagacacaaagtgcctgagttattaatggtgtcagtaagcaaccacaggaatgcagaagccacctacttcgacacttgttatgtaagaactatgaattctgaattattcccgtcactattatatggttttctgaacgcattcctgactgaaacacccactctcatgaaataacgtgagctagtttggaggcgtggccactaacaaactgacttccatcactgccagttcacacacacacacacacacacacacacacacacacacattctgacattaaaagtagcatactacacacactgttcacatttttatttatcttacttagccacatatcctggaggtgtctccacatgcactatccactggtacagaaagggccctgttctgaggtgaggacagccaggatcagggatgctagatcctgcatcccaaaaggcattattacagcccagaaacactcaccgtcccacaaagaggcccaacccaacctgtcagcaaagcactttggtgcttttcaaaataggcaaaaagcaagaacagtttagttgaaacaatcaagtctattctcaccttatttgatttgatataaaacaaggattttccaccttgcctagtcaaaagatcattagcctggaagaaagggtatctggggcaggggatggtaggggagcggggagggaagggggacagcacacacagcagtgtcttcaaccattttagatagggtggtcagggaaagtccctttgaggaggtgcaaattggtagggaactaaataaagtgaggaaccaacccccatgaatacatgggggcaaagccttctaggccaggcttgtccaacccacagcctgtgggccacatgcagcccaggacagttttggatgtggcctgacacaaattcgtacactttcttaaaacattgttttaagaaacaatgtttctttcagcttatcagctatcattggtgttagtgaattatatgtgtagcccaaggcaattcttctttttccaatgtggtccagggaagccaaaagactggacacccctgtactaggcagagggaacagtcctatacaaaaacactggggctggacaagcttgacagcttgtggcacagcaggaaggccactggcactggagcacagaaaaggaggtgcagggagccaggaaaagaggttgggaaattgaaaagaccaagaatatttaggatttaaaggcagtgggaaggaatttgtattttattttgagagtaaaggaaatctactggagagttttgcgatgggaaatggcatgatatgtgtttaaacaatctctctggctaccatatagagaaaagatcagggtagaggtgagggaggggaagatgggatcattacgaggtcattgcagtagggagaggccatggcgatgtagattgtgggaagggttgttagctgggaagtaggtgagaagtgggcagattcacttacccaagctaaaccgtatgtctgtgtaccacccatcagggtattcagcacagtaaatcagatagtagccttgaaggactccatttccagtgcagaaggcagtgcctctgagaatgagtatagctggataaggcctccctcgattgagcagtgagtacacaaatgtcctgggacacacagggaggaaaggttaggattcactgttaaaaaagaacatggtctcatccccacctctttcttaagctcacaccagaaggtacaaaaaccaggctctgccatttcgccttaacccaatacaaattatcttctccaggaggatgtatatcacaggccaaaataattacatacctgaaaagtacaaccactaagaaataatcaacaacatgtaatatataaataatttatgtaataaataatgaataacatgtaccatgcaaagtggaattatcatgacagaacaacaattttaaataagtacaataaatatccttaaagaaatgtttccttcaaggcagaaaaaaatacttgaaaaagaactaaataaaaataatttatcaaaaattataaagcctattagtgatagagtaagagcaaaatctaggtcttctgataatcctagttttctacattaaacctttctaattactcttgaattggcattttcaaaaagatgtactgtcactgtatgtgaatgagtgatagactcaaaaaagagaatccatagttaagtaagcttgggatctataacatcagacaagacctaatatttactcattgtggggtttcttcaagccatggcatactaaggatatgatgactctccgagaaggaacccctagtttggcacattcatcacagacttggagctccactccagaaaacactttcctaaacagggcagataatcctatacacacaattggatcttgaagctttgaaaactgatatttgattctgtaaattttatattcatttttctttctttgtctcttacacaaaaacacacacacatatgcatgcacacacacatgtacaaatgcacacgcacatgctcatgctagacaaccacacacatctccagagcattcatctgatcttttgcagacaagaaagagcagacaagatctgcagatttcacagataatcacagttgcattttggataggaacacccatccttcaaagtctgggaggtttgtcttagatttccttctcaaaaacaggaagtctaagaaatgccctgggcttcatgtcagggatgtgagtcaccattttttttacctggatcatatgtgagtgttgcctcctaaaattgctgtgaggatgaaattatctaatttgatgcttcctatgaagaagcacattttaaattatggagtgactggcaaaagtatgcagacaggtgttgcattatgtgtgagtcaattttttttttttttttgagatagagtctcattctgttgcccaggctggagtgcagtggcacgatctcggctcactgcaacctccacctccagggttcaagcaattctcctgcctcagcctcccaagcagctgggactacaggcacctgccaccatgcccagctaatttttgtatttttagtagagacagagtttcaccatattggccaggctggtctggaactcttgacctcgtgatccacctgcttcagcctcccaaagtgctgggattacaggcatgagccaccgcgcccagctgagccaaattttataaacataaaacatcaaggtggtattgaagacctgcactttcccccttggcaacagcagttccacatctttcctctcttggcttgaatatggacaattctgttggaacagggaggctgctcaagtgttctcaggatgctgaaacttctcacctctaccatctgctctcctggccagttaatggactatgaggatctttaattatttgtattaaaaagctgaaggggaaagaaaggttagtttcctgtgctgtctccctagaaactaaatgctgtctgctgtctccctctccccttcacacctggactcaggtctactatgtcgtctgcagaatgcctcccaccccacccaatcacaacagtgcctacaattcatgtcagtaaataattaccttctctgtttctcacctccttcaaaacacaaatacacacaacaagagaaaggaaattgagtctctaataccagagtgtgcataagtgaattagattcatgagttttacttccttccccagagggaaaaagaacagagtgaagatgtagtgggagagcaagggctccgtggttaaaaaggtcaggctcgaaggatttcactatttcataactctgtgatcttggacaaactccttcatctgtaaactgaggttaattattaaccttattggattatgaggctggactcattggactactgttttatgagaatcattggattcctacagaaattaaataagatgatgcaggaaaaagtaactgatacaggattgttgctatttgtttctccttgcattcacactccaggaaagctttgggagcctgaaggtgacttcttagaaggaaaggatcctgaaaggctacagaaaggtattttttaaaaagttgtatttttgtaatacttgcagtagaagtatgtattaatcagggcaggctcactactgtaacaaacaactacaaagtatcaaaagatcaacataataaaagctcatttcttgctcatgccacagtaagatgctattcaagcttctgctccacagccattcaggacccaggcccttccaaggaatcttctgcatctatccagcaggcaaaggaagagagaggacaaggaggattgtgtagaagattttcttaatgaccatgcttcaggctggaagtggcataaattccaccctcattcttttggccccacccaactgcaagggaggctgggaaatgcagctgattgggtttcccagcaggaaaaagaaggaggtttggtgaacacatggtacagacagaagactttggagaactagatgtcccggagaacaaataaagttcatctaatctgaataactttgctattggaaagctggaaatagttcaaagcttgtttcactgtagaaaaagacaaagacaatgacagaagcgggagagagtctattagcccaagaggctggcaattggtgctgtagagttgtaggtgagtttccccttcagatcccatgctccacctatggtctgagactcagtttccctggtttgggaccacatcactttaattacctcctacacctctaatgtaaattttcattcttttatgtttgttcttatagagagactgataagtactctgtaaatataaagtttttttatcattgctaagtaaatattcatttggggggattcattggaaagggttaactgaaattgcaaatccaaattaaaccaaagaaaagaagctttaaaattacacatcttgcatagaccaactcatatttaactaagtcttcttcaaatataaatgctattgctaagattatcaagccaattgaagacttttcactatatgaaattttagactcattgtcaatcaaaataaattcaaactctatagataaatacaaagtttccatgtatatatttaactgttctgtatagtaattacacctttcttgaccctgtaaccttgttcatctactactccattttcctgctttcctttatagcaactccagagagttgcttatgctcaccatctctgtcttctcctccacttctttcctccttccccctcctcccatggaaacaaatcttggtggggccaccagagaccatcacattcccaaacccaagaatcaatttacaactctcttcttatttgacaaattaatcactccctctttctggaaacactttctttactcaacttccagcacaccacactctcttggttcttctgcttcactgatctgttctcattttcctttgctggtttctcctcatcctcctgacctctaaatatgagagtgcccccagaactcaggactctttttcttctttatttacagtctctgtctatgtgatcacatctagacatatcattaaatatcattcatataatctgaatgtgttccccaaaatttgtgtgctggaaatttaatccccaatgcaacggtgctgaaaggtggggccttttaggaggtgtttaggtcatgagggctctgccaacatgaatggattaatgctgctataaataggacttgagggagtggatttgttcattcttgccctttcaccttctgccttcctccacgtgagaatacaccaagaaggagtccatcagatgctggcaccttggccttgtacatcccagcctctagaaccgtgtgaaatagatttctgctctttgtaaattacccagtctcaggtattcagttatagcagcgcaaaacagacaaaagcaattatctataggacagcaagtcccaaattgatatctccagacaggatatctgcagtccttaaactcagactcctgtgggcaacctcctactatgcccctagtttaatggatatttcaattttaacacagtcaaacccaaacctctgactccccattcttccccagacttgcacttccctcggtcttccccatctcagtaaatgccaagtttattcttccaattgcttaagccaaagatcttagaccatctttgatctctctctctctctcattctctcacaccccacataaaatctgttagcaatttctgtcatctttatctgcaaaatgttttcagaatctggccacatctcactaactccattattccatctgagtttaatctctcattaaacctctcccgggtatttgtaaaagcctcctcatttgaccaccacatttactccaccgcaatctattctccatatagcagaccaataaagctgtaaactggatcatattacttctctctgaaaacctccttcatgactaaatgaaagcccaaattcttgactgccttcaagaccctagacaatctgattccccaactacatctctgctctcttctaccacttttgtctttgtccatctcactgcagccactctgctcaaatgttagcttccctgaccaccttatgtaaaataaataacctccaatgcctccagcactcactagcctcataaatctactttactttttccagtagcattttttactaacatattctactttctgtgtttattgtccacctcttcccacaagaatgtatgcaccataaagagagaaatgttatctattttgttcatcactatatctgcaatgccttgaacagtgcctgggacacagcaggcctggaatgaattttgaatgaaagagagtctatcatgtgctataagtggcacacatcatacgcatgcagagcttcaaattttatctcactgtatatgcatcataacttttacttccaggggggtgtgaagtggagatgcttttccacattcctcctgctacatataattgagtctctggacgttatttaaaaagcaaacatgagaagattctaaaagttggagagaacaaggcatatgggctagaaaccttaggatttgaagaaaaacaaagcagtgtgttcctggattttcattttgcctcatatattccagatttagagccattgaagttggcaaccataaaatggaaccatcacagatcaaaaaggccaaacaaaatcttactttctctagccaaggaatgagaaaaagggaaaaaccagaaagacaaaaacttttagaatatagttgctttgttataacaaacaccacagaaaaactggctcactctcaccccactagcaaagtctgatggaagtgcagaagcctgtgcttcccccttaccaagctgttataggcactctaaccccttgccaggctgtgtcagaaaaggctgggtagggagtcaggaattcctactgggaagtaacaagctcatcccacttctccacagtgttagtagagacaacatggggagccaggatttcttaactccacatcctcctgctggcctgggtagtatcagagaagccctagtggagagttggaatattcaccgtttcccagtgacaacaaggccaccttccctcctccactgcattccatggtgtcagtggaaaccagttgggaggtgaaaggaaacattcccaactctctcagccaaacagatatcagtggaggactaacagggagccaaaaaccccaccgccacacaaaagtaacaaggagcctccacgttcaggtttcaaaatgtccaggtttcaatggaaaataacttaacataccaagaaccaagaaggtctcaaactgaatttttaaaaatcaatagatgccaatacactgtattatgtaattctaaatgtacgaagggggaatatttaagacaattatattataaatgaggaagaaaaatgtggcattacgggaagtatgttttctacactcaaactggtaaaatgacaacacttttaaactatgaaaaattgtgcatatataatttaacaccaagagcaatcactaaaaaactatatgaaagagattctcttgtatcaaatctaaggataaatcaaaatgaaattctaaaaaatattcatataatcaccaggaagcataaaaaaagaaaacacatagaaaaacagagagaacaaatataaaacaaaaaataaaatttcagacttaagcattaatacattaataaatccaataaatgtaaataattcaaatcattgtaaagacaagagttggctaaagacaattaaaagacaagagttgactaaaacataaccaaacaataggttgatgacaagaaactcactcaaatataacaatatagtcagggtaaacgtaataaaaaggggaaaagatgtatcataaaaacattaaataaaggaaggtagggagagcatcctggggaactgcaagagtaagaaacacgaggaatctgtctccctgcttaggcaataattgcactgacagagtatgtctgatataactgttttggaaatctggagtctattgaaggcttgcaactttcagggaaacatttggatggtacattgcagttaactttgatttcagctcagtcaattttagctcttagcacagtaacagctacccatttcctatccccacccctgtggcaggcagctgtgcatgtattcctgcagcagcttgttgcacacagcttgaaggagccaggataagcaaaatggaccctgtcctctaagtatcaggcatatgtgcttagattgatgattgctgcttctgatcagagaggtacagacaaagaggtggtgggtctttgctgttacaccttattccattgttgcaaacccctccccatccagctgaaatgacttccagagatttaaagggctggcaccctatttccactccctttttcatttttctctttttctccttttgggagccagatattaaagataaggacattcacaaacaactgaatatatggggaaaattagaaagttaacacacatgaccacagaaagatgcaagctcagagaataccagtaaagaccttatgtttacacctcaggctgatccttggcacagagacagactaaagcaatttttataaacaaacaaaacaataacaaaaagcaaacaaccttgaggaaaaagaagagtctgcatcccagagttaccacatcattaaattgaaatacccaactttcaacaaaaaaaaacacaaggcattcaaaaaaaaaagaggaaaatatagcccattcaaaggaaaaaatagtcaacagaaactgcccctgaaaaagacctaacagcagatctactcaaaaaagactttaaaataactgtcttgaagatactttaagaactggaaaagagggagggtggagcaagatggccaaactgaaccttgcaacaatgatccccactgcagaagacctatttaacaaactatctacacacacaaaaagcaccttcgtaaaaacaggaaatcagataagcaatcacagtacttggtttaacttcatattgctgaaagaggcactgaagaaggtaagaaacatagtcttgaattgccaatgatgcccctcccctatccctctggcagcagccacatagcacagagagacaatctgtaaacctgggaaatggacagtacagtgattgtggggctctgcattgaactcaatgctgccctgtcacaatggaaagtaaagctgggctaaactcagccaatgccaacacacacagggagcatatagatcagccctagccagaggggaatcacccatcccagcagctggaacttgaattttcacaagacttaccaccatgggcttaagtgctctgggatcctaaacaaacttgagaggcagtctaggccacaaggactgcaattcctgggcaagtcctagtgctgtgctgggcttagaatcagtgaacattggacaccagccagggtggctaaggaagtgcttgtgccattcctcctgcaacaccaggcaacacaactcacaacaaaatttactcccaccatctgcttaaggaaaggaaagcaaagagtaaagagggctttattttgtatcttagaagtgattattatgcactgcatgcctgtatcaaaatacttcatgtacctcatgaatatatacacctactacatacccaaaaaataaaatttaaaagcctaggcaacatagtgagacctcatctctattaaatttatttatttatttatccaggcatggatggcacacacctgtagtcctagctactcaagaggctaaggcagaaggatcacctgagccaaggaggttgaggctgcagtgagctaactgaaccatgtactacagcctggatgacagagcaagaacctgtctcaataaataaataaataaataaactaaaagtacatgtggatgaagtcaagaaaacaatgtataaaacaaaatgacaatacaaataaagattttgaaaacctaaaaagaacatctggagctaaaaattaaaataacagaaatgaaaaatttactagagggctttgagggaagatatgagtaggcaaaagaaagaatcagagaactcaaagataaggcaatggaaatcatcaagtctgaggaacaaaaagaaaacaaaattgaagaaaagtgagcagagcccaagagacctgtgagacatcatcaaggggctcaacatacacaccatgagagtcccagacaacgcagagagaaagaaaggagtagagagaatataggaagaaataatggtgaaaaattcttcgaatttgaaaaaagacatgaacataaacctccaagaagctcaattaactccaagtaagatgaattcatagatacccacatggatatacattataatcaaactttccaaatacaaaggcaaagagaaaatcttgaaagcagcaagagatagaaatgacttgtcacataccaagcatctgcaataagattatctacaaatttctcatcagaaattttagagataagaaggcagtgggctgatattttcaaagtgctaatataaaaaagaaactgtcaagcaagaacaccatatctggcaaaacttgaaagtgaggagaaacttaagacattcccagctaaacaaaagctgagatagcttgctgccctacatctgccatgccaaaactgttaaagggagtcctgcaggttaaaatgaaagcatactatacagtaactagaatctatataaagaaataaaaatatcaatgaaggtaaacatagggacattgtaaaaggtggtattattataacaatgtttcttgactttgtgttctgtacatgatttaagaaactaatactttttaaaaaaacaattattagtctaaaagttaatatcactgaaactatggtttctaactcattattttttccatagaagagtttaatgcatttcaaggaattatttatgttttgtgacacatgatatataaagttgcaattttgtgacattaacaatcaaagagagatgggaaggagctgttaaagtagcagagttttatgttattgaaattaagctggtttataagttagaatgttataaatttaggatgttaaatgtaattccaatggtaactgcaaagaaaatagctatagaatatatacaaaagggaacaagggatggggagttatacggtgtagagaaaacaaatataaaaattatagaagtaagttcctccttttcagtaatagcatacatgaaaatgtattaaactcttcaaccaatatagatgagcagaatggattttttaaatgatccaaatatatgctgtttacaagagactcactttagctccaaagacacaaataaattgaaagtggaaaaatggaagatgacatttcatgcaaatggaaatgaaaaaagagcagatgtggctgtactaacaggcaaaatggactttaaatttttttaaaaatggttacaagaaacaaaaaaagtacttaatcttaaaaggttcagtatagcaagaagatagaagacttatgagcatttatgcacctaatgacagaccatcaaaataaagacagtgaaaacttcagaattgaagtaaaaagagacatttctgcaataatagttaaagaattcaataccacactgtcaaaaatgaatagaataactagacagaatataagtaatgacatagagaacttaacacaataaaccaactagatctaacagaaatatacaaaacaactctgaccacaacaggataaagttagaaatcaataacaaaagtaaaactgaaaaatctataaatatgtgaaaattttaaaacacattctttaaaaaaattaatggatcaaaagagaaagcaaagggaaattagaaaatacttagatatgaatgaaaatgacaacataacatactaaaacttataggatgcagcaaaagtagtgttaagcatgaaatttgaaactacaaatgattatattaaaaacaaggaagatcctatatcagccaactaactttacaacttaaggagctagaaaagaataagctaaacccaaagctaccagaaagaaggaataattaagattagaacaaagatcaaagaaatcaagaatagaaaaacaagggtaaaaccaataaaaccaaatgctccttctttaaaaattttttttaaaaatgacaattctacacttagattgactaagaaaaatagagacaagactcatattactaaaatcataaataaaagtgggacattactacttattctatgggaataaaaagaattctaagacagcactatgaacaattgtaccccccaaaattggataacctacatgaaaaagttcagattcctagaaatactaaacctaccaagactaaatcataaagaaatagaaaatttgaaaagacttataactagtaaggagattacataagtaatcaaaaatcaaaatctcataatgaaaaaaaaagcccttgatctaacagtttcactggtgaattctaccaatagtagaaatacttctaccatttaaagaactaaccccaattgttctcaaacttttccaaaaaaaaaatgaagaggagagagaacacttcctgacttattctatgaggtcagcattattctgacaccaaatttagacacagacactatcagaaaagaaaattatagagcagtattttttatgaacatcaaagcaattttttaaacaaaatactagcaaaccaaattgagcagcatataaacagaattatagaccatgatcaagtaagacttaattctagaatgcaaggataactcaaaatacaaaaatcaatcagtgtaatccatagcgttgtcaggcttacagagggtaaaacacgtggtcaattaattgatgcagaaaaagcatttgaaaaattcactctttcatgataaaagcaccaaccaaactgagaatggaaggcaacttcctcaacataataaaatctgtatattaaaaacccaaagcaaacgtactcaaagatgaaagctcttcttttaaaatcaggaacaaggcaagggtgctgcttttgccatttctattcaacatagtgctagaagttttagccagagcaattagacaaggaaaagaaatcaaagagatacaaatcagaaagaaggaactaaaattatctctgcttacagatgatatgatcatgtgtctagaacactctaacgattccacatacatttttaaaaaactgttaatagacgaattaagcaaagtagcaggatagagagttgacacacaaaaatcagttgcatttctatacacttacaataaacaatatgaaaaggatattaagaaagtctcatttacgatagcatcaaaacaaataaaatacttaggaattaactaaagacgtgaaagacttgtacagtaaaaaattataaaatattgctgaaagaagttaaagaagaatataaaaatggaaaacattccatgttcatggactggaagacaatatttttcaaatgtccatactaccaacacaatctattgactcaatacaatccctatcaaaattccaatgacttttttttttcagaaataaaacagtccactataaaattcaaatggaatctcaagagacatcaaaaagccaaaacaattttgaaaaaggagaaaaaatattgaggactctcatttcctgatttcaaatcttactaaaaactatagtaatcaaagcaatatagtactggcatatagacaataaaagcctataaagacaaagacatgcaatctacctagatgcccattaatgaaggactggataaagaaaatatgttacatatacatcttggaatactatgcagccataaaaaattaaattatgtcctttgcagcaacatggatgcagctagaggcctttattcaaagccaaattaatacaggaacagaaaacaaatactgcacattctcacttataagtaggagctaaacgttgagtacacttgaacataaagacaaaaagaacagacactggggactaataaagtgggaagggtgagagggggctaagggctgaaaaactaccagttggctacaatgctcactaactgggtgatgggatcgtttgtacaccacacctcagcaacgtgcaacttacccatgtaataaacctgtacatgtgccccctcaactttattttaaagttaaaaaaaataaaaataggctgggcacagtggctcacacctgtaatcccagcactttgggaggccaaggagggcggatcacctgaggtcaggagttcaagaccagcctgaccaacatggagaaaccctgtctctactaaaaatacaaaaaagtagccaggcgtggtggcacatgcctgtaatcccagttactaggcagggtgaagcaggagaatcacttgaacctgggaggcagaggttgtggtgagccgagatggcgccattgcactccagcctgggcaacaagagtgaaactccatctcaaaaaataaaataaaataaaataaaaataaaaataaaagtctaaaaggcacatagacctgtgaaatacaatacagagtccagaaataaaccctaatatatatggttaaatgatttttgacaagggtgctatgatggttgattttggatgtgaccttgactggattaagggatacccagcagctgataaagtacaaattattctcaatgcttcagtagaaactgatcatgtctcccttctgtaaaagggaaacccaagtgatttagcatttgattctaatgattgggctaccccaggtgcatctgtgagggtgtttctggaagagattggcatttgagttggtggactgggtggagaagatctgccctcaatgtgggtgatggaataaaaatgtaaaggaaggacaaattcttgatctgtcttctggagccagaattcatttcttctacccttttcaagtgtacatgggctatataccatggtagattatatttgtatcatgagacaagttcagattctctggtctttggactttaggacttgcaccagcaattctccaggctctcgggctttcagtcctggactgagaattgcaacattggcttccatggttctaaggccatcagacttggaatgagccatgctaccagcttccctggcactccagcttacagatgatctgttatgaaacttctcagcctacataatcaagtgagtcaattcccctaataaatcctttcttatatctcccccgcctctctctacatagatagatagatagatagatatagatatagttagatagatacagatatagatatagatatatatctcctattaattctgtctctctgaagaaccctgattaaaacagatgtcaagaccattcagtggagaaagaacagtcttttcagcaaatcatgctgggaaaactggatatccatatgcaaaataaataaattagacccttacctaatactatatagaaaaattaactcaaaattgatcaaagacctaaatataagaaaaaaactataaaattcttaaaagaaaacgtaggacaaaagcatcatgatactgtatctggcagtgatttcttggatatgctaccaaaggtgcagccaacaaaagaaaaaacagaaaaactgaacttcatggagaatctttaaaattgtacatcaaagacactattaatagaggaaaagggcaacccacagaatgggagaaagtatttgcaaagcatatatctgacaagagattgacatccagaatatataaagcactcctaaaactcaacaacaacaacaaaaaattgggcaatggactcgaataaatgtctctccaaagaagctatgcaaatggcccataagaacctgaaaagatgctcaacatcactaatctttagggaaattaaaatcaaaactacaatgagataccatctccaaccaaaccaattaagatggctactattaagaaaacaaaaaataacaagtcttggcaaagatgtggagaaactggaacacttgtgccctgatagtagaaatgtaaaatggtgcagccactgaggaaaacaatatggtggttactcaaaaattaaaaatagaattactacatgacatagcaaatccacttctgaatatgcatctaaaagaactgaaaacagggtcttgaagcaatatttgtgcacacattgatagaagcattattcacaatagctaaaatgtggaagcaatcaagtgtctattgacagatgaataaatggataagcaaaatgtggtatatacttacaatggctttataaaggaagaaaattctaacacgtactataacatggatgaaccctgagagcaatgtgctaagtgaaataagccagtcacgagaagacaaattccatatgattcacttatatgaggtagttaaaagtagtcaaaagcatagaaacagaaagtagaatggtggcttccaggggctggaagtagagggaattattattattattattattattattattattattattattattatttaagatggagtctcactctgtcacccaggctggggtgcagtggcacaatctcggctcactgcaaccgccgcctcccaggtccaagcgattctgctgcctcagcctcccaagtagctgggactataggtgcccaccaccacaccagtctaattttttgtatttttagtagagagggggtttcaccatattagccaggttggtctcaatctcctgacctcatggtccacccgcctcggccttccaaagtgctgggattacaggcgtgaattattttcttactaggtacagagtttcagttttataagataaagagtcatgagctaaatagaagtgatggttgcacaacattaagaatgtatttaatgtcactcaaaatggttcaaatgttaagttctattatgtgtattttgccacaataaaaaataataaatgttaaaagtaaaaatgaagtagagttactatactaatttcagataaagtagactctgagcaaacaaaattaccagaattagagagggacattatataatgataaaatggtaagttaaccatgaagatatagaagtcttaaatgtgtgtgcatcaagcaacaaactggcaaattatatgaagcaaaaccagaaggaaaaataaatagatctactattaaagctgaaggcttcaacacccatttctaaaccatagataggaaaaccagaaaactaggaaaactagaaaatcagcaaagatataaaagaactcaacaacactatcaaccaacaagatataatcaacatttctattacacagcatcaaacaacagcagaatgcacattcttttcaagtggccatgggatatataccacagtagaccacatcttatatcataaggcaatcctagacaaatttttaaaaagtaaaattatacagaatatgtcacctggccataatagaaacaaaacagagatcagacataataataacaagaaattctccaaaacttagaaactaaacagcatacttttaaataattcatggatcaaagaccaagtctcaaggtaaattaaaaactacattcatctttgttttttgtaaccactttaaaaaataaactaggtaatttatttcttaattttcaatatccccaaaatagagatatccttgtccagatggctttactgcagaattctaccaaacatttaagtaattaataccaattctatgtgatttcttccaaaaaatagaagagcttctcaattcattttataaagcttgtattaccctaatccaaaaaaaaaaaaggtaaagataaaccagataaagacagtgcaaagaagaacaagaaaaaaattacaggctactagtccccataaaaattgatgcaaaaacatttaacaaacagaattcagtaattctatatgaagaattatatagcatgaccaactggagatatagttcagagatgcaaggctggtatacttaaaaatcaattgatgtaacccaccttattaacagaataaaaaaagagaaataacctgattatatcaatcatttaaaaattttataaaattcaatttctattaatgataaaattataagaaatagaaaataagagtagaggaaaacttcctgaacttgataaggaacatctacagctaacattatatcgaacagtcagtaactgaatgttttttccttaagatcgtgaacaagacaaagatgtgcattcttactacttttattcaacaacatgctagaaattctagtcagtgtaataaggtaagaaaaaaatttatagattagaaaaggagaaataaaagtcatttgcaaatcacatgattatctatgtgggaaatccccaaaaatatacagaaaaaaacccctcacttctaatagattatttcagtgaatttgcaggatacaaaatacacaattaaatttctatttgctactaatgaatatgttgacactgaaatttaaaaatatcaccaaatttacgatgaccccaaaactaccatattttgttgtaaatctaaccaaacatgtacaagggttctatagtgaaaactccaaagaattaataaaataaattaaagatcttttttaaatggtgacatatcatgttcatggattaaaagactcaatatagcaaggatattaattctcccccaaaatgacaatgcaatttttattacatcccagaaatttttaaaaaatatagacaagataattctaaaatgtacacatgctcctcaacttacaatgagattacttcctgataaaaccattgttttcaatatatcagaagttgaaaatacatttaatacaactaacccaccaaatataacagcttagcttgctttaccttaaacttactcagaacacttacattaacctacagttcagcaaaataatctagcacaaagcctattttataataaagtgttgaatatgtcatgcaatttatttaatagtactgtgctaaaagtgaaaaacagaacagtgtgtggacactgcgtatggtttctactgaatgcattttgctttcataccttcatatagtcaaaaagttttaagtagaactgttgaatttcagggaccatctgtatacagaaagtcaaaggaacttggataactaaaataattggaaaaaaaaagtcagagttcctatcagatttaagacttattaaatagttatagtgatcaagactatgtgctgttggtggtgggatagacacatagattgacaaaacagaatataggacccagaaatagagccataaaaataggctcaaatgattttttataaaggtggagaagcaaatcaatggaggaaaattagcctttcagtcaggagacaatcctcaggatctaggactaagcaaagaggtctcagacttgacaccaaaagcaccatccataaaaggaaaactcataaattggacttcatcaaaatttaaaacttttgcacttcaggggagtgatatcagcaagatggtagaataaatggtccctcacctcattattccacagaaacatcaagctaacaataatatacacaccaaaatacctttgtgagactacttttatgagaagttgcaagcatcctagatgagcacaaaatgaagaacagccacattaaaacaaataagaagagcaattacactttacctatgtcagcctctccccaaagccagcacagatcaatgccaagggatattgcctcaacccacacttctctcattaggaggggaagagaagtggaatgaccatccggcatcccagtctttcagtgaattgtccaaggggacagtttctatcttgccccacatggaacattgacagtactgccatagtttggacccctcggtcaactcaacaatggaaagggcgtaaacagattgttacaggatagcagagctctgtgagattgggagaaattgcagaacctaggcatctcaccaagaagagagaagagtggtgtatacctccaacctcttggtctttcactacattgccagaagaatgccagtccctgttccactcaacccaaaggactgacagaatgagtatagtttgatgggggcagctaagaacaaaggaaaagaggcagtcagcttgctatgtgagaggctctccaaatctctagctgggctaattgatgaaggtctttaactgtcaacaccactccataaaaactgggagagatggctgttttttcaaatgtgcagacaccaaggcaaagctacaagaaacataaaaaatctgggaaacatgacacaatcaaaggaaaaaacaaatctccagcaaccaaccctacagaagtggagatcttttagatgcctgacaaagaattcaaaatacttatcataaagaagtttaatgagttacgagaggaaacatatgaacaaccaaaggaaatcaggaaagtaatacctgaaaaatgagattctcagtaaaaagataggaactatacaaagaaccagacaaattctgcatctgaggaatctaattgctgaaagaaaaacaatcaatagaaagcttcaaacacagaattgatcaaacctaagaaggaatcagtgaactcaaagacaagttatttgaaattatccagttataagtgcaaaagaaaaaagaatgaaagagttaagaaagcctaagggacatatgagacatcatcaagacaacaaatatatacattatggtgattctagaaggaaagcagagagacaataggaaaaaaagcttatttaaagaaacaatcactgaaaatttctcaaattccagaagggaaatgaacactcagattcatgaagctgaaagcaccacaaataggatgaatataaagaaatctagaccaagacacattacaatcaaattgccaaaatacagagacaaagaaattgtcgaaggcagcaagagaaatgtgacacgtcacatacaaggacacatcaataataccatcagatttctcataagaagccttacacaccagaagacagtggaatgacacattcaaacagctgaagaaaaataaaactgccaattcaactgaggtaggtccacaccacagaatactactctgcaatctaaaggaaggatatttgaggagtttggacaaaggaatagtaagcatagtaagcaatatataaatattagctgtctgtggtcctttgctgagatttcccttactggatgtctgaactaaaattgatttcaatggtctaatataactccaacaaggtatattagctccctgtggctgctgtaacaggggttacggaggtttggacaaaggaatagtaaagggtttggacaaaggagtagtaagttttgataagagaactgaaaagacttgaaggctagtcaatttctaggaaaaataaaccttttggagcatgatagtgcacatctgtgagggatcttgagataattcctatccgtaggaattccttcctacccataacaggaaggataattctactacttgttatcttccaagtgatagctaaaacctacggccaacagtcttttagaagtagaataccacataacatctgttgtgagtacacttgcaaccgatctaggagaaagggaaaaagacccgggtatctttctcaaaaaatgtcttacctcaatctagaagattgaagataaacactaactccctgaaaaaaaagttgagcctgtcactcacacatgcttaatatgaatgctttaatcaattcataatcagatggtacttgccctacctaatagcaactccactgtgaaaatgagcactgtgattacggagatgaagaggtcatttttgcaactggagacaacttggagaaagaagagctctaggtatagtttttcaatatggacattccctgtggtattggatatccccagggaacactgcctcaggagaagcagttagagaagaatcctaaaacaaatgtggaaaaacagaaagatcattttgcctgaagtctcttgatggttgccttgcatgttgagaatgatcacacaaggtgactttggctcatcccttctaaggtggcggataaggagtagtcagtgatgcaggatttcattttgcttttccctggcatcaatttgcatttttcacctggctctctggaaacatgttgctttaaacattccttccattactcaaatggtagaaatttccaacatgtttcaggaccatgaaaaatatgtagggacagatggttcttcggtatcaatcagactgtgttcatgtaggcttattctgtttatgtgccctggtgatgaatagtcctggtaagatggcctctatcctgatcgtgtgtgtgtgtgtgtgtgtgtgtgtgtgtgtgtgtgtgtgtgtatgtgtgtgtgtgtgttaccgccaggccagtgaagaatttaaagcttacagacataaggtaatgtgcccaaggccacacagctacaaagaggcagcagagatggaatttaaatgtgggtcttctgcttcaaaataactcacttatttccaagtggaaagggaaattgtgaccaacacacacaactagaaaaaaaaaaaaatcccacatgtcgctcaagaaaacccaggtttggatttcagacattttagtccaaggacctaattgcatctacagtggtcatctgttgtatttgccacccaatattcattctcccttctgatggtacctacactggttcttcagaacagacctacctctttccacagtcttagcccatgtattaagaggggtcatcctttccaaggtcctcggccaaacagaacaggaaggggtgctatcacattggttgtctcaggcatgagtattcaacccaacaaatctcggtaaggttttgcttacatttttttctaggactgtttattttcatgtgccttgaacctgagagaatgtaggtcttagtacagttgtcttgccagtacctaaggacggcctttctgaaactacagccagcaaaagtagagccaagagctggagaaagaaaccaggtcctgatagtatctttggaaccactgcattgatctggacctgaagctggaattttccagttatgagagttaataaattagggtttcacttaagcctattcagattgatttttctatcacttgggacagaaaacatgtcctgataatgtagcatcaccctgttctcttttaaaataagcatcagacttttccaaatgtaaacccaaaattagccaggcgtagtcatgcagcctgtagtcctagctactcgggagggtaaagtaggaagatctcttgagcccaggagttcaaggccagcctgggcaatatagtgagatcatatctctaaaatgaaaacaaaataaaaaacagccatcattggtgagattttgggtacacattttagcacaaaatagagtttctcaaaaaattgttctctttggagcaaaaccaccaggaagcctttccttgttggagctctctatatgccaaaggccattgggccaaccagtcctctgagcacttgctccacttctgtgggtccttgccgagaagtaactacaaacattgacaataaatagtcacttgtttgtatatttggatggtacctgttgtgtaaataatggttttagacatattagagaatgggatgtgcaggccaaatgtgaagtccactaaacacagaatgagtcagtgatgcctcccatccaagcttactttttattatgccatcttgtatagtgggttgaatggtagaccccaaaaagatatctctatgtcctaattccaggaacttatgaatagtaccttatgatagcaaaaaaaagtgaatattatcttctatggcaaaagatgtgactacattaagaatccttagaaaagcagctcatcctgtataatccacgtgggccctagatgcaaacacatggattcttatacaagaaataccaggagaagaaagacacacaggggaggaagtaatatgaagatgaagcaaagagagatgtgaccgcaagccaaggaatgccaatagccaccagaagctgaaagaggaaaggagcaggttttccttcagagcttccagaagaagtgtggccctgctgacaccttgatttcagacttctggccttcagaatagtaagagtaagatttattttgttttaagccactttgtggtaatttattacagcagtcacaggaagttaatataacttgttggagtaatattacactattgagatcaatttcagttcagacatccagtaagggaaatgtcagcaaaggacgacagacaactaatatttatatattgcgtactatgttccaggcaatgttctaagtactttgcccatattaactcatttaatctttataacaaccctaggagataggtattattattcccattctacagagaaggaaactgaggcacaatgagactaagttagcccaaggtcacataattatgagatatcagagttgggattcaagtccaggtggcactgattccagagtatctgctctctagcattttcctctattgcagtcacatgtccacatcagaggattacacccctggttgcacaagcaagtcacctgagtggctttagaaatattaaaggggaggaatcaccctgaagacaaattaatcacaaccttgggcacatgactttgagcagaagtcattttaagggttcccccagatgattttaatgtgcagccaggttaaaagccaatgacataatgactcccagtggcagatttaactaatttgtttaaatttgcattgcttagatgttttggcttttccaagtctatgtctacacagagaaattggaccgcaaaacctagtaaaaggcttaactcagtaaaaccataattttttttcttgtaatggtctggttgatcaatttttttcaagggttataccataggaaaaactcaatgtgaaggctacctagtaatcaacaatttgttttaattttggtattgagggagtaggaatggagaatgataaaatggagatggagtaggaatggatgagaaatggaaattcatccacatccccagaacccattctggccaatttctggtcaactctggtctggatatctgtgacctagaaatctggagtacagcaccctgggggctcttgattttgcaattgccctagagcaaactcaaaggctgttattgcttctaaaataggaccagcttccttatattctcctgaacaaaaaggaactcatcacgaaagcagcctcctagagcctgctccaggcctgacacaggtcagtgctgcctgaccttctgatgcagagtctcaggttgaacaatcctctgataggactagtgctatctcactttcagatcggcactatgaagcactttagaaactaggctctatagagtccaaatctgccgataataccaatggattttaaagctttttagccatggagcattttcttcaatggaaatcttacttggaaggccagcaaacataaaaatcggggggagtttctatacttgaagagaatctgaacccctacttggccagacctttagtgtaggaaaatacaaagagcctttgccaagagagggccaagtaaacatcaagaactactctgacattgtaaataattctagtaacaggagacctatttggttatcccttgacctgtcctgctctgaagtatgcctggtgttaatttcctaggctgccataacaaattgccgcagactggatagcttaaaacaatagaaatgtattgtctcacagttctgaaggctggaagtatgagatcaaggggttggcagagccatgcttcctctaaaggctctagggaggagtccttacttgagtgttcctagcttctggcaatggtttgcagtccttggcattccttggcttgtcattgcatcactccaatgtttgcctctgtcttcagatggccatcgtcccggtgtttccctgtgtttgtgtctgtttctctcctcttatgaggacactagtcacattggatttagaacctacctaatccagtatgacctcatcttaactacagtcatgcatcataatgacatttcggtcaatggcacactaaatatatgattatagtctcattagattattgtaccccaattgcctacagtagtcagtacagtaacaggctgtagaggtttgcagcctaggaacaataggatatagtatatggtctaggtgtgtaggagactgtaccgtctaggtttgtgtgagtacactctatgatgtttggacaatgatgaaatcacctaacaacacattactcagaatgtaaccacaatgttaagcaatgcatgacatcgcaaagaccctatttccaaataaggtcatagtctaaggttctagagaaaacatgaatttaggagagacatgcttcaacccagtacacagctccagttctacctctgaacttgtttatatggctgggccccaccaccatggccagatctcccccagcagctaccctgacaccagatgccagtggcgtggctttttggcttccatcagcttttattgcctaaatgtttgagctcccagactgtgtgatctccaggctgcaaatgttgccactttggcttgacctgctgccgagtccagaatggaatgttttcttgcaagttttcctttccagatttcaatcaagaaaaaaatgagtaagctgtctgcagaaaatcctatggtatctttccagacaaagaaagacttccctggaaaccactctttgacttattcaatatccctttttttcttaattatggctaatataaattgttttttagaaagtgtttcttactaagtgataccatattttaactgagccgtgctagaacctactattctttaaaaaacctctttattctttgaatattttaacatacatttgcataaaacaaaaaatgttgatttgtatttcaattttattttagttcttcccaaattgctcttaaaaaaagaaaaagaaaagatttaaggccataaacatagatgtataaagtgctgtaagatggcctaaaatttaaagaaaaaggaggcaaatgaaaataaagatatgaaagtaaggtgaattgactaatgaagttagcacctagactctatgtcaacaagtcaggtatgtttgtctactgaataggacaaaaatttatctatgaactttctagtaaccaatacatcagtgcccataagtaaaagtaaacaaacccacacacacacacacacacacacacacacacacacacacacacaaagccatacaacacaccccaaccaccaaagtaagctctgaagagtaatctcaaagtttcctccaggaactgttaagatttaagtagaacagagtggtttgtgaaggtacctatagaactttatcatcactttttaaaaaattgtacgttcccacaatatctatgtacataccaatccccccccccccctttttttaaaaagtcattgaccattgggaatcaagtattttaggtaggtgagaggacaggtgctccaggatattctaagacatgtgattaatatatatgaactctttctgaagtcctggccctatatcctctaatgggacattccattcttctttccatcttgttgctactgctatttagaaatctgtcaagcaagcattgcctttgatgtaagcatctagatagactgtggggatggggagagagttctgaccaatgaacctgaaaccaagatgtctaagggtgtctagagctcccatctcctgtccatcttcccctgattttccctctatatctcacagttccctgaacttctccagcactttttgtatttctgtttaactatcctaggcaatagcactgattcttaataagcccttgttatttgagaaccggcacctgatttcaggctcctggcctttgggtgtaacttgttcaatgctttgcccaatataggcccctgaaaaacctgcatcagcactctctcttctttttccaccttttttgctgcgcttcctttctcctttcccagcttttcttctttttactgttgtatctcctttaaacctctttccccatttccttttactcccctttccctgttccttttatgcacctgctctttttcttcatacccttgccctctgagtagctgctctataatcctatagccctacagagcttgtcacacattacttcaagactttgttactcggtgtctccacaagaatggcctgcaggaagacaagcaaaataaactggataccaagtttaggaagaagatcagaagctagtctcctaagggctgttgcagagaaaggcagcaactcatctagttttttggatgggtgccctccctaaaatattgctcaaagttcccagaatatcattttataaattctagaatcaaaccttctatatacctatcccaaccctagaaaagcaatagagaaatgcctccctggggaaagcaaagtgattccctccacatctaatccctttttctaaaatgaagactcagcacctttccaagagctcaataataatgcaatgagatttgtaaaagagcacacctgactcctctccaagtgtgccctaactggggaaacacacggcctccagtatttacagtgtggattagcccagttttcaggctccaagactctattagcacagcaatattaacctaattactttctctagtaagacaaatattaaggcctcctagacatataatgatattttccccaaagagcaatgactcaagacttcttcccatcttactctgccatgctggaagacagggcagccacatcccattgtcaaccccatgcaaatgttatctggttttaactatctaatggtcctaatctggcagatccatttaaatcatgcaaaatctttgagatgattagcttgtgaatatctaaaatacagcagaaaacctttaagttccctgcttatgtttttaagtatttatggcatgtcctggtaatactgggagaccttggaactgtccactcagtatctttcttcctgcctctacattaaaatagatgttcaatccaaacatctaatgaattaccaaggttttaaaaaactttgaggattccccagaatgatagaaagaataatgatcattggagtgaaacctcccataggcatgctactgaccactggctccattttaaaaaaatttttaataccccagaagatcaaaatcaaagagaatcagatcaacttcatggcctgagtaactaaatcaacttatttgaataactagtttaccgttttctataaattgatcaacttgaggtggattttggcatcatgaaacaacagttgctcagccactcatgctaactgattattacaaaatcaagaaaatacaaatattgacatgggatggttttcagcttgaagtaaaaagctcagcaagcctatgaagagcagctaaggacataacaggcactttcactgttggataaatacatgccatttctctgagctataattttgtctcctttatttctcaatgtttgcaaaaagaaaattgtggttttctaagttcagttgtttagcttcttagtgcagcccaggtttacaggtcttttttttcctttttaaaaaatttttatgtttaatatttgtgggtatatagtgtatatgtttatgtggtacatgagatattttgatacaaggatgcaatgtgtaataatcacattagggtaaaatggggtatccaccacctcaaatattgatccttactgttacaaacaatccaattatactattttagttatctttaaatgagtaataaattattattgactgtagtcagtctgtatcaaatactagaacttattcattcaatctaatcatattaatgtacccattaacaatcccaagtcttctgatgttatttggaagcaaacagctctgtacagttttgcagcaatgaggcctagatattgccataaatttgagaacttttaaaaagtttccacctacatttaaatattgtcctgatacaaagatgggaacaatacacaccagggattccaaaagggaaaaggagggagaggggcaagggttgaaaaactacctattgggtactatgttcaccacttgcgtgatgggatcattagaagctcaaacctcagcatcacacaatatacccatgtaacaaacctgcacatgtaccccctgaattaaatttttaaaacaaataaataaatgtccagggattcagtagccctgatcaaaggcaacattcaaagattgatctacctcagcatatctccctcctacatctacctccattccattgttcatttggaccaaacaaaaaaagaacaaaagcacaatctgaggtttctgcaacataattttccatgtgaaagtttcaaaccaatcattcataaccatctgttggtatctcccactctttatctcctactctatagtcctacagccaccttcccagctgcagctacatggagccacaggactcatgtaaaggaagtcatcattctgctatcccacttagtcttctaagtaaaatacgtcccaaagcattacacgtcaagcctgaagatggaaagtttggggaaaaaaacatgacattgagtacaagtagaggtcactaaaaccaacaaatcaaccagtattgcagattatccaattagcaaagataaatactaaaacccattggagacacttctgcttccagtcaaggaggaataacaggaattggatttatcctccaggctagaaaaaaaaaaggtaagttatatgaaataattatttacaaaacactggatattaggcaatgaaaaacagtgagtggcaagaaaaaaatgactcacaccacctcataactgacccagcttcctggtttgagaaaacttccaggctgaggtacagggaaggggatcccagggagaagctaaaagacttcctgagttgagaaaacaaaattgagatttcaagaaatcaagacatctagaattttcaagacagagtgctgaaaaggacagagacacacggagacctgcagagaattttcctcaagtattagcagagtgttaattcatgcatttgtgtgaggaaagaatcacccaaaagaattaaagggaacagtatccagtgatcacacatggccacaaatagagcctgtacccataagccagatagaaaagctcatataagacattgggtagaatactcaaaaaggctttacctcagaggaaattattaattagccctagcattaacactcttctggaaccactgaacaaatcagatcaaagcctgaaatgatcaaattgtttccaagtaacttaacttcatcccagaacaaagctcaagaatatttatagaaacacaaaaatatccaacacccaatgaggtacaattttctgaccctccaatcaaagattaccaggcatgcaaaaagggaggaaaacactgcttattataggaaaaataattaatcagtcaaaactgacaccgaaatgacacagatattaggttagcaatgatattaaaacagctgttataactgcattccatgtgttcacaaaattaagtagggacatggaagagagaaaaaaagaccgaaatccaaaattctagagatggaaactacaatccctgagataaaaataccagagatgggattagcaacagataagacattgtagaagaaaagattatgaacttgaagaatagcaatagaaattacccaaaagaagcacacagaaaaaaaaaagaatccacaaaaatgaaaagagcatcagtgagttgtaggacagtttaatatacatgtaggtctcatagatattttcctcagcaaaagaaaggagaagtagggagggaatgaagaatagtgtatgaaaatcgtccaattttgatgaaagactcaagctcatggattcaagtttaaggaagcccagaataagaaatataaatacaccaaggaatatagtaacccaacatctcaaatccagtgataacatgaaaatattaaaagtaggcaaagataagaagatacgttaagtacagaggacaaggataagggcaagaacagatttcttgttggaaataatgcaaacaagacgacagtgaaacatctttaaagtaatgaaagaaagcagctgtcaatctggattgctatatcctagaattttctatcttcgaaaacaagaaataaaaacactttcagaaatataaattctgatttcaggtaaaaggaaaaaatgataccacatagaaatataaatcaaccctcaaaaatgaaaagcatcaaatatggcaaccacataagcaaatatataacttttttattatcttatttaaaactgtttaaaagataattgacgatttaaacaaaaataatagtaataagttgaggcttttatagcacatatgtaagtaaaacaacaacaataacataagggcaagagagaagaaatggaagtacattatttcagatttttataccatacttgaagtggtataatatcaccttaaggaagactgataaatttaagatacatgcaataaacctttaagcaaattaacaaaagagttataatgaataaactgacaatataaattgaaataaaataatactaaatccaaaagatggaatataaataggaaataggaacaaataacagagacacaaatggaaacaaatagcaagatgatagacataattcaaactgtataaataatctcattaaatataaacattctaatatcccagttaaaaatcagagattgtcagaatggcaggggcagggggaaagaaaaattgaacagtatgccacctttgagacacacacattaaatctaaagacagaaacagattaaaagtaaaatgttggaataaacatggtagatacatataccatgttaaccctagtaaaaagaaatctgtagtggctaagttaatataagacaaaagtagatttcaaagcaagatattaccaagaataaagaagattgtttcatcacgataaaagcatcaattcatcaagaggacataccagttctgtctctatgcatgtaataatagaccttcaaaatacatgaagcaaaaactgatagagctgtaagaaaaaaaagcaagtctacaattttgatcagatatctcaatactcttctctcaataactggtagaataggtagagagaaaatcatcaggatatagaaatttgaagcacactaacaatcaaaataacctatggacaattttagaacactcctcttcttggcagtatacacattcttttcatgtttacacagaacaattattacgattgatagacccaattctgggccataaaacaagttttaaattcagtaagtttaaaaggatgtatgtcatacaaagtatgctctctatccacagtggaattaaattagaaatgaatacagaacatgtctggaaaattcctaaacatttggaaactaaataacacccttctaaataacccatagatatgagaataaatcaaaggagaaattaaaatacatgaaataaattaaaatggtaacaacatgtcggaatttgtgaggtgccacaaaacaatatgtaggatgaaattcaaagcaataaatgctcatattagaagaaagagaaagtctccatttataaccttggcttccaccttaataaaaatagaaaaaggagagcaaataaaattcaaagtaagcataagaaaaaacataataaagatcaaaacagaaaacaattaaatgtaaaacaaaatcaatagtgaaactcaatgaaataaaaatctagttctgagatgatcaatacaatttctaaagctctagtcaaaaagatctggaaaaaaagtggaaaatataaattaccatgattaaggatgaaagagatgagatcctctcagattcaaaatattaaaaggataatagtttggactttgccaagtgctactttgccaggtaacatgattgcatgttaagggatcatcaacatcttgatacaaaggagaaatagaaagatgacaatttcataagtgggttgtgtcatagcagctcagtgggggagatctcacacacgaagtgtgacttttaaaatccctcagaacagtaactacttatggggtgtcatatctctgctgagatttaattgcatggtcagtttgtaaaatacatcttaaaattttgtaatacagtattatttcttctataaggtataataggagttaaataattaaatactttaataatactaaaaggaaaaaatacaaacctaaattatcagctatttacatcactttatattccaatcatggtcaattttcatttgtacatgtcaacatggattaaatcagagtgtactctttatgtgctactttttaactaaatggctccatatatttatttccatacacagatatagtccatgcaactaatatttttgaaatatatatggtaatttaatcatattgattacaatcaatccccaattgtagagcatttaggtaacttccagtgtttcacagttgtgaatagtaacactataactttgtgtagactgatttcttccttttggattatttcccttgagtagaattcctggccctcctctactcacacctcaaaaaagtgaaacagcttatcagcacttgttgaacatttccagatgaacttcacagaaactttgaacaattctcagtgacacagggccacatatacatataattttttcacaggcctacctagttttcttatttttattgaagtaaattactattcagtcaactgaacctatttaaagggtgcaatttggtgtgtgtgtgtgtgtgtgtgtgtatatatatatatatatctaccagtgcagtttggtagatatatttcatgtcacatgaagccatgtgacataaaaataatgaacacatccatcacaacaaaaggttcttcataccctttgtagttctaccttcttgtccctcttgtgtcctcaggaaaccactgatgtactttgtgtcaccatagattagtttaaatttcatagaattttatataaacataatcataaagcatgtactcctagtttttggcttgtacaaataaagctactacaaacatttgtatacaagtctttgtgtcacgagatccttggggtgtcacttcaccagctggaaacctctgtggccagtagtgccttctgcctgagtattgctcatgcccactgagctcaatctgtccactcagcctggcaggctgcacttggctcatgctacaggcctggatcccacacctgccaagggtgagccaggcacagaatgatgaggggtgtgtgtgtgagtgagcgcagggtccagccactgtgcacagccaggcacactggttgctgggcaaggcaagcagctccagatgacagcataagtgccggctccatgtgaggctatggttggaccagatgtaccccaagtggcttccactgtgggcacccacatctggatgaagggaacatggtggtgcctggaagcttggagatgccaggaaccacaaagccccaaagagggtgtcatagccctggctcagggctcccctagttctgggctccccgaagggtcccagctcttctctccttcttgttgcctgcaatgtgacaagcaggggggcatgtttcagacctgtttgtgttacagctctttcagtccccgcattcagcaggtcctgatttcttgtcccgtgtccgggaacaatgaggtacgcaaacaactggaggatgagcaaggcagagaggagcttcagtgagtgacagagaggctctcgggagacccaaagtgggcagttccttcccacagctggtagtcctgatgtctgcccaagtctggatgagtccagagtttttatagcctcagaaggaagggcgtgctgattggtccatgggccaccatgagcaggttcagaaaaagcaccataaattgtcactctgggccactgactccatccagaattgacagcccagcacccaggcttcaggccatccctggcttgaaggtggggtttcacccgagacctgcccctttccacccaggagcctgtctgcctcctgccaccatccacatgccatccatggtgcccaggctgttagtgccaaggggtgcttgcaagcctgcactaagccaccctcagcccccacttgcccctcctcccatgctcatcagcacccaaagtctggagggggccaaggcggcagggggctggtgtgtcaatgccgccctgagcttgcacatgccaggccgagcaacagcaccttggctcagccacaactttgttccaccccagagcaggtgcctagagtgggaagaggccaaggagcgggagcaggtacttccaagccttcaggggcaggggcgcttcccaggcccctgagagcacagggaagcccgggtccagagccatggctgggtggctgcagctgcgccaaggagcactggccttctgccccaccaacttggtaggggatggggctcatgcctgttcctggccgtgccagctctgtggagtgcgcagccccagccatgcctctaacactgcagccactccagtcaggctgctgctaccaccatttgtatgaacacatgcttttatttttcttagaaaaataaccagaaatgcaatggctacattatatgataggtatatgtttcactttttaagaaactatcaaaccattttccaaagtggttgtcatttaaattcccatcaaaggtatgagagttccagctcttccacatcctcacaaacacttggtatggtcagtattttttatttgagccattctatcagacacatagtgataccccattgtggtttaatttgcatttccctaatcactaataatgagcatcctttcatgttcttgtttgccaatcatacgttttctttggcaaagtatctgttcatataattctcctatttttaaagttaaggtgcaaaggcagttcattggacaaaaagtagtattttcaacaaatggtactaaaacaattgactgtccacatgcaaaaaacaaaaaacaaaaaaaaaaaaacacaacaaaaaaactttgattcaaacttggaaacctactttaaaaattaattcaaaatgtgtcatagacctgaaattaaaacctaaaactacaaatcttgtagaaggaaatataagagaaaatcactgtgaccttagattaggcaaaaattttttagatatcacatcaaaagccaaagaaaaatggaaaaattagacttcatcaaaattaaacatttctgtttttcaaaagacagttaagacaaattacaccagatgtgtaaagaagagctggtaccactcctacttaaactactccaaaaaattgaggaagagggactcctccccaactcattctatgaggccagaatcatcctcataccaaaacctcacagagacacaacagaaaaagaaaacttcaggccaatatccctgatgaacatcagggcaaaaatccctaacaaaacactggcaaacttaatctggtaggacatcaaaaagctaatccaccaggatcaagcaggctttatccctgggatacaaggttgagtcaacatatgcaaatcagtaaatgtgatttacataagcagaactaaaaacaaaaactacatgattatcttaatagattcagaaaaggctttcaatacaactaaacacctcatcatgttaaaaaccctcaacaaatgaggcattaaagaaacataattcaaaataacaagagccatcaatgacaaacccacagctaacatcatactgaataggcaaaagctggaagcattccccttgaaaactagaacaagataaggataccctctctcaccactccttttcaacatagtactggaaatcctggccagagcaatcaggtaagagaaagaaataaaaggcatacaaataggaagagaagaggttaaactattcctgtttgcagatgatgtgattctatacctggaacaccccatagtctcttcccaaaagcttcttggtctgataaacaacttcagtaaagtttcaggatacaaaatcaatgtacaaaaattactagcattcctatacaccaacaacatccaaactgacagccaaatcaagaatgcaatcccattcatgattgcagcaaagagaataaaatacctaggaatacaactaaccagagaggtaaaagatctctacaatgagaatgacaaaacactgctgaaagaaatcagagatgacacaaacagaaaaacattccatgctcatggatagaaagaatcaatattgttaaaatggccatactgccaaagcgatttacagattaaatgctattcctatcaaactactgatgacattcttcacagaattagaaaaaaactattttaaaattcatatggaatcaaaaaagagctgggataaccaggcaatcctaagaaaaaagaacaaagctggaggcaccacattacctgacttcaaactacactacaaggctacagtaaccaaaacagcgtggcactggtacaaaaacagacatatagaccaatggaacaggatagagtgcccagaaacaatgctgcatacctacaaccatctgatatttaatacagttgacaaaagcaagtaacagggaaaggactccctattcaaaatggagctgggataactgactagccatatgcagaaaattggaactggaccactaccttacaccacatacaaaaatcaactcaagatgaattaaagacttaaatgcaaaacctaaaaccataaacaccctagaagaaaacctagaaaatgccattctggacataggatctggcaaagacctcatgacaaagacaccaaaagcaattgcaacgtaaccaaaaattgacaaataggacctaattaaactaaagagcttctgcacaggaaaaaaaactatcaagagagtaaacatgcaacttacagaatgggaaaaaatatctgcaaactgtgcatctgacaaaggtctaatatccagcatctataaggaatttaaactaatttacaagcaaaaaccaaacaattcaattaaaagtgggcaaaggacatcaacagatacttttcaaaacaagatatatgtggccaacaaggatatgaaaaaatgctcggcatcactaatcattagagaaatgcaaatcaaaaccaccataaaatatcatctcacatcaatcagaatagctactattaaaaagtcaaaaataataaatgctggcaaggttatggagaaaagggaacgcctatacactgctaggaggaatttctcaaataatttaaaacagaatcaccattgaactcagcaatcccattattgggtatatccccaaaggaatatatattgttctaccataaagacacatgcatgtgcatgctcattgcagcacgtattcacaacagtcaagacatgaactcaacctaaatatccatcaatggtggactggataaagaaaatgtggcatatatacaccatggaatattatgcagccatgaaaaataatgagatcatgtcctttgcaggccattatcctcagctaactaacatagaaactgaaaaccaactgcatatcctcacttataaatgggagctaaacaccaagtacatatggatactaagagaacaacagcactggggtctacttgagggtggaggatggaaggagggtgatgattgaaaaaatacctatcgggtagtatgcttattactggggtgatgaaataatctgtacaccaaacccctgagacatgtagtttacctgtataacagaactgcatatgttaacttgaacctaaaaataatttttttaaaacaaaagacagttaagagaataaaagagacaagtcacaaactgagagaaaatatttgctaagtttatacctggcaaaatacttctatccagaatacataaacaacttttaaaactcaataataagaaaacaaacaacccaatacactagaacttagatttgtttatcacatgagtaacttttggcaagtaaagggcattgactgacagcatgagacacagagttaagttttaaaagatagaagtaagatcatgtactgctgatacaagagggcaggcagagaggcaagagagaaccagagtctatacatgaaaaaagatcttgggatgtttcgtggttagaaagaaaaaatatcaaaaccaaattaccctgttttcttcacagtaacttctaggatcagccttaacaatatggagcaaatattaaaaaaaagaaattgaaagaggcccagagcctaatttaagacttgggtagtaggactggataatatggcatagttacagaagatgtttggaatctaaaagtagagagatactccaagactgagtatacaaagtataaggcaaatttaagtcacagatcaccaaatgggccccttttcccaacagacatcatgtccccacccagaaatctgggaacaggccattcttcaaggaccaggtcaagtctcccatcttcactcccactcactccatcaatgctctgcactgcaatcacttgtaaaatagcactaataacagggattgcctcaaggacaaaatgagatagccaatgcaaagaacataatataatgcctggaacacccagagcgcaataaatattggtttcccttctctcccttctataaccaaatggaagacaaattgcactgttggccctagttcaggggtttttaaaatttagagctcctatgttgagctgagtctcgttaaaggctcctgggttgagcacagaaacttttaaaacaacttgagtccagactttgatgtccccattgccatacatggcagggagtcaacagcagaacgggaagtaccccaagttgcagaaacaagttgccaggctgtggcaaaattcaataagtagacaacgtttgtattccatctagtaacaaaaaatatttatgctccccctacagctggctgagggcccttcattagagcatcactgcaagcccttccactgtccctcacccattcctcctcaggcaaggaaatgtgaattacctgatgggtcaatctgggagcaggacctgccaaaggatgcgtacagctcagcccttctgctgtcttttcagaacaggtaccactgtgagaggcctgtggttgcccagccatgatcatagctaattatttctgaggtactgtgttataaggcccatataatccaaaaatctaagccacattcccccaaaccagctttaccagtaataaaaggtggtaatatgtctctagttacctaattcctggatctctcagttagttctgaacttgaatggagaagaagggtgccattttgaggccccctcaacacctatccacctatctatctgccccctgtcccatgcacaatcaaacatagacaggcactagggccctctcagatgaatgttcagtggcctggcgggggcccgtgctaaccaggcttctttccccctcagtttacattttcccacctgcctgatattgtcagactgacgttgctgccacccaagtttcacaccagaaagagtgagaagcacacaatgaaggttctttcctgccttcttcctagagggcaagcactaggtattgtactcctatgactcccatgagacctagcatagttctgagcctatagaactctgataaagatcaggagaccaggcttcaagctccactctgccctttcttgccatgtaacttggtacatgtcactttgccagtctgaatccttgaattcccatcgtaattctttattttgtttgttctttttaagtgacattaaattagattttaaatggacaaaaagttggtcctttcttcagtgtggtaaaagtgaagtggtcacgatctccaaagctggtttatatttttggcaaacatagctatatatttttcagatgtgcttatgatgtcattccatttagaatgaaaactccaagactcctactattttcccataaaagttcaaataaaaacttagaacccaagaattctcagaaaacaatatttactgccaagtccccacttacatgtagcagaaattttctaagatatgcccgctgctttgctatagaatttaaccaaattttattatagaattaccagggcactgaatgtaaagccacgccattcatagttttctttagaagggattggtaaactatggcccataggccaaatatggcccactgcttgtttttgtaaataaagctttattggaatacaaccacattcatctgtttacataatgtctgtagctgctttcccgctataacagtaggggtgagttgctgcaatagagatcatgacctggctttttacagaaaaagtttgctgactctcattctaaaaaaatccttcaattaatcttaatttatttaaattatgattcaggaacatccttaacacatgattaagtgatcacaggaatgttgcttttcttgcttgggctttttttttcttaatctctaagaggagagatttgtctattgtttccaaagtagccattaattctcattctgattctcagcagatgagtagtttccttagcaaggtctgattacttctgaatagttgagacatctgcacctctcgtgaaataagagaagcattggcaggggctcatgagaagactcaagttccaactctttgatttccccctaactgacccaaccttttgtgctttgcttctgtaaaatgaagaggctgggcagatgagaactacgtttccttagaacagataattatgatccagtgtgtgaaatgcctcatcgaaagccacactgcctattatgaaagcccaaagaacagcatcacaactggatttagagaaaagaaaagactcagacaaggcttcttggaggaaaggatgcctgacctgaatcttgaaggatgaggagaaattccgctggggaatgaactgactaataaagcaaaaagcaccttattgaagccatcattttatttggctaatcaaaaaaatgtttcagcatctaaacctcaaggaatatctctccgaattcaaacagactctaatgtgtgcattatactctgcttctagatgtatatcatggaaattacattgcccaaaaccttttcacaatgtagtcacttcttctctggaaaaaaaaatgtttctttgtcttgttcattcagttatcaaggtcccatcaaagtcttgaaaaagacatcagccaccacatgcataagtgatgtgactgaccactgtatggaacaccaagacttcttgggaaagtgaagaccaatcagagagtttagacaaggggtcattccacagctgtaatcacagtcaacaagaggtgagatggatggattaaagatttaaacgttagacctaaaaccataaaaaccctagaagaaaacctaggcattaccattcaggacataggcgtgggcaaggacttcatgtccaaaacacgaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaataacaggtgctggagaggatgtggagaaataggaacacttttacactgttggtgggactgtaaactagttcaaccattgtggaagtcagtgtggcgattcctcagggatctagaactagaaataccatttgacccagccatcccaatactgggtatatacccaaaggactataaatcatgctgctataaagacacatgcacacatatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctgggaactgtggtggtctctgtgttggtttttcttatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaacattaaaaaaaaaaaaaaaaaaaagaggtgagataactcttgacttcaaatgcctttggcagtgggattaggcaatgtgcttaggcagcagtcatttccatgtggctaaagaatccaaacagccacaacaatagattctgaagagaggaaagttatctgaattgacctaactatgcaatctcagcaattatgattcccaagtaattgctagctctcctacaattctgtctgtacggttgttgtaagtagagttcattcatgcattcaacaaattctagtgagtaccaactatgtaccagctctttgtatacaatggggatacagccataaaagtgagacaaaaacctttgaccctgtggaatctacattcttgtgtgccatccttgtattgagaaaagtacaatgagttttaacttctatttgatgggacatattgctgctttgaacagtccccaatggacattttgcaaaagagtctgagccaaacctgagccatcctttctccctgtctctccgtcttattctctgtcttagcaacacacagcacgagataaagccaagacagcctgatgcttgttccttaatgcaccctcagtatcaagccaaatgactccttaagcctcgaaacagatatgtatgattatatcaagaccctaaagaatgttcataacctttgaaccacttctggaaatcctaagaaaatagatctaacctttgaaaagaatttagatgcaaaaaatgtacatcacagcttcaatgaacctagcctcaccccaagacaaattaaatgtccaactataaatgaatatataggtaaattattatttttacagtagatgaaataagcagatattaagaaatctgtgataatgttggaaaatactataaaatgttaggtaattaaacagaactaaaaaaccatatattcaacataacaagcatgtgtgaaaatctactaaggaaaaagatttgatagaaattctctaaaacattaatatttaatatacttagatgtaattatgagtattttctacttttgggatttttccatttttcattaggaaaaaatgtttttataatttaaaaaatttttacataataattttaagaataaatatagtttttaaaaagcaagaatgaggtcgcatttatccaacaagtatacaacagtttattatcatacctgaagagcctgagatctggagtctactgcctgggtttgaactctgattcctcgttattgtgtgaccttgggcaaggaagttatttaaccttttcttgctccagttttccacctgcaaaatgggcgtgcctacctaaatgggttggtatgaggatgagtaaattattaactcagagtgtttggcacacagagtgtaacaccctgtaagcactcaaataataacagatcacacactccagtggcttcaaagaaagaattcaaaaaagaggaaagacaaacatcagatcccgatgcctcaggaacaagtagctcaagagttgtacttccagtgggcaattttccctcaggcagaatgaatctccaagtcctttactaatattttaaaatttcctctgaagaaggacaatatgtagatatttgttttatgcataattactcctttgggtttttttttaaatgcaccggtcataatgtattgtgcaaagtgccttttgatttcaaaaacaagcctaaagattacattaatatgattgtcacaaaacactaatcattaagatgaaatgacctcataaaaatattgcttatgttgccaacatacagtagttaatttgaagataaaaataattgttgacaaaaatcacatttctgtcaaatgtctgttcaaaaatcagtgaaataaaaaactaatctcttatctcctgtatccaacatccttctttctgtgcaaattaaaccatctaaatctgagtaaaataaaatctgtgtaaaataaagaatcttgttcacagcaggcttttagtaaatatttgttgaaaggatacagtttagttcttattacttgacaacatttgccttttaaaaagagtgagaattcagttaagattgcataaatattaaatcttgaccaataaagaagattcagaggataagaggaaattaagaaagacagtttgaaatccgtctctgacaccttcttctctcgaaatgaggcatcactttctctttacgagacagattatgccagaggcattctttatcctaatttctaatccaaacttccttgatcttttgaccctaggaatcttctactcaaaataaggcaaaaccttcaaggttttgatttcgtttgataacttttctctgtttatgggctctgttctcttcttgcatagaatatctgcctacttaaaacggctaaaaggtcttaaacctcagagattcacaagctcagatttgcatcttagcgggcaccagctgtattgtcttctttcagtcccataaccttactcagcctcagtttctttgtaaagtggacataataaatatctctcaaaaggttacaacagagttaagtgagaccatagatactaaacgattgggcatggtaggcaatttaacaatgtgttcgttcttccctttccctgtgagactttactgaggctggacagtctttctctgaaccctaacatcccttggtctctttcctgtctttccttcccagagcagaaagcaaagttctcctgaacccggattttttaaatctagaagaacatttgagctgtaagttacccactcacatttcaagtcccagggaaattggaaaggtagatgaattggtggtgtgcttggtcccttttgggaggggcctaagaagcggggaccctcgcttgagtcagtgggatctcactatattctcttccccatctgtgaagtctggatttgggctctacccaccttcctccttagacctgcaaagactaaatcaatgagaacctctgagctgagtttccctcgggagatgccaaacgcgtaagactctcccaagatcccagaactaatctgtccccaccctgcaaggaaaaggtgaaggaagaaagggaagcggggcggggcgcgatatgccacaggtaaccgccgcctgcgcgcagttaaggaacagtcctgtccaataggtctccccaacctgagctttccaggtcgcctcccgcccgcaggacctctttctctcgagcagccagaggatttggagctgctgagagcggatgaggtcctgggggagtgaaggcggcgtctgtgccgcagccgcttgtcaactctctagcgtccaagccccggccccggcccccgccaggtgcgccaggcaggctggcctccgcgttcctcacagcgccccacgctgcctccttggcgttcctcggtgcgcgctctacgctgcgctcctggacgccgggagcagggcagtgcgctgcactgggcgcccgcaagggaaaaacgctacctgtggaagtaatgtaggcagaagaggcccagaagtaccgtcccaggtggcccgaagagggagaggggctgccgggcgaggatccccgcgggcaccgcgaaggaaggcagctcctgcaggaaccaggcggcgcgggctggcaggcgggtagccgccggcttcaggctctccgtgtgcttcccgtagccggaggcttcgcgacgtacaaggccagtgccccaagggcgaccaaagtggcgctgcctgccagcactgggctctgctggcactgaacctgcatcgcgccgtgttcctcgccggtggccgctgccctcccagaagagagcgcggcccccgcaacccctttatggagcgccagacgccacccgtgtccgccccctcggccttggctcccgcccctccatcctgcctcccacctcgccgcgtccagccctggcgcggttcgcagcaatacccctttctcaaggatgcagccgcggtggccggaggagaacgaaggccttcttagttcgcccgccctctccacggctttacattcacctcccgcttaggctgtccttccatgacttgttcctcaactattagcgtctgatgcgcatacttctggaactaagacacgggaagaaaaccccacggggacgattcagctggggtggttcttccgccccaacacacaccctctgtgccgtcggtcaccacgcagtcccaccctcgaacacccaagccaaggtctttccatctcctccggttcctcatgcactttcactccctcacagctcccacccaacataggaccttccttggaccctgaaccatcctggctctctgagcgtctgccagcccttctgctctggggcgccgcgctccttagccactctcagcatcagtgccagctctgccccaccacacgcccccggcaggtaccagtctctcccggccctaattcctcagcggtttctctctgcatccccgcacgcgtccctgagccgcctgcctgggtcagagaggagcgtccgctgagctcgggtgatcatgcacagattggggccagaagtcgagattctgcgcgtcctctcccgccaccccactcccggtcccctagagtggcccagactcaggctaaagtctagggcttctttcctgggatgccctttcccagctcctagagccaatgagccgtggcccatcaggtggtggcctggcgaccccgctgttctctgaactcctgtctagccgtcatacacgcagacgcggttctttctctcttccgtttcccacctttatgttatcctccagcccctccgtcttctacctcttccgttctatgattcagcttccaggctttcttggctgcctcctcctctgtttcccaacccttcttttcttctcttccttctttcttcgacccggctttctcctttaggttgacctcctcttcccacctgctgtttacctcattctttcatcttcctgtcccatctcccttgattactttatccctgttttctcctctggtccctacttggggctccaccccagtccttctcatttttcactcttcccttactttggaggtctcttctcttccttccccttcaactcacgcctcccaggagccccattcagtgtatctccatccacttctgctggatcaggccagctggtccaatgacagacacaacccctcatctgctcccgtttggggtgtctcctgattcttggcacacatggtatatggtgatgctttagcactacagggcaccctctgcttgctgaccaagagtcgtttatcatattcccattgggttataattaatgctaatcatacttcagtttttaattgatcaccactttggaatcactcatactgaccgaagcatttttcatggaaaagccaggtcttagccatcatagccgtttcaagctttttttgcactggctttagagtacaagtccagtcccagcttcctcagctacaacctgcttgttgaagatgcccaaatctagattgccagcaaagatatgagctttagctctgcgttttctccctgctggaaaactccacttacatgtccttcagagacctcaaaaccagccctacccaaaactaaacccagttatttttccctccacccacttggacccaaattctccttctatgttcctgagtgttacctcttccctgtcctcaattgccatagcctccctaggaagctggctcatagactcagtaaacaatagatttcatgataccatacagcattaggagaacaggcagtgcactatttcaaacccagctcaatggaatatttttttaaatgaaatgtcttctgtctcaatttcttcctctcttttcttccgactctgcccactttttgtcctcatgatcttttctccactattataacaattagcttgataaaaccagtcatcttcagcttatgcatctgtgggttggctgtgggtcagaaatctgggctgggcttgacttatcttaacaatattcactcattcatctgtgtaacaagttagagcccagctccaggctgtgtttggatggagaaacttagctgaggctctcatcctgggatgagtgagctagctccaccatgtctatataatgttaataacaaaagtacgagagtagaagaaacacacaaggcctcttcaggctcaggccaagaacaagcacacccttacttcctatttattgtattggccaaatcaagtcatatggtggattctagagccaaagtgagagactatttgtaaagttacatggtaaagggcagggatatagtgggaggtagaaaattggaaccaataatgcaactggtctgtattacatgcaagaagaaagtgcccaattataaatatacagcttggttgatttgcacaaactgaacaccctcttgcaagctgcacctaggtcaagatacagattatcagcatatcaggatctgtgctcctgcctccttacatcctccttccaggaaaaaaaaaaaaaacaaaaaaaaagcaaaaaaaaaaccaaaaaaaaagcaaaaaaaaaaaacaccactaccctgacttctaacaccataagttaattttgtctgcttttgaatttcgggtaagtggaatcatacagaacttactctttttaatcaatgtggtaacatatgcagacacaaaaatgactatcgtgaaggaaaaggtttatatcgacagatccctacaaacagaagacacagcacaccacccaagaccacatggagaagcaccagtgttaggaggcagctggagtgaggggtcaaggtgggcaagagcctttactgtagtttctgcaggaaagagtgggcatgacaaggtaatcaggcttaggattagctcgtttgaatacttttagcaggctctggggtacagcggctgtctttacttttctgttacctggacctggctgattagggcaggagaatagtggcccagggtgtagagtcctgataaaggaagtggttggggaacgtatgagccctgaattagttggtttgcatatgaaagatgtgttagagtcatttataatctccaggaaacagctagctgggagatcccagaaggccatggtttagtagtagaaatgatctacagagtattggaattaggtagaataaaagctatcttcttaacaaaacataaaatcaatcccccaaaggatcaagatgactcacaagtaacctaacacagtccaacactgtttaaaggaagtcaattaaatccagacaagtaagaatatagcctttacaatatccagcattcctaaaattactaggcatgttacatcaacttttgacaacaactactagagttgagccaaacttcaaaagttaaggacatggtcctccataacactgtccttacttcagacatcagctgcaagttcaaggttacgtaagctacctatacttctaaacagctggctaccatatttaggaatccccactaacccttcaagcttgataattcactaaaaaaaattaaagaactctggaaagcactatacttacaactacagttttattatagcaaaaatatccaaacagaactagccaaaagaagagatgtatagtactatgggaggtggagcaagatggtggaatagaaggctccactgattgtttccccaacaaggacaccaatttaacaactatctgtgcaagcaaagctccttcacaagaaccaaaactcaagtgagcacttgcagtacctgcttttaactttgtgttgctgaaaaaggcactgaaaaggttgcagaaggagtcttgaagcactgaagccacccctccatcacaccctggcagctgtggtgtggtgcaaagagcattttcgtgcactgggtgagggagaacacatcaatggtgaggcattaaactcagtgttgtcctgttacagcaaaaaggaaagccagacaaagttcagctgatgcccacacataaagggagcattcaaaccagtcccagccaaaggggaatcactaattccagcagtcagaatttcagttcccacaaacctcaccactgagggctgaagtgctctggatctctgactaaacctgaaaggcagtttaggccaaaagaactgcaattcttagacaagtcctagtactgaactagggccagagacagtggactgaggggtgcaaaatatactgagacaccagctggggcagccaagggagtgctggcatcacccctccccaatcccaggctgcacaactcacaactctaaaagagaccccttcctgctgcttgagaagaggagaggaaagagttgaggaggactctgccttgcatcttggataccagctcagccacaacagatatggcaccagtcagaataatgaggtccctgttccaggccctagcttccaggtgacattcctagaaacaccctgggccagaagggaacccactgctttgaagggaaagacccagtcatggcagcgttcatcacctgctagctgaaaagccctttggctctgaataaccagcagtgatacccagatactacatcaagggccttgggtgagcctctgagactagctggtttcaggtactggctcagccacagggaggtaaagcaccaagcaagctcttgggggcccttgattccaagagttgactcttcaacagcatttctagacctttcctgggccacagggaagcccactgccccaaagagtgagtcccaggccaggcagcagtcaccaccagctgacttaatagcctttctgccttaaatgaatacctgtgataatccagcagtacttcttgtgggctgtggagtgaggctcctctgcctttggacaggggaggaaagagtgggaaagactgtgttttgtggtttgagtgccagctcagtgtttttgtttattcattttattattatttattattattattatttcaataggtttttggggaacaggtggtgtttggttacacagataagttcttagtggtgatttctgagattttggtgcccatcacccaagcggtgtacgccgtacccaatgtgtagtcttttatcccctactcccctctcacactttcccccgagtccccccagctcaattttaatgcaatagaatgccaggtagacttcaaaggttttttactctagtccctgactcctagacaacatctctggacccacctggggcttgggggaacttgccaccctgaagggaagggcacagacctggatggcttttccacctgtttattgtagagccccaaggccttgagcaaacataggcagtggccagggagtggttacagcagggaagacccagtgttgtgctggcttcaagtctggctgagcacagtcatagtggtggtgtcctcaggggtgctggtttcactccactcctagcttcaggtgtctcagaactgacagagggactctgtttgggagaagtaaggaaagaaaataagagtatctgcctggtaatccagagaattatcctggatcttgtccaagaccatcaaagcagtacatctagaaactgcaagaaccatagcattactgggattgtggtaccctctaaagcagatacagcatagatcaaaatactccggtcttttcaaatatctgaaaatccatcccaaggaggacaggaacaaaaaaacacagacagtgaagcctacaataaatcctaacaccaaagaacatttacaagtatcaagataatccaggaaaacatgacttcaccaaatgaactaagtaaggcaccatggaccaatcctggagaaacaagacataggaccattcagacagagaattcaaaatagctgctttgagaaatctcaaagaaattaaagataacacataggagaaattcagaattctatcagataaatttaacaaagagattaaaatactttaaaagaatcaaacagaaactccatcaaaaagtggatgaaggatatgaaaagatactccccaaaagaagacatttatgcggccaacaaacatatgaaaaaaagctcatcatcactgatcattagagaaacgcaaatcaaaaccacaataagataccatctcattggtatctcatcaccgttagaatgctgatcattaaaaagtcaggaaacaacagatgctggcaaagctgtggagaaataggaatgcttttacattgttggtgggagtgtaaattagttcaaccattgtggaagacagtgtggtgattccttaaggatctagaaccagaaataccatttgacccagcaatcccattactgggtatgtacccaaaggatcataattcattctactataaagacacatgcacacatgtttatggcagcactatttacaatagcaaagtcatggaacccgaatgcccatcaatggtagactggataaggaaaatgtggcacatatacacaatggaatactatgcagccataaaaaaaatgagttcatgtcctttgcagggacatggatgaagctgtaagccatcattctcagcaaacaaacacaggaacagaaaatcaaacaccccatgttctcactcataagtggcagttgaacaatgagaacacatggatacagggaggggaacattatacaccaggacctgtcaaggggttggagtcaaggggagggagagcgttaggacaaataccaaatgcatgtggggcttaaaacctagatgacgggttgaaggtgcagcaaactaccatggcacatgtatacctatgtaacaaacctgtatgttctgcacatgtatcccagaacttaaagtagaatttttaaaaattttaaaaagaatcaaacagaaattctggagctaaaaatgcaattggcatattgaagaatgcatcagaatcttttcatagcagaattgatcaagcagaagaattagtgagcttgaagacaagctatttgaaaatatacagtcagaggagacaaaagaaaaaagaatcaaaaagaatgaagcatgcctacaggatctagaaaatagcttcaaaagggcaaatctaagagttattggtctaaagaggacatagagaaagagagaggggtggaaagtttattcaaagggctaataacagaaaacttctcaaacctagagaaacatatcaatattcaagtacaagaaggttatagaacattaagcagattcaacccaaaagagactacctcaaggcatttaaataattaaactcccaaagatcaaggataaagaaagaatcctaaaacaagcaagagaaaagaaacaaataacgtacaatggggctccaatacatctggcagcagtcctcacagtagaaaccttaccttacaggcaaggagagaatggcttgatatatttaaaatgctgaaggaaaaatcttttaccttagaataatatatctagtgaaaatattatgcaaacatggaagagagaaataaagactttccaaaataaaagctgaggaatttcatcaacaccagacctgtcctacaagaaatgctaaagggaatacttcaatcaaaaagaaaaggacattaatgagcagtaagtaatcacttattaagtaataataagtaatatgaagatacaaaacaaactggtaatagtaagtacacagaaaaacactaaatattataacactaactgcagtgtgtacactattcttgtcctaaatagaaagacaaaacaacaaaccaataaaaaatcataactatatcacaaaattggaaaatggtggatagcagacagaactaacatgcagctcctgcttggaatggacagaacagtgtgtggagactcacactgtgagcttttgctgcaagaactaccatgggaacataccaggaaaactgaaagaattcacagaccctttgaaagaagcagttttactgttgcaaactctatgagacagccaaaaaactgtgagttcccaaagtgtgagcagggaaaagtttgcctctgaacacacatccccactggggaacctgaaaatccagatcacaggagaaggatttaaccttacccagagctgaaacagatttaggatgccaagcaaaacataaaagtagaagaagcaatgggaagagccctgtagacacttccactgaactgcccatgtcaagagagcttgtacagtgcatggatagctgccagcccccgggccctcatccaccacctcatccagtggagctcattcccagctgttgggataatgaatttacatgagctgataatgtagacacgaattcagtcagtggccaggagcgcagaagttaataaatacctctctagtgagggcaggaaggtgtgctctcccaggtcctccttctcccctctgcccggatgcccccaggaactccacagacaccttggcacctgccctggtctcagcgagagaacacctccattggggaaagactctcatctgcctctctagggagggctggaggccttgtgccgaggcctgggggagcccagggaaaccattcctggcctcatctcacagagattcttcaggaagggagggcagccagtagaactggggaggggccacagggtgaaggaagctcctagctgatctttgttataattttggctgagtacgaattttcctgtgcagaaacggggtggggggcaaatgggaagtgcacatacaattgcagaagctgcagctgaagggaagggcaggcagggaagggaggcctgagagccctgcttgctttctcagtgggaaggattgtagcctggggaaagatctcagccctgctcaaaggctgcctggatataaactcagtgctgttggaggggcatggcgggagtaagagtggccttgctggctgcatgagagctgagtgaggcccgtcactgcctgttttcccccgcttccctggtgacatgtataatgcagtagaggcacccataatccccctaggaacataacaccattggcttaagaaccacctctctgtcctccacagtggctgcagcaagccctgcccaagtagcatcagacctgcccaatcctgcgcccccaccccacccaccctgcgctcaatggtttttctctacccaccctggcagctgaaaacaaaagacataaactcttgggagctctatggccccgctcatcacctgagaaacccgagtactaatcctggccaacacagggcaagattatatcctccatgagcatggaatgttcttccatttgtttgtatcctcttttatttcactgagcagtggtttgcagttctccttgaagagatccttcacgtcccttgtaagtaggattcctaggtattttattctctttgaagtaattgtgaatgggagttcactcatgatgggtaggaagaatcagtatcatgaaaatggccatactgcccaaggtaatttatagattcaatgccatccccatcaagctaccaatgactttcttcacagaactggaaaaaactactttaaagttcatatggaaccaaaaaagagccctcattgccaagtcaatcctaagccaaaagaacaaagctggaggcatcatgctacctgacttcaaactatactacaaggctacagtaaccaaaacagcatggtactggtaccaaaacatacttatagaccaatggaacagaacagagccatcagaaataatgccacatatatataactatctgatctttgacaaacctgacaaaaacaggaaatggggaaaggattccctatttaataaatggtgctggtgctgggaaaactggctagccatatgttgaaagctgaaactggatcccttccttacactttatacaaaaattaattcaagatggattaaagacttaaatgttagacctaaaaccataaaaaccctggaagaaaacctaggcaataccattcaggacataggcatgggcaaggacttcatgtctaaaacaccaaaagcaatgacaacaaaagtcaaaattgacaaatgggatctaattaaactaaagggcttctgcacagcaaaagaaaataccatcagagtgaacaggcaacatacagaatgggagaacatttttgcaatctattcatctgacaaagggctaatatccagaatctacaatggactccaacaaatttacaagagaaaaaccaataaccccatcaaaaagtgggtgaaggacatgaacagacatttctcaaaagaagacatttatgcagccaaaagacacatgaaaaaatgctcatcatcactggccatcagagaaatgcatatcaaaaccacaataagataccatctcacgccagttaaaatggcgatcattaaaaagtcaggaaacaacaggtgctggagaggatgtggagaaataggaacacttttacactgttggtgggactgtaaactagttcaaccattgtggaagtcagtgtggtgattcctcagggatcttgaactagaaataccatttgacccagcaatcccattactgggtatacacccaaaggattacaaatcatgctgctataaagacacatgcacacgtatgtttattgcatcactattcacaacagtgaagacttggaaccaagccaaatgtgcaacaatgatagactggatcaagaaaatgcggcacatatacaacatggaataactacgcgccatnaaaaatgatgagttcatgtcctttgtnaggncatggatgaagctggaaaccatctttctcagcaaactatcgcaaggacaaaaaaccaaacaccgcatgttttcactcataggtgggaattgaacaatgagaacacatgggcacaggaaggggaacatcacccacggcagcctgttgtggggtggggggaggggggagggatagcattaggagatatacctaatgttaaatgacgagttaatgggtgcagcacaccaacatggcacatgtgtacatatgtaacaaacctgcacattgtgcacacgtaccctaaaacttaaagtataatttaaaaaaaaacaaaaataaaaacagcccaaaaaaaagaaagaatataaaaacacaggagtttcagcaattaaaaaaaaaaaaagattatatctcccttctactaccgcagatggtggtcttttgaaagtgccacctcctggctggaggccatccaactcaagccattacagcaacccataacagaacaaacctgatcctaggaaggagaaaacaacagctaattccaccacctacaacaccctggctaaccggaagtcctgagtctgtccatgtgacagcttcactgctagcataaccagcatttgagaaaacgagtgcactaaacaaaactaataccaaggactcccacagagtccacttcactcccctgacacctccaccagagcagacactggcattcacagctgagagacctgaagctggatcacatcacaggactctttgtagacatttttcagcaccagcccagagcccagtagtcccactgggtggctagacccagaaaggcaatagcaatcactccagtccagctctaaagaggccccatccctgggggatagggtagagcaccacatcaagggatcatctgtgggacaaaataatctgaacagcaggccttgacttccagatctttccactgacatagtctacttaaatcagaaggaaccagagatgacaaaacaagattccataacacccccaaaagatcacactagctgtccagcaatagacccaaaccaagaataagtctttgaattaccagataaagaatttagaatgttaattatcaagctactcaaggaggcaccagagaaaagtgaaaaccaatttaatgcagccataaaaaatgatgagttcatgtcctttgtagggacatggatgaaattggaaaccatcattctcagtaaactatcgcaaggacaaaaaaccaaacactgcatgttctcactcatagatgggaattgaacaatgagaacacatggacacaggaaggggaacatcacactctggggactgttgtggggtcgggggagaggggagggatagcattcggagatatacctaatgctaaatgacgagttaatgggtgcagcacaccagcatggcacatgtatacatatgtaactaacctgcacattgtgcacatgtaccctaaaacttaaagtataataataataaaaaaaagaaattttcaaaaaaatacaaaatatggatgaaaaattcttcagagaaatatatatcataaagaaaagacaatcacaacttcttgaaataaaagacacacttaaagacaggcaaaatacactggaaaggttcaacaatagactcaaacaagtggaaaaaagaacttcagagctcgaagacaaggcttttgaattaacccaatctgacaaaaacaaagagcaagaaagaactgaaacaattaacaaaacctccaagaaattttagatttgttaaacaaccaaacataagaataattggtgttctttgttcttgaggaagaaaataaatctaaaagtttggaaaatttatttgagggagcaattgaggaaaacttccctaatcttcctagagatctagacatccaaatacaagaagttcaaagaacacccaggaaattcatcgcaaaaagataatcaccaaggaacatagccaccacgttatctaaagtcaagatgaaggaaagaatcttaactgtgaggcaaaatcatcaagtagtctataaagaaaaacctgtcagattaacagcagattgataagcagaaactctgcaagccagaagggattggggtcctatctttagcctccttaaacaaaataactatcagccaagaattttgattccactgaaactaatcttcataaatgaaggagagataaagtcttttccaaacaaatgctgagagaatttgccactaccaagccagcacagcactaaaagaaatgctaaaagaaattctaaatattgaaacaaaaactcaaaatacaccaaaatagaacctccttaaagcataaatctcacagggcctataaaatcatgacacaatgaaaaataaaaaagatattcaggcaacaactagcatgatgaacacaacagtacctcatatatcaaaactaacgttgaaggcaaagtggtctaaatgttccacttaaaaaatacagaatgacagaatacataaaattccaccaaccaagtatctgctgtctttaagagactcaccatacacataaagactcacataaacttaaagtaaaagtgagggaaaagacattccatgcaaatggaaaccaaaagcgagcaggattagctattcttatatcagacaaaacagactttaaaacaataacagtttaaaaagacaaagaaggatgttatataatgacaaaaagattactccaacaggaaaatataacaattctaattatatatgcacctaacactggagttcccaaatttataaaacaattactaccagacctaagaaatgaaatagatagcaacagagtaatagtggggaacttcaatagaatactccactgacagcattagacaagtcatcaagacagaaagtcaacaaaaaaacagtggacttaaactataccctataacaaatggacttaacaggtatttacaaacattctacccaaccaatgcagaatatacattcttttcatcagaacatggaatattctccaagatagatcatatgagaggccacaaaacaagtctcaataaatttaagacaattgaaattatagcaagtactctgtcataccgcagtagaataaaattggaaattaactccaaaaaggaatgctcaaaactatacaaatacatggaaattcaataatctgctcctgaataatttttgagtcaataatgaaatcaaaacggaaattttttaaattccttgatctgaaagataatagtgacacaacctatcgaaacctctgggatacagcaaaagcagtactaagaggaaagttcatagcattaaatgcttacatcaaaaagtctgaaagaccacaaatagacaacctaagctcacacctcaaaaagctacagaaaatagaacaaacaaaacccaaacccagcagaagaaaataaaaatatcagtgcaaaactaaataaaactgaaagaaaaaatcaatacaaaagataaatgaaacaaaaagttgattctttgaaaagataaacaaaattgatagaccattagtgaaattaaccaagaaaagaagagagaagatccaagcaagctcaattagaaatgaaatggcagatatcacaatggacaccacagaaatacaaaagatcattcaaggctactatgaacacttctatgtgcataaactaaaaaacctaaggggatggataaatttctggcaatatacaaccctcccagattaaaccagaaagaaatagaaactctgaacagacaaataacaagtactgagattgaaacagtgagaaaaagttgccaagggaaaaaaaaatccaggaccagatggactcacatgtgaattctgtcagcattcaaagaagaactggtgccaatcttactgaaactattccaaaaggaagagaaagagagagtcctccctacatcattttatgaagccagtattaccctatcaccaagaccaggaaaggacataacaaataaagaaaactacaaactaatattcctggtgagcatagatgcaaaaatcttcaacaaaatactagccaacagaatccaacagcatatcaaaaagatgatccaccataatcaagtgggtttcatagctgggacgcagggttggcttaatatatgcaagtcaataaatgtgatgcaccacataaacaaatttataaacaaaaatcatattatcatctcaagagaggcagaaaaagcatttgacaaaacccagcatccctttatcattaaaaccctcagcaaaatcagcatagaagagagataccttaaggtaataaaagccatacatgaaaacccagagccaacaatatattgattgaggaagagttgaaagcattctcctgcaaggtgtggtgctcacgcctgtaatctcagcactttgggaggccaaggagtttgagaccagcgtgaccaatacagtgaaaacccgtctctactaaatttacaaaaattagctgagcatggtggtgggcagctgtagtcccagccacttgagaggctgagacaggagaatcacttgaaccctggaggtggaggttgcagtgagccaagatcatgccactgcactccagcctgggtgacagagcaagactccaccaaaaaaaaaaaaaaaaaaaaaagcattccccctgcagactggaacaggacaaagatgcccacttttaccacttctatttaacatagtactggaagtcttagccagagcaatcaaacaagagaaagaaataaagggtaaccaaactggcaaagaggaagtcaaactgtcactgtttgctgatgatataatcacatacctagaaaaccctaaagactcatccaaaaagctcctagaactggtaaatgaactcagcaaagtttcaggatacaaaattaatgtccacaaatcagtagctctgctatacatcatcagagaccaagctgagaatcaaattaagaacataacccctttcagaatagctgcaaaaaataaaataaaatacatagaaatatactgaaccaaggacgtgaaagacctctacaaggaaagctatgaaatactgctgaaaggaatcataggtgacacaaatgaatggaaacatagctcaagctcatggatgggtagaatcaatattgtgaaagtgaccaccctgccaaaagcaatctacaaattcaatgaaattcccatcaaaataccaccatcattttttcacagaatttttaaaaaatactaaaattaatatggaaccaaaaaagggcccactcaaccaaagcaagactaaaccaaaagaacaagtctggaggcatcacattacacaacttcaaactatactacagtcatggtactgatttaaaaacagacacatagaccaatggaacaaaatagataactcagaaataaagccaaatacttatagccaactgatctttgacaaagcaaacagaaacaaagtggagaaagaacaccctactcaacaaatggtgctgggataattggcaaaccacatgtagaagaatgaaactagatctgcatctctcacctaatacaaattcaactgaagatggatcaaaaacttaattcaaagatcagaaaccataaaaattctagaagataaaataaaaaaaaaactcttctagacattgccttagtcaaagagttcatgagtaaaaatccaaaaacaaagataaatatatgggacttaaactaaaaagcttctgcatagcaaaagaaacaatcagcagagtaaacaggcaatgcaaagagtgggagaaaatcttcacaatctatacatccaacaaaggactgatatccagaaactacaaggaaatcaaacaaatcaacaagaaaaaaacaatctcatcaaaaagtgggctaaggacatgattagacaattttcaaaagaaaatacacaaatggccaagaaacatattaaaaaatgctcaacatcactaatgatcagggaaatgcaaatcaaaaccacaatgcaataccaccttactccagcaagattggccataatttaaaaatcaaaaaataatagatgttggtgtggatgtggtaaaaagggaacacttgtacactgctggtgggaatgtaaactagtataaccactgtggaaagcagtatggagattccttaaagaactaaaagtagaactaccatttgacccagcactcccactactgggtgtctacccagaggaaaagaaattattatggcaaaaagatacttgcacacacgtttatagcagcacaattcataattgcaaaaatatgaaaccaacctaaatgcccatcaagcaatgaatggataaagaaaatgtggtatatataccatggaatactactcctcaataaaaatgaataaaataatggcattcacagcaacctggatgtagttggataccattatttaaatgaagtaactcaggaatgaaaaaccaagcattgtatgttctcacttataagtaggagctaagctataagaatgcaaaggcataagaatgatataatgggctctggggactcggtaggaaaggtgcaaggggggtgagaaataaaagactacataatgggtgcagtgtaccctgcttggatgatgagtgcatcaaaatctcagaaatcaccattaaagaacttatccatgtaatgaaacaccacctgttttcccaaaactatagaaataataataataactacaacaacttttcaagacatagtacaataagataaaaacaaaaaaaaagaagggggaaaaataacacatagagtttctattagttttatttttttgctttcttgtttgttttttaatgcaaataatgttgttatccgcttaatataatgggttatctggtagtatttgcaagcctcatggtaacctcacaccaaaaaacttacaatagataaacaaaaaataaaaaaacaagaaactaaatcatatcaccagagaaaatgatccttactaaaggaagacaggaaggaaggaaagaaggaagagaacacaaaacaaacaggaaacaaataaaaatatggcagatgtaagtccttacttatcaagaataacattgaatataaattgagtaaattctgcaatcaaaagacataaagtagctgaatggatgaaaaaacaagatccactgatatgctgcatacaagaaacacacttcacctatacagacacaaatacattgaaaataaatgaatggaaaaagatattccatgccaatggaaaccaaaaaagagcagaagtgctatacttatatcagacaaagatttcaaggcaaaaattctaagagacaaagatggtcattatataatgataaaggggtcaattcaacaagaggatgtaacaattgtaaatatacatgcacccaacactggaacatccagatacataaagaaaatactagagcaaaagtgagagaggtcccagaacaataatagctggagactttagcaccccactttcagcattgaacatatcttccagacagaaaatcaaccaagaaatgtcagacttaatctacactatagaccaaaagaatctaatacatatttatggaacattttatccaatggctacagaatatactttattttcctcagcacatggattattctcaaaatgggccatatgttaggtcacaaaacaagctttaaaaccttcaaaaaatgaaataatatcaagcattttctctgaccacaatgtaataaaactagaaatcagtaacaagaggaattttggaaactatacaaatacgtggaaattaaacaacatgcttctgaatgaacagtgggccaatgaaaaattaagaaggaagttgaaacatttctttaagcaaatgataatgaaaatataaaatactgaaacctatgggatatagcaaaagcagtgtattaagaggaaagtttatagctataagtgcctacatcaaaacagaggaaaaacttcaaatgaacaaactagaaaagcaagatcaaaccaaacccaaaattagtatgagaaaataaataataaatatcagagctgaaataaatgaaatgaagaaaacaatgtaaaagatttttttcttttttaattttaagttctgaggtacatgagcaggtttgttacgtaggtaaactcttatcctgtgggtttgttgtacggatatttaatcacccgggtattaagcctactacccattagttatttttcctgatcctctccttcttcccatcctacacctcaggtaggccccagtgtctgttgttcccctctatgtgttcatgtgttctcatcacttagctcccactgataagtgagaacatacagtatttggttttctgttcctgcattagtttgctaagtatagtggcctccagctccacccatgttcttgcacaggatatgatcttgttcctttttatggctacacagtatcacatggtatatatgtgccacatttttttatccagtctgccatttgtgggcatttaagttaattccatgttttttctattgtaaatactgctgcaataaacacatgagtgcacacgtctttacgatagaatgatttatattcctttggtaatacacctagtagtaatgaaattgtcaggtcaaatggtattttggtttcacctctttgaggaatcactacacactgctttccacaagcattgaactaatttacattcccatcatcattgtaaaagtgttctgttttctctgcaacataaccagcatctgttattttttgactttttagtcatagcaattctgactggtgtgagatggtatctcgttttgatttgcatttccctaatgattgtggatgttgagctttttttcatatgcttgttggccacatgtaccaccaaacttttaaagaacaactaataccagtcctactcaaatagttctgaaaaatagagactagaatacttccaaatgcattctatgaggccagtgttaccctgatagcaaaaccagacaaatatgaatcaaaaaaagaaatctacaagccaatatctctaatgaatattgatgcaaaaattctcaacaaaacactaacaagccaaattcaacaatactttaaaatagcattcattatgaccaagtgggatttcttccagggatgcaaggatggctaaacatatgcagtgtgatacattatatctacagaatgaaggacaaaaatgatatgatcatttcaattcatgctaaaaaggcatttgataaaactcaatatcacaactaaaagaactagagaaccaagaggaagcaaaccccaaagctagcagaagacaagaaataaccaagatcagacctgaactgaaggagacagagacatgaaaaatccttcaaaaaatcaaccaatctagaagctggctttttgaaaacataataaaataaataggtcactagctaacctaataaagaaaagagagaagattcaaaggaacacaatcaaaaaatggtaagggggatatctcctaccccacagaaataaaaacaaccatcagagaatactataaacatctctatgcaataaactagaaaatctagaagaaatggaaaaagtcatggacacatacacccttccaagactgaaccagaagaaattgaatccctgaatagaccaaaaatgagttctgaaacttaagcagtagtaaatagcctaccaactaaaaaatgcccaggccagacagattcacagcttaattctaccagaggtacaaggaagacctggtaccatttctactgaaattgttccaaaaaattgaaaaagagggactcctccctaacccattctatgaggccaacatcattctgatactaaaacctggcagagatacaacgaaaaaacttcaggccaatatccctgctgagcactgatgcaaaactcctcaataaaatactggtaaactgaatccagcagcacatccaaaagctcatccaccatagtcaagtaggcttcatccccagttgcaaggtgagttcaacatatgcaaatcaatcaatgtgattcatcacataaacagaatgaaagacaaaaaacacaattatttcaatcgatgcagaaagggccttcaataaaattcaacatccttcatgttaaaaactctcagtaaactaggtattgaaggaacatacctcaaaataataggagccatatatgacaaatccacagccaatatcatactgaatcggcaaaagctggaagcattccccttgaaaagcaacacaagaaaaggatgtcctctctcaccactcctattcaacatagtattggaagttctggccagggcaatcgggcaagaaaaagaaataaagtgtattcaaataggaagagaggaactcactcacttaaactttgtttgcagatgacatgattctatatttagaaaaccccattgtctcagcccaaaagcttcttaagctgatagcaacttcagcaaagtttcaggatacaaaaatcaatgtgcaaaaatcactagcattcctatacaccaacaacaggcaagcagagagtcaaatcatgactgaactcccgttcacaattgccacaaaaagaataaaatgcctagaaatactgctaacaaaggaagtgaaggatcaaggagaattaccaaccactgctcaaagaaataagagaggacgcaaacaaatggaaaagcattccacgctcatggataggaagaatcaatattgcgaaaatggtcatactgcccaaagtaatttatacattcaatgctattcccattaaactactattgccattcttcacagaattagaaaaaactatttaaaaattcatatggaaccaaaaaagagcctgagtagccaagataattctaagcaaaaagaacaaagctggcgatatcatgctacccaacttcaaactatactacaaggctacagtaacccaaacaacacagtactggtggaagaacagatacatggaacaaccgaacagaatagagaacccagaaataagacctcacacctacaatcatctgaactttgacaaaactgacaaaaaaaagaaaaacagcaatgggaataggatttcccatttagtaaatggtgctggaagaactggctagccatatgcaaagaattgatactggaccccttccttacatctgatacaaaaattaactcaagatggattaaagacttaaatgtaaaacaccaaagtataaaaaccctagaaaaaaacctaggaaataccattcaggacataggtatgggcaaacatttcatggtgaagatgtcaaaactaattgcaacaaaagcaaacattgacaaatgttatctaattaaactaaagagtttttgcacagcaaaagaaactatcatcaaagtaaacagacaacctagagaatgggagaaaattttttcaatctatccatctgacaaaggtctaatattcagcatctacaatgaacttaagcaaatttacaaaaaattaaaagtgggcaaaggacatgaacagacacttctcaaaagaagacatacatgctgtcaacatacatgtggaaaaaaaagcttaatatcactgatcattagagaaatgcaaataaaaaccacagtgaggtaccatctcatgccagtcagaatggctgttattaagaagtcaaaaaataacagaggctcaggaggaaaagaaatgcttttacactgttggtgggaatgtaaattagttcaaccattgtggaagacagtgtagtaattcctcaaagacctagaggcaaaaataccatttgacccagtaattccattactggatatatatccaaaagaatataaatcattcttttacaaagatacaagcatgtgtatgtacattgcagcactattcacaatagcaaagacatggaatcaacctaaatactcatcatttatagattggataaagaaaatgtggtacatatacaccacggaatactatgcagccataaaaaggaatgagaccatgtcgcatgcaaggacatgaatggagctggaaaccattatcctcagcaaactaacacaggaacagaaaaacaaataccacatgctctcacttacatgtgggaactgaatgataagaacacatggacacactggaggaaacaacatacactgaggcctgtcagagggtgtggggtggaaagagagagcatcaggaagaatagctaatggattctgggcttaatacctaggtgatgggatgatctgtgcagcaaaccaccatgacacacatttatctatgtaaaaaacctgcacatcctatacatatatccctgaacttaaaataaaattggaaatttttaaaaagtcaatgtttcttcataataaaattgctcaaaaactgggtatagaaggaacatacctcaacataacaaaagctatatatgacagactcacagctagtatcacactgaatggggaaaaactgaagtctttcctctaagatctggaacatgactagggtgcccactttcaccactgttcttcaacatagtaatggaatttctagctagaacaattggatggacaagagaaagaaatacagggcctccaaattgaaaaggaagaagtcatattatttttgcttgcagatgatatgttctcatatttagaaaaattaaaaacaatttaatttacaaaaattattagatacaaaaaatattagatctgataaacaaattcagttaagttgcagaatacaaaatcaacatacaaaattcagtaacatttctatatcccaacagtgaacaatctggaaaagaaacaaaaaatgtaatcccatttatgacagccatgcataaaattaaacacttaggaactaacttaaccaaagaagtgaaagatctctacaataaaaaccacaaaacattgatgaaagaagttgaagaatgctccaaaaaatggaaagatattccatgttcagggattagaagaattgatattgttaaaatgcccatactacccaaagcaaacctacagattcaatgcgattcgtgtcaaaataccaatgacattcttcacagaaataaaaaaaaatcctaaagtgtatatggattcacagaagacccagaatagccaaagctatcctaagcaaaaagaacaaaactgaggaatcacattatctgactaaaaattatactacagaggtatagtaaccaaaacagcatggtactgccataaaaagacacagagaccaatggaatggaatagagaacctagaaacaaatcccacacacctacagtgaactgattttcaacacaagtgccaagaacatactccagggaaaatacagtctttcaataaatggtgttgggaaaactgaatatcaataggcagaagaataaaactagatccctatctctcaccttgtacaaaaatcaaataaaaacaaagacttaattctaagacctcaaacaataaaactactacaagaagacattggggaaactctctaggacattggtctagggaaagatttcttgggtactacccacaagcacaggaaaccaaagtaaaaatggacaaatgggatcacaaattaaaaagcatcttcacagtaaaggaaacaaacagcagagtgaagagacaacccacagaatggaagaaaatatttgcaaagtgttcatctgacaaggtattcactaccagaatatataaggagctcaaacaactctgtaggaaaaaaaacctaataactcaattaaaaatgggcaaaacatctgaatagacacttctcaaaataaaacatacaaatggcaaactggcctataaaaaggtgctcaacgtcattaatcattagggtaatacaaatgaaaactacaatgagatatcatctcatcccatttaaaatggcttatatccaaaagacaggcaataacaaatgctggtaaggatatggagaaaagggaacatttgtacactgtttgtggaattgaaaattaatataaccactatggcgagtagtttggaggatcaaaaaaaaaaactaaaaattgagctactatatgatccagcaatcccactgctgggtacatacccaaaagaaaggaaatctttatatcaaagagatatctgtactctcatgtttgttgtagcactgttcataatatccaagaattagaagcaacctaaatgtccattaatagatgaattaataaagaaaatgtgggacatatacacaatgaagtactattcagccattaaaaaatgagatcttgtcatttgcaacaagatggatggaactggaggttattatgttaagtaaaataagtcagacacagaaagacatacatcacatgttctcacttatttctgagatctaaaaatcaaaacaattgaactcatggagataaacagtagaaggatggttaccagaggctgggaagggtagtgggtggtggaaaggagataggttaatgggtacgaaatgtagaaagaatgagtaagacctactaattgatagcacaacaggatggctatagtcaataacaatttaattgtacactttgaaataactaaaagagcataattggattgtttgtaacacaaggcataaatgcttgagggtatggacaccccatttgccatgatatgattattatgcattgcatgcctatatcaaaacattgtaccccttaaatatatacaactatcatgtacccacaaaaattaaaaatagaaaggaagagaggtagagagtgaagtctgggggagtctcaaacatgaaacttccttgttctttccccatgcagtcagtatgcactaccttcccagcatctgagtgtgacaatatgcagtatattggcaaccaggaaagctcaatcgagcttcagtgtctagcatttttagtaaggttttattatgtacggatgacagactgaatcattacccatgtgactgaactcagtctctagccactttccctttgcaaaagtcaggctgatactatgttgctcaaagccccacccctctaatcatctccattctgagtcacatcgttggcataaacaatcagcccatattagcttgctaaggctgctgtaacaaactgtcacaaattgggtcaattaaacaatagaaatttattttctaacagttctggaggctagaggtctgagatcaatgtgtcaaaagcaatggttcctctgagggttgtgatggataatctttcacatgctttcaattcatgaatatctcaacagagaaatgagaaatcacagcagagatgtaaaaataatttttaagatggaaattctagaaccaaaataatttttgaaataaaaaattatgaattagacataatagttgaataaggaagaagagaagtgataatttaaagatatgtcattagaaaaagttggaaaaaaacatagcatcagttatcttatagatgaaatccaacagtcaaatgtatatgtagctgtaattactaaaaggagaagaaagaccaattaaaaagtttgcaaggaaataatgactgaaatatttccaaatttgataaaaggcaaaagtttacagattcaaggttctcaataagcaacaaagagaaaaacacaaagaagcccacactgaagcacgttatatttaaatatggaagggtgaagacaaagaggaaaccttaaagtcagtaatagaaaaacagcatattgtctacagaagcagcattctgatcaacagctgatttctcatcataaaacctatagatgagaagaaagtggaacattcttaaaatactggaaaaaaaaaagctcagcattttacctatatccagcaaaaatatcattcagtaatgaaggcaaaataaggactttttcagataaacaaaatataagaggattcatagttacactcaataaatgttaaagttcttctggctaaaaggaaaagaatcctgatgaaagtgtgtcctcagcaaaaattgcagagcatcagaaattgacatctgcgtaaatgcaaaaacaaacaaaatatatttttttattttcgtcttaaaattatgtaatccatatgttaggaactgaatgtttgtatcctccaaaattcatacactgaaattctcaccccaccccagtgtgatagtattaggaagtggagatttggggaggtaattattagctcatgagggtggagccctcatgaatagcattagtgcccttgtaagaagacaatgatctctctttctcagctatgtaacggtacaatgagaagacagccatctacagaaagataggccctcaccagacactgaccctgttggcaccttgacctttggattcccagactccaaaattgcaagtaatgtatgtttgctgtttaagctgaccagcctatagtattccattatagcagcccaaactgactaagacatcatataactgtttataattttattataacattgtcttataaaatttataatatatgttggtgtaccacatatacaattatatcataagagatagagagatgaatttactaagtggtaagatttctattttttatgtgcagtagtgcattgtaattatatactgtgaaagttatgaatgtatattgaaatctctaaagcacccctataaaatgaaattataaacaataactaaaattcaacaggaaaattaagataaaatctaaaaaataatagaataatacaaaacgggggcaggaaaggaaaaccaaaacacagaagtaaatggttggaactgttggaaagaaagacataagctatgtattttcagatggcatgattatgatcttgtttaaaagatactgaaaataaaaattagaaataatatataaattcaataaggttacaaaatacaggattaatatataaaataagttgtattcctatacattagaaaagaaaacctgaaatgaaattacaaaaacaatccatttacaatagcaccaaacagaacaaaatacttagatataaatttaacaaaaggagtgcaagacttgtacactaaaaactacaaaacattgttgaaagaaattaaagaaaacttaaataagtgaaaagatatcccatgtccacggtttggaagacttactattgttagaaatcatactgcccgctatggactaaattacgttctaccaaaatttatatgtggaagttttaacctgcaatgtgactttatgtggaaatacagtctttaggaggtaattaaggttaagtaagatcataagagtagagcccaaatccaataggactgtggccttagttttctaagagagaaagagggagatctttttctctaccacatgagaacacaataagaagatcgccatctgcaacccaagaagaaagccctcaccagacattgagtccactgacaccttcatcttggatttccactctctagaatgtgaaaaataaattcctgttttttaagccacacagtctatgatatttggttacagcagcctgagcaaactaagatactattcaaactgatctacagattcacttcaatccctgtcagaatcccagctgacttttttcagaaacaggaaagttgatatagcatagacaaaataatctttaaaaagaaaaaaaaactgaaggactcacattacccaattataaaacttagtacaaaataacaataataaagatagtgtggtactaacataaaaatagatacatttatcaatggaatagaattaggagtccaaaagtcaatgtatacatctatggtcaactgattttcaacaaggttgtcaagatcattcgatggggaaagaatagtctttttaacaaatgatgttggtacaaccagatagctagatgcagaaagtaaaataaaataggacccttatttcaccccacatgcaaaaattaactcaaagtggatcaaacacattgtgtaaaagtcaaaactataaaactcttagaagaatacataggtgtaaatctttatgattttaaattaggcagtggtttcttaggtgggaccaaagccttcattcagaaaaaaactttcattctgaaaacactaccatcaggaaagtgaaaagatggcccacaaaatgggagaaatatttacaagttatatcattgataaggacctagtatctaggatatgtattttttaattcaagttcaataatgaagagataaatagcccaattttaaagatggcaaaaaaagaaatggatgaattcctagaaacctgcaacctgccaagactgaatcaggaagaaatagaaatctaaacggaccaataacaaataaagagactgaatcaataataaaaatgttcccatcaaagaaaaacacaggaccccaaagccttcactgttaatttctgctaaacatttcaagaagaactaataccaatgtttctcaaatgcttcccaaaaattgaagaggagggaatattttcaaatttattttatgtggtcagcattatcctgataccaaagccagataaggatactacaagaaagaaaactacaggccaatatactgatgaagacagattcaaaaattctcaacaaccaaaaaaaagctagcaaactaaattcatcaggacgttaccaacatcatttaccattatcaagcataatttatcccagggatgaagagatgcttcaacatatgtaaatcaataaatgtgatatgatatcaacaaagtagaaaaagaatttgataaaaattcaacaactgtttatattttaaaaactctcaaaaaataggtagagaagaatgtacctcaacataatataagtcatgtatgacaagcccacagctatcatactcaatgctgaaaggttaaaagcttttcttctaagatcaagaacaatacaaagatgcccacgcttgccactgctaattaacatagtactggaagtcctagccaaaacaattagacaagaaaaagaaataaaaagcattcacacagaaaaagaaaaagtaaaattatctttttttgctgatgacatgaccttttatgaagaaaactctaaagattcccccaaaaacctataagaactgataaacaaattcaataaagtttcagattacaaaatcaacatacaaaagtcagtagttgccatgcacggtggctcatgcctgtaatcccagcactttgggaggccaaggagggtggatcacctgaggtcaggagtttgagaccagcctgaccaacatggtgaaaccccatctctactaaataatacaaaaattagccaggcctggtggcgagcacctgtaatcccagctactcaggaggttgaggcaggagaatcacttgaacccaggaggcagagtttgcagtgagccaagattgcaccattgcactctagcctaggtgacagagcaagactccatctaaaaaaataataataattaaaaaaagataaagtcagtagtcagaatcaacttctagacatacactttcagatgattttagcccccagcctttaagccacccagatgacatcaaagggaacacaagcaagctatccatactgagtcctaccaaaattatagattcatgagtaaaataaatgctgtcattattttaagccaaaaaatttgggatcgtttgttatgcaaccgtagtaactgcagcactgtcaaaataaaaaacaattctgaaactcaagacaccattaagaaactgaattgataatccacagattagaaacaaatacttacaatacaaatatcttacaaaggatatgtatccatcatacataaagaatgcttacaaattaaaattttgaaaaccattagccctataaaaataggcaaaagacttaaaaagataactcacaaaataagagatacaaaacaccaattaagtatgaaaagtgctcaacataatcctgaaactgcaaattaaaaacataatttcacacctactagcaggattaaaatgataatgccaaatgaagataatatgcagtaaaaccctcatatattgctgggtggaagtacaaaatggtacaaccactttggagaactgtttggctattttttatacagttaaatagacatctaccctaagacccagaaatttcactacttatttacacaagaaaaatgaaagcatgtttccaaaaaaagacttgtacgtgaatgttcataacatttttattcataatagtaaaaaactggaaactactcaactatctgaatataggagaatagaaaaacaagttggggcatatccatacaatgaaatacaacttaacagtatatattaaggataaactggctgagtgtggtggctcattcctgtaatcccagcactttgggaggccaaggcaggtggatcacttgaggccagaagttttagaccagctgggccaatatggtgaaactctgactctactaaaaataaaaaataaaatagccaggtatggtggaacctgcctgcagtcccagttacatgggaggttgaggcatgagaatcacttggacctaggaggcagagtctgcagtgagctgagatcatgccactgcattccagcctgggtgacagagcaagactgcgtctcaaaattaaaaaaaaaaaagagagagaaagaaaaaagaataaactattgagtcatgcaacaacaacaacaaaaatgtcagtagtgtttctatacactaacagtgaactatccaaagaatttttaaaatctcaattacaatagcatcaaaaaataaataacatacttaggagtaaatttagccatagagctgaaagatttgtatacttaaaatgataaaacattgatgaaagaaattgaagatagaagtaaaaagaaatatagttcatgttcatggattggaagaattaatattgttaaaatgtctacactaaccaaagtaatctgcatatttaatgcaatttgtattggaattccatgtcatttttcacagaaatggaaaaaacaatcctaaaatttatacggagttacaaaagactgtaaacgcccaaagcaatcttgagcaaaaagaacaatgctggaaggatcacactgacagatttcaaaatatattacaaacctactgtaatcaaaacagcatgctattggaatttaaaaaaggcattttgaccgagggaacaggatagaaagcccagatataaacttaaatatttgcagttaattgattttcaacaaaggtgccaagaacacaccatagggaaagaacagtctcttcaataaatggtgtagagaaactggacatccacatgcagaagaatgaaattggacccttatttcataccatatacaaaaattaacttaaaatgaataagagactgaaacataaggcttaaaactgtaaagctactgaaagaaaacagaagggtaaaacttcatgacattgagctggttaatgacttcttggataggactccaaaagtacatgaaacagaagcaaaaatatacaaacgggattgtatcaaactaaaaagcttctgcacaacaaaggaaacaacagaataaagagacaacccacagattgggagaaaatatttacaaaccatacatctgataaagaaccaatataaaaaaacacacaagaatctcaaacaactcaatggataaaaaagcaaaacccaactaaaaaatgagcaaagagtctgaacagacatttctcaaaagaagagatatgaatagccaacagatatatgaaaaatgctcaatatcattagtcatcagggaaatgcaaattaaaaccacaatgagatatcacctcacatcttttagaatggttattactcaaaaagacaaatgataacaaatgttgaaaagaatgtggagaaaataaaacccttgtgcactgttggtgagaatataaattattataggcattttggaaagtagtatggaagttcttcaaaaaactaaaaatggaatattcatatgatccagcaattccatttctgggtatgtacctgaattagtctgttctcactctgctaatagagacatacccaagactgggtaatctataaagaaaaagaggcttaatggactcacagttccacatggctggggagtcctcacaatcacagtggagggcaaaggggaagcaagacatgtcttgcatggtggcaggcaggagggagcatgtgcaggggaactctcatttataaaaccatcagatctcatgacacttattcactaccacaagaaaagtatagggaaaaccactcccatgattcactaatcttcacctggccccacccttgacatgtggggatgattacaattcaagataagatttgggtgggaacacagcaaaccatattattctgcaactgtcccctctcaaatctcatgtcctcaggttttgaaactaataatgccttcccaacagttcctcaaagtaataattcatttcagcattaactcaaaagtccacagtccaaagtcttatctgagacatggcaagtcccttcagcctatgagcctgcaaaatcaaaagcaagttagttacttcctagatacagtagggacataagcattggataaatacactcattccaaatgggagaaattatccaaaacacagggactgcaggtcccatatgagtccgaagtccagtggggcaatcaaatcttaaagctgcaaaattatctcctttgcctccatatctcacatctaggtcatgctgatgcaagtggtgggctcctgtggccttgggcagctctgcccctgtggctttgcagggtacagctcctctcctggctgctttcacaggctggcattgagtgtctgtggtttttccaggtacacaggcaagctgtcagtggatctaccattctggggtccgtaggacagtggcctcttctcacagctccactaggcagtgccccagtcaggactcttgtgtgggggcttcaaccccatgtttcccttccacactgccctagcagagattctccatgagagctctgtcactgcagaaaacttctgcctggatatccaggcatttccatacatcctctgaaatctaggcggaagttccaaaactttaattcttgacttctgtgcacctgcacacctagtaccatgtaagccaatgatatggtttggcagtgtcctcatcccaatcttatctttaattgtagctcccataattcccatgtgttgtgggagggacccactgggagaaaattgaatcatgggggcagtttccctcatactgtttgcatagtagtgaataagtctcatgaggtctgatggttttataaagggaaacccccttcacttggttcccattctctcttgcctgccaccatgtaagacatgcctttcatcttctgccatgattgtaaggcctccccagccacgtggaactgtgagtctattaaatttctttttaaaaaataataataaattacccagtctcaggtatgtctttatcagtagcatgagaacagactaatacagtaaattggtaatggtagagtggggtgctgctgttaagatacccaaaaatgtggaagtgactttagaactgagtaacagaggttggagcaggttggagggctaagaagaagacaggaagatgtgggaaagtttgaaacttcctagagacttgttgaatggctttgaccaaaatgctgatagtgatatagataataaggtccaggctgaggcagtctcagatggagatgaggagctagttgggaactggagtaaaggtgactcttgctatgttttagcaaagagactggtggcattttccccctgccctggagatctgtggaactttgaacttgagggagattatttagggtatctggcaggagaaatttctgagcagcaaagcattcaagacatgacttggtgctgttaaaagcattcagttttaaaaagggaaacagcataaaattttggaaaatttccagcctggcaatgtgatagaaaagaaaaaccccattttctgaggagaaattcaagccagctgcagaaatttgcataagtaatgaggagccaaatgttaatccccaagacaatggggaaaatgtctccaaggcatgtcaaaggtcttcatggcagcttgtccaatcaagaggcccaaaggcctaggaggaaaaaatggtttcatgggccagacccagggccaccctgctgtgtgcagcctagggacttggtgtcctgcatcccaaatgctctagccatggctaataggggtcaagatacagctcaggccatggtttcagaaggttcaagtaccaagccttggcagcttccatgtgttgttgagcctgccagtgcacagaagtcaagaatttaggtttgggaacatgcacctaaatctcagaggatgcatggaaatgcctggatgtccaggcagaagttggctacaggggtgagcacagaagtcaagaatttaggtttgggaacctgcacctagatctcagaggatgtagggaaatgcctggatgtccaggcagaagtttgctacaggggtgggaccctcatggagaacctccactagggcagtgtggaaagggaatgtagggttgaagcccatacacagagtcccaactggggcactgcctagtggtgctgtgagaagagggccaccatcctccagatcccaaatggtagatctactgacagcttgcagcgtgcacctggaaaagcaatagacactcaatgccagcccatgaaagcagccaggaggagaggtgtaccctgcaaagccacaggcacagagctacccaaggccataggtgcccacctcttacatcagcatgacctggatatgagacatggagccaaagaagatcgtttcagagctttaagatatgactgccccactgaattttagacttccatggggcctgcagccccctttgttttgcccaatttctcccatttggaatggctgtatttacccaatgcctgtacccccactgtatctaggaagtaactaatttccttttgattttacaggctcatagaggtgaaagggacttgccttgcttcagatgagactttggactgtggactttgagttaatgctgacatgagttaagactttggggggctgttgggaaggcatgattggttttgaaatgtgaggacatgagatttaggaggggccagatacaaaataaatatggtttggttgtgtcctcacccaaaccttatctttaactgtagctcccataattcctatgtgttgtgggaggaacctggtgggagataattgaatcatgcgagcagttccttcatactgttcttgtggtagtgaataagtcttatgagatcggatgatggttttataaggggaagctcctttccttggttctcattctgtcttgcctgccactatgtaaggcatgcttttcaccttccaccatgattatgaggcttccccagccacgaggaactgtaagtccattaaacctttttctttataaattacccagtctcgggtatgtctttatcagcagcatgaaaacagactaatacagccaccaaggcttgggacttgtaacatctgaaagcctgagctgtacgttgaccccttatagccatagctggtgcaactgggacacagggcatcaggtcctgatgcagcacacaggagggggcccctgggtccagccatggaagccattttttcctcctagatctctgggctggtgatgggaggagctgccacaaaagtctctgacatgccctggagacattttccccattgtcttggagattaacatttggctcctcattactcatgcaaatttctgcagcaggcttgaatttctccccagaaaataaggctttcttttctattgcatcatcaggctgcaaattttccaaactttcctgctctgcttcctcttgaatgcttcactgcttagaaatttattccctgggatgccctaaatcatctctctcaagatcaaagttccacagatctctaggacaggggcaaaaggccaccagtctctttgctaaaacctaacaagcatcaactttattccagttcccaacaagctcctcatctccatctgagaccaccttggcctgggccttattgtccatatcactatcagcatttttgtcaaaaacattcaacaagtctctaggaagttccaaactttcccacattttcctgtcttcttttgagccctccaaactatttcaatctctgcctgtcacccagtttcaaagtcacttccatacttgttgagtatcttatcagcagcaccctactctactggtaccaaggtactgtattagtctgttctcatgatactgataaagacatacctgaaactgggtactctataaaggaaagaggattaattgactcacagttttacatgactggggaggcctcacaatcatgacagaaggagaatgaggaacagagtaaggtgttacatggcagcaggcaagagagcttgtgcagaggaactcccatttataaaactatgagatcttgtgagacttattcactaccacaagaacagcatgggggaaactgtccccatgtttcaattatctccacctggccttgcccttgacacaagaggattaatacaattcaaggtgagatttgggtgggaacacagccaaaccatatcagtatccaaaggaaataaaactgatatgttgaagaggtatctgcactcccattttcagcattattcataatagccaatatatggaatcaacttaagattccaccaacacatgaacggacaaagaaaatatgatatatatacacaatggaatactaaacagcttctaaaaagaaagaaattctatcatttgcaacaacatggatggtacaggaagacattattttaagtaaaataagccagacacagaaagacatatactacatgatcttacacatatgtggaatctaaaaaaatcaatctcataaaaacagagagtagaagggtggttacctgaggctaagggtaagagggagaaagcaagaaagggaagatgttgttcaaaggatacaaagttttagttagattcgaaaaataagtttcagtaatatattaaactgcatagtgaccacagttagtaataatgtgtggtatatttcaaaattgcttacctagatttttaatgttctcaccaaaaaaagcaataaatatgtgagttcatggatacattaattaccttaattgaacatttctgtaatgtacacatagatcaaaacatcacactgtacctgataaatctacataattattagtgaattaataattttccctccaaaattttaagtgtgcaaagaatctgaataaacatttttccaaagcatatatacaaatggccaataaatacatgaaaagatgcccaccatcattagtcactaagggaatgcaaatcgaaatcacatttagaaaccacttaacacttctcaggatggctataatcaaaaagacagacaataacaaatgttaacaaggatacagggaaattagaactctcatacactgttagtggggatgtaaaattgtgtagccactttgggaaacaatttggcagttcctcaaaaagtttagagttaccacatgaccgagtaattctatttctaagtatgtaccacattttctttatccagtctatcattgatgggcatttaggttgattccatatctttgctattgtgaatagtgctgtaatgaacatacacatgcatgtgtctttataacagaatgatttacattcctttaggtatatatccggtaatgggatttctggatcaaatggtgtttctgtctttaggtctttgaagaattgccacactgtcttcaacaatgactgaactaatttacactcccaccaacagtgtaaaatcactttcttttctccacaacctcaccagcatctgttttttttgtgactttttagtaatagccattcagactggtgtgaggtgatatctcattatggttttgatttacatttctctaatgatcagtgatgaactttttttcatatgattgttggccatatgtacgtctttttttgaaaagtatctgtccatgtcctttgtccacttttttatggggttgtttgtttgtttcttataaatttgtttaagttccttatacatgctggatattagacctttgtcagatgtatagtttgcaaaatatttctcccattcttcaggttatctgtttattctgttgagagtttcttttgctgtgcagaagctctttagtttaattagatctcatttgtcaatttttgttcttgttacaattgcttttggcatctttgtcatgaaatctttgtcagtgcctatgtcctgaatggtatcgcttatgttgtcttccaggtttttatagttttgggtttttcatttaagtctttaatccatcttgagatgcagaaaaggcttttgataaaattcaacatcccttcatgttaaaaactctcagtaaactatatattgaaggaacatacctcaaaagaataagagccatctattacaaacccacagagaacatcacactgaaatgagcaaaagctggaagcatttaccttgaaaactagcacaagacaaggatgccctcactcaccattcctattcagcatagtattggaatttctggccagggcaatgaggcaagagagaaataaagtgcattcaaataggaagagaggaagccaaactatctttgtttgcagatgacattattctatatgtagaaaaccccatcatctcagcacaaaagcttcttaacctgataagcaacttcagcaaagtctcaggatactaaatcaatgtacaaaaatcgctagtacttcttttttttaatgtgacttgctttattgcgatatttgctttattgtggtggtctggaattgaacccacaatatctccaaggtgcctacattagtatacctacattagtaatacctacgttagtgtatacttagtataattggcctttgtattaatatgcaaatagtattgacacttaaatgctccgaaaaggtctctgtagagaactctttgagaactgccatctagaggaaaggatgggctgcatatccaccagataattttacatgcatattttatatattttatatatatttatttatttctataaaactgcatgtgaatccacgatggtctcaaaatataaaatttaatttaaaagatccattatatttgctatctgacccttaaaaattatatatatataaaattatattttatgtaaatataattaatataatatataaattaaatatataatataaataatttttaagggtcagatagcaaataatggatttttaaaattaaattttatattttgagaccatcacagattcatatgcattttaaaaaaataataggaagagatcctgtgcattctttgcctggtttccttcaatagtaacatcttccaaaactacagtacaatagcacaaccagattattgacattgatacaatcaagatacagaataatgtcatcaccacaaaggttccttagtttgccctctcatagtcacactcactttactcctttccattgctcctcatctcccatctctgacacctagaaattattaatctgtttctatttgtaaatgttgtcgtttcagtaagattatctgaatggaatcatatggtatgtaaccatttgggattttcaatcagcataattccttgaggattcatccatgtagtataaatattttgttcatatttattgctgagtagtattctattacatgaatattgcgcagtttgtttattaattcaccctttgaaaggcatttcagtcaggttttggttattacaagtaagctgctatgaagattaatgtatagctttttgtgtgaatgtaagttgtcagttctctgggatatatgcaggtttttgttttgttttgttttgctttgttttgtttaaagacatggtctcactctgtcacccagactagagtgcagtgccatgatcatagctcactgtaaccttgaattcctgggctcaagccatctgcctgcctcagcctctgatctggagtagctagaactacaggtatataccaccacccctggctaatttttaaaaaactattttttgtagagatgagatcttgctatgttggccaagctggtctcaaactcatggcctcaagtaattctcccacccccgcctcccaaagacttggaagtacaggcatgagccactctaccctgacaggtttgtaattttttaatttttttcttgaacttttaagtcaggagtacatgtacaggacatgcatgtttgttacctaagtaaacaagtgccatggtggtttgctgctcagattatcccatcacctaggtattacacccagcacccattagctattcttcctgatgctctccttccctccactccaacctctgacaggccccagtgtatgttgttttcccccatgtgtccatgtgttctcatcattcagctcccacttataagtgagaacatgcagtatttggtattctgcttctgtgttagtttgctgaggataatggcttccagctccatccatgtccctacacaggacctgatctcattcctttttctagctgcatagtattccatattgtatatatgttccacattttctttattcaatctataattgatgggcatttaggttgattccatgccttttctattataaatagtgcttcaaaaagttgttgagatacttgaagaactggtagtcagttggcaagagctcaggtgaatatgacggaagaggtaaaaatttgtagcccaattcattcaacttttgaagcattgtttgtgcaatgtgcagtcgggcatcgtcgtggagaagaattgggcccttcctattgaccaatactggctgcaggcattgcagtttttagtgcatctcatcaatttgctgagcatacttctcaaatgtaatggttttactgggattcagaaagctgtagtagatcagaccagcagtaaaccaccatatagtgaccatgaactttttttggtataagtttggctttgggaagtgctgtggcacttcttctcagtccaaccactgagctggtcatcaccggttgttgaataaaatccacttttcatcacacatcacaagttgattgagaatgattccttgtagcatagaataagagaagatgatgcttcaaaatgatattttttattttcactcagctcctgaggcatccacttatcaagctttttcacctgctttttcacctgcttcaaatgccaaatgagttcttcagcaacttctcatgtagttgtaagaggatcaccttcaatgattgctctcaattggtcgttgtcaacttctgattgccggccactatgcttctcatcttcaaagctctcgtctcctttgcaaaacttcttgaaccaccacttcactgtacactcattagtcattcctgggccgaaggtgctgttgatgttgcaaattgtctctaatgctttacaacccattttgaactcgaataagaaaatcgctcaaattttctttttgtctaacatcatttccatactctaagataaatataaaataaacagcaagtaagaagtcatttgcaaaaaaacatggataaagcaagaaaaatgcattaaaatgatatataacataaccacatttacttaggaatgtattccaatatcaaatgcaaatttcaacaatgcaaaaacctcaattacgtttccaccatctcagcctcagcccagttctgtgcccttgctggagaggtgttgaggtcatttggaggagaagaggcactctggctttttgagtttttagtgttttggcatcgattatttctcatccttgtgggtttatctacctttgatttttgagagtgttgacctttgaatcaggattttctggagtctcaaatgttgaataggagtggtgagtgagggcctccttgtcttgagccacttttcaaggggaatgctttcaagattcgcccatttagtatgatgttggctgtgggtttgtcatatatggcttttattatttagaggtatgttccttcaatatctagtttagtaagagtttttaacatgaagcaatgttgaattttattgaagcccttttctgcatcaattgagataatcatgtggtttttgcctttagttctgtttacatgataaataacattgattaatttgcatatgttgaaccaaccttacatcccagggatgaagccaacttgatcgtgttggataagcttcatgatgtgctgctagatttggtttgccagtattttattgaggatttttgcatcaacattcattaaggatattggcctgaaattttctttttttgttgctgtttttgtttttaattttttaatttttgtgggtaaataataggtgtatatatttatggggtacatgagatgctttgatacaggcatggaatgcataatcacatcacataaaacaggggtatccatcatgtcatttatcccttgtgttacaaacaatccaattatactcttttagttactttaaaatgtacagttaaattattgttgactacactcaccctgttgtgctagcaaatactaggttttactcatcctttctgtttttttaacttctttttttaattaattattatttttttaattctactttaagttctagggtacatgtgcacaacatgcagatttgttacatatgtatacatgtgccatgttggtgtgctgcactcattaactcattatttacattaggtatttctcttgatgctatccttcccctctccccccaccccacacaggctctgtgatgttccccaccctgtgtctaagtgttctcattgttcaattcccacctatgagtgagaacatgcggtgtttggttttctgtccttgcgatagtttgctgagaatgatggtttccagcctcatccatgtccctacaaaggacatgagctcatcctttttcatggccacatagtattccatggtgtataggtgtcacattttcttaatccagtctatcattgatggacttttgggctggttccaagtctttgctattgtgaatagtgccacaataaatatgcatgtgcatgtgtgtctttacagtagcatgatttataattctttgggtatataccctgtaatggaattgctgggtcagttggtatttctagttctagatccttgaggaatctccacactgtcttccaaaatggttgaactagtttacgctcccaccaacagagtaaaagtgttcctatttccacacatcctctccagcacctgttgttttctgactttttaatgattgccattctaactggtgtgagatggtatctcattgtggttttgatttgcatttctctgatgaccagtgatgatgagcattttttcatatgtctgttggctgtacaaatgtcttcttttgagaagtgtctgttcatatcctttgcccactttttgatggggttgtttgattttttcttgtaaatttgtttaagttctttgtagattctggatattaacccttcgtcagataggtatattgcaaaaattttgtcccattctgtaggttgcctgtccactctgatggtagtttcttttgctgtgcagaagttctttagtttaattagatcccatttgtctattttggcttttgttgccattgcttttggtgttttagtcacgaagtacttgcccatacctatgtcctgaatggtattgcctaggttttcttccagggtttttatggttttaggtctaacatttaagtctttaatccatcttgaattaatttttgtataaagtgtaaggaagggacatagtttcagctttctacatatggctagccagttttcccagcgacatttattaaacagggaatcctttccccatttcttctttttgtcaggtttgtcaaagatcagatggttgtagatgtgtggtgttatttctgaggcctctgttctgttgcattgatctatatctctgttttggtatcagtacaatgctgttttggttactgtaggcttgcagtataatttgaagtcaggtagtgtgatgcctccagctttgttatttttgcttaggattgtcttggctatgtaggctcttttctggttccatacgaactttaaagtagttttttccaattctgtgaagaaagtcattggtagcttgatggggatggcattgaatctatacactaccttgggcactatggccattttcaccatattgattcttcccatccatgagcatggaatgttcttccatttgtttgtgtcctcttttatttcgttgagcagtggtttgtagttctccttgaagaagttcttcacatcccttgtaagttggattcctaggtattttattctctttgaagcaattgtgaatgggagttcactcatgatttggctctttgtctgttaatggtgtataagaatgcttgtgatttttccacattgattttgtatcctgagactttgttgaagttgcttatcagcttaaggagattttgggctgagatgatgggattttctaaatatgcaatcatgtcatctgcaaacagggacaatttgacttcctgttttcctcattggataccctttatttctttctcctacctgattgccctggccagaacttccaatactatgttgaatgggagtggtgagagagggcggccctgtcttgtgccggttttcaaaggaatgcttccagtttttgcccattcagtatgatattggctgtgggtttgtcatgaatatctcttattattttgagatacatcccatcagcacctagattattgagagtttttagcatgaaagctgttgaattttgttgaaggccttttctgcatctattgagataatcatgtggtttttccctttggttctgtttatatgatggattacatttattgatctgagtatgttgaaccagccttgcatcccagggatgaagccaacttgatcgtggtggataagctttttgatgtgctgctggattcggtttgccagtattatattgaggatttttgcgtcaatgttcatcagggatattggtctaaaattctatttttttttgacgtgtttctgctaggctttggtatcaggatgatgcttgcctcataaaatgagttagggaggattccctctctttctattgattggaatactttcagaaggaatggtactagctcctctttgtacctctggtagaatttggctgtgaatctgtctggtcctggactttttttggttggtaggctattaattgttgcctcaatttcagaacctgttattggtctattcagggattcaacttcttcctggtttagtcttgggtgggtgtatgtgtccaggaatgtatccatttcttctagattttctagtttatttgcatataagtatttatagtattatctcatggtagtttgtatttctttgggatcagtggtgatatcctctttatgtacccatttcttctaggttttctagcttgtgtgcatagtgctgtttataatagagtctgagggtgttttgtatttctgtgggttcagtggcaatgtcccctttgttgtttctgattgcatttaattgcatcttcttttctttattattctagctagtggtctatcttattaattctttcatagaacagctcctgtattcactgttcttttgtacgggggtgtgtgtgtgtgtgtgtgtgtgtcttaatttccttcagttcagctctgattttggttatttcttgtcttctgctagctttcaggttaatttcccttgtttctctagttcctctagttgtgatgttggtttgttaaatcgagatctttctaaagttttgatgtggatacttagtagtgtaaacttccctcttaacatgctttggctgtttcccagagcttctggtatgtttatcctttttctctcattcatttcaaagaatttcttgaatcctgccttaatttcattatttacctagaagtcattcagaagcatgttgtttgattcccacttaattgtatggttttgagtgattttcttagcattgatttttatttttttggcactgtagtccaaagaatatggtaagtatgatttttttgttgtttttttaatttgcagaggatggttttatgccaaattacgtagtcaattttatagtgtgtgtcatctgcagatgagaagaatgtatattctgttgtttgggggtggagagttctgtacatgtctattagttgcatttggtcaagtgttgaatttgggtccaaacatctttgttagttttctgcctcgatgatttatctaatactgtcagtggggtgttaaaatctttcactattattgtgggatgtcttaatctttttgagggtctctaaaaattcgctttatgaatctggatgctcctgtgtggggtgcatatatagttaggataggtaggtcttcttgttgaatcaagccctttaccattacataatgctcttgtcttttttttaatctctgttattttaaagtctgtttcttctgaaattagaacagcaacccctgcttttctctgttttccatttgcttggtcgatttttcttcatccctctactttgagcctatgggtgttatttcatgtacaatgggcctctcgaagacagcgtaccactgggttttgcatctttatccaacttgccaactctgtgtctattaattggggcatttggcctgtttgcattcaaggttagtattgatatgtgtggattcgatcctgtcatcatattgttagctggttattatgcagacttctttgtgttgttgctttatagtgtcactggtctatgtatttaagtgtgcttatgtagtgattgataatggtcttttctttgcatatttagcactcccttcaggacctcttataaggcaggtgtgttaaattccctttgtatttgcttatctgaaaaggattttattactcctttacttatgaagcttagtttggctggatatgacattcttggttgaaaataggctcccaatctcttctggcttgtagggtttctgcttacaggtctactgttagtgttatggggttccctttgtatgtgatcttccccttttctctggctgcctttaacattctttctttcattttgaccttggagaatccgatgactgtgtgtcttggggttggccttcttatgtagtatttcacaggttttctctgcatttccttaattttagtgttatatagtgttcttaaatgtatgatttttttctca

SEQ ID NO: 137 - DNA, 7050 bp, Homo sapiens
tacttttcaacaaaatgtctacactcaatatgcctaactttatacctaccactggaaaagtactatattatatagaaatatttaaaacatactatagaaattttctttaaaaattaaatatggtaatttctgggataacaaaaacacatctgaaaatattttaatatctcttgctcttcatgttatcaagaaacacaagtgaaaaaagaaagaaagaaagaaataggtactaaagccaattcttataaacaaaaatattttctattaatagttccatagtgcaatataaaagtgtaactgtgtggaaaagttaagggtgaatgctgagtgcaagagagttagaaaaagcactaaaacctttaactgaaaaagtggagaagacttcttaccaatgtgacatatgagacactataaacataatataaaacacaaaatgtagtggaatgttccctaaatccaaaagtggcatgaaagcacaaaactgcatatagattggattacctgaagttttactcagctctgctgaaaatatagcagatggtgatctgtcctctttttctgtatcggaaggaagttttttctcagcttctttcacaagaactttgggtttaactatgctctctatctctgcttgagtggccaaagcagaaacatctggaggcaataagagcacctttgatgtagcagacccatttttagaaaagtcatctgagaaactgattttctcttcaactttgggttgtatgttcttcaaagaaaggtcatggggcaattctgtgcaaggcaatgacccagctccatccggggcattagcaatttcacttttgtgggatacttctaggtcagtatattccctggctaatttagaaaatgaatcagttttagaactgatcaatgtagggaactcatctataatttcaattggagatgaatctgaaaacgtttcagtttctcttatctgtgcttccttagaaataaataagtcatcatttgaataaactgcagtactgagctcctccatctgcaaaggaattttctcctttttgctcaatgttgaaacttcatcaggtaacagggtatcttttgtgttatctaaactgagcttaaaagattccaaatatggctttcctccctcaggtggcaaagcactgagtttttccttattttcatattctatcattgactcaaatgaagtctcagtgagactttctttcacaagcatcacagtttcatcttgtttttgtggaacgtcaggtattgaatcatcactaaataagtcaactggttcagaatcaggtgaggaatcttcaactagctcagaatgatcaggcactggctgttcaacttttgccatttctgaataatcagagaaatccggagctggttcagcagaaagctttgtttctttaattaaatcacatgcaatagatatataaggagcttctgtttcttgaagagctgcattaatattttcaggctctttaatttcttcctttattcctgatactttttttagtgatacactcatggcctcttcatatggtggggggttttcaggctcatgttttatgctttcataattaactgaagaagcttctaatggtgatgagctgggctgtatcacggaagcaccagcactaggaactgcagaattcaatggtgcttccataacaatgtcaggcaaaactggtgaaggagtagcttctgactcttcaaatgatgggcaaagctgtgctgcaggatagagtgactcttgcataacttctgatgtttgaaccaagtccatttttgtttcataagcaatctttgtaccagtaacttcattcaattcactttcacatgcttcctgtactaaatctggagtcaggccttcaggcatgtttgccacgacttcctcagtcacctttgttaaattatctgttgtgacataatctgtctcagaatcctgtgctgctacaagaaaagggtttgatgttttggtgctagtattcttctctgttactatttgggccttcttttcttctatttttttttcatcggtcttattttctgaagtaggatctcctaacaaaggaaaaatgtttgttgcaatgctctcagttgctgctgggttaaagggagcacatgtgatatatgctcctgaacgatcctttataccttctggcgtactggggaaagaagtatcatcattactactctcactatctttttcgtgattagtttgctcaaggctatctgcaaaacattttttatccactttactttccaagttgctctcgattttacctccagcagccaacatatcactatcttccttactatctttcacttcccatactcgctcaaatggtttgaagtctgcatattcctccctcataggagcttccactgcaactctcttttcattaaaactgtcttttgctttttctgaagacacaacttcatcctctttaaccaatttagtaagagctgtaggtaactcttgttgattatgaaggatgttattactaactaacttctcttcttcatctttatttttcacgattatttcttccctaggatttgctactattacggcagattctgcttttggagagacactgaacgatgatcccatttctgagtattctaattctgaaaactctgttaaatctctatctatgagtagagtttttgccttctctgagacctctttagaagcttcactgacattttcttgaagtgttccttcagtgggtaatactgttgacaaattaccaaggtattcatgttctttgaaagaagcggctgagagaggagacagagaaggaagagaagcagcagtttcaagcaggacagatgggaaatcctcttgaccagccgaaatagtgttacctggctgctccttcaagtccatattttctgtgaccatggacagaaaggaaagttagagaatgccagtgttctcagagttaatgcaagttttatgacagatccaaaatagtgttagtaaagacttactgtttactaaaatgaaatgttaatagcaattaataagtaacaatagagtagacttcaatcattactgaaaatattaagctattgtaaatataacatatgcatggctacagaggcaattacatgctgtgcaaagacaaatcaagtctgagtaaacctcaaatgttatcaactaagatactaatagctagttttagagaagagaagaatatctgtgaaaagagtttcggtgacagcataggaaagaaggggcactgggtaaatgccatagactggtatttatttacaggaaagcctttctggctatactcaaactgtatttggagaaagggaatggtaaatatgtaaatgtaattcaagggtccaagaattccttatgtacttccaagtattcatcagattttgctcatttttcccttgggcataccatataaaatgcacatttcaacttttccagtagacaaaacattctcggaaccatgctaatttttagtaaacccaaactactctgcatagtgttaacacactaaagagttaaagttagaatacagagaggataaaaggctggcagaaagaacttgcctgcagaggagcgtatcacaggctcagatgcagcaggaagagcaaaaagggtctcatctgaaaaacaaatagaatataacctcagcagaaataaagacagattgaaaggagactaaagataagaggagcaagccagggttcagtttgtaataagttaacaaaaaactttacagagaaagggccaagatcaaaaggaagtcagaaaaagtagtaccattaattcaggttaaatcatcatatgtattataaagctaattaaatgttatccatagaacctatcatttttcaagaggcaatacaacctgtttatgttaaagaaacttatgaatcaaagtggctttaaaatactgttctacttaacatatcacatcccaagctttcactcaggttttcacataggtaaattgtcttgttctattcaggccaaaaacaaaaagctgaatttgaatacaattaacaactacaaatgtttaatcttttgttattggcatatattcaatttaaagaaacacttttaaagaattatgcattttctcttacattctaagttgttacagtcattgtacattgctctttgaagacattagtcctgtgccaatgtccaaatgccagagtccaaaatacaaaaaaaaaaaaaattaactgcctttaggatgacaccattattggttttgcttaaaattaacctaagtgagggctacttgttatttgtatacacaactagtaagtgagagactaaggcaattcaattccagagcccatttccttaatcactgtatgttacagaactgaatgcttatatttcctacaaaactcatgttaaagccccaacccctaaagtgatagtatctgaagatggggactttgggaggtgattagggttaaatgcagtcagggtggggccctgggccaaggggattaatgcccttacaagaagagacaccagagagcttgctgtcatgctccctgtctccccaggcacacacaagaggtcatgtgtgcacacagtgagatggtggtcacctataagccaggagaagaggcctcaaaaagaaatctaccttgccagcaccttgatcttagacttaccagcctccagaattgtgagaagtaaatttctgttcagccacccagcctatggtattttgttacggcagcccaagctaactaatacactctatattggtaatattaactttgtacaatgtcatcttgtacctgcagttgggagatcctaagctaaagatcttccatggtttacactagagaaaggcctctaccatcagacaatttgaaacagcctgagagatgactggaaggtgatattcctttaacagagagaacctaataaatttagacaatttcatctggatggacaagctagacaaggctgatcaaaacagataaaaatccaagaaatgtagctaacatgaatacggacttgtcttccaagcatattacccttaatgaattaggagagctaacttcacaaggtcttatatattttagataaatatatactgggcatgaagtcatacttaaaggattcctagatgagggtgatgacgggaaatttatgatgtgtgtttaaaagggtttcctccaacctagagcactaggtaggatgggctatccagtcaaaggggtaacataatggcttataagatttttaaataaagtgcatatatatgtgtacacatatttaaaagattacttgctatgtgatcttaaattacagtttctcatttgtaaaatgaaggaaagttcccttcagctaaaataatgaattattagcttgtataaaactgaaatttgagggtcaaagagcagaaccaaataattacgcagctgctccatctaaataacagttaaccaattcttaacaaaatggttgtcttttttatctagacaatatagttaaaagccactaattcagaggctagtctatctggaaagtgaactagaaacatatattactgttaaagttagtgggaaaacaaactacatctaaatttgtgccataattttaaagtatttttttaatgtactgtactcttattcctacctagtgcaataatcttttataataaaaactatattcctggaatttttctaagtaaaaaagttttcaaattggtatttcaaagattcattatgtttaagaaaaaaagaaaaatcttcattttgtaaaatgggattcgatccagttacccataaaacaagtactacatttctaaaagctctttaaaaaaatccagaatagttaactatcttctgggacttcaagaatacagttcagactcctaataaagcaatcacagatcatgaaattgaattgcctaagtccaaatcacaaatccatcacttacaactgtaactcttagcctttctgtgcctaatgaaacttgtaaaataaggataataagagtacccacctaaaaatgttgtgaaggagggagagggaaagaaaaaagaagaaacaacttgccctaagtcacagaactaggaggccagagggtcaaaacatctaattcccaagtctttgtgctttataattattattattttttggctaggcttcctcaaagcacgagatgtgcttcatcttctgaaggatgtatttatgtacaagtgcaactggtgcaatccttcttactgtatcagcccctcaagttagttctcctgaaacaaggtaaatcgtcacccagtaaataccttgtaattagcagaaatattgcattgatcaattgcttctattttacaatgtaacaacatttatagaaacattaatgtgggacaggtactgtgctgagccggcacatttgtttcagatgttcattctgttctcaaaactaccctgtaaggtaggtactactgttacccccatttcacatacgagaaaagaggcatttaaatcatatctaattacaatactacaaaaaacctgcattttaaaaccatagaacttctgcttctggctatgagagtaattacaacagactaattcttccaatataagcaactaaaaatatgggcaaaatactagaagcaactatcttgagacactggacaagaggcaggacagcagtgtgaatcctgagaaaagggaaacctgcaagatgactacgctgctttctgtctgaaggcacattctggtctacagtacagagagaagcctaagaataccgcactcttgctaagctgaggaggctgaggagttgtctggaatttgtgagacagggtaacatacaaagtaaagcctcacagaaaaggagctccaaaaatctggataggggttcctcttaaacctctgggtgaatactacgctgcatgtgcacagcacaagactcggcaaggcctagccaagaaacctatggtagagctgcaaattaactggattatatcgaaggtcagaaagtgctgaagacctgatctaaaaattctgaccagtcagaaaggaaagatctctct

SEQ ID NO: 138 - DNA, 72168 bp, Homo sapiens
cacagacattttactaatacattctatcaaaccaatttaaaagttactcaaaaactaagaaagaaagcataaaactaaaagtatacaaaatataaaaacaagtgtagtgaagtgaataacgtccccacaaaatctatgtcaacccagaatctctgattgttatcttatttggaaataggatcttttcagacgtgactagtgaaggatttgaagatgaaatcttactggatttagggtgagccctatatctaatgcctggtatccttacaagaagaggagagcacacacacacacacacagagagagagagagagagagagagagagagagagagagagcaagcgagcgcagccatttgaagacagaggcagagactggagttatgctatcacaaaccaaggaacatcaggagccacaagaaggtgaaagagggctgggcacggtggctcacgcctgtaatcccagcactttgggaggccgaggcggggagatcacctgaggtcaggagttcgagaccagcctggccaacatggcgaaactccatctctactaaaaatagaaaaattagccaggagtggtggaacacacctatagtcccagctacttgagagactgaggcaggagaatcacttgaacccaggaggcggaggttgcagtgagctgagatcatgccactgcactctattctgggtgacagagtgagactccgtctcaaaaaaaaaaaaaaaagcagcagcagctggaagaggcaaggaacagattctccactagagccttcagaagaaacatggccctgatggccctttgatttcaaatttctcacctccagtactggcaaagaataattttctgttgctgtaagtcattgagtctgtggcattgttacggcagccctagaaatggatatagttagtttatcagttgaaaagtggattttctaaagaagtaccaaacagtaatcatagagctgaggaatagtataactgaactgaaaaattcaataaaggggttcaaccacaggctacatcaagcagaagaaaagattagtaattagaagacaggccactggaaatcatacaatctgaagaagaaaaaaggataaagaatgaaaaacagtggtcaggcatggtggctcacgcctgtaatcccagcaccttgggaggccgaggcaggcagagcacttgaggttaggagttcaaaactggcctggccaacatggtgaaaccctgtctctactaaaaatacaaaaaaaaaaaaaaaaaaaaaaaaaagctgccagtggtggtgcacgcctgtaatcctagctacttgggaggctgagtggaaggatcacttgaacagagcaggcagaggttgcagtgagccaagatctcaccactgcactctggcctaggcaacaaagtgagactttgtctcaaacaaacaaaaagaaacagaaaaagaaatggtaaagaaacttcttcaagctgaataaagaagacactaatgagtgacaggaaaacatgaaaagtataaaactcactggaaaaagtaagtatactgtcaaccccaaaacacactaatactgtaatggtggtaagtaaatgaattatatatctagtataaaggttaaaagataaaactattaaaaatagttaaagctagccaggcgcggtggctcacacctgtaatcctagcactttgggaggccgaagcgggcatatcacctgaggttgggagtttgagaccagcctgaccaacatggagaaaccccgtctctactaaaaatacaaaattagccgggcgtggtggcgcatgcctgtaatcccagctactcacgaggctgaggcaggagaatagcttgaacccaggaggtggaggttggggtgagccaagatcacgccactgcactccagtcccggcaacaagagtgaaactccatctcaaaataataataataataataataataataaagctacaataatttgttaaagatacaaattattttttaaatgtatatcgtgacatcatgaacataaaacatggaagagggggagtaaaaatgtagaatgtgtgtatgtgatcaaagttaacttgttatcagcttatataccagttataagatgttttgtgtaagccacagggtaactacaaagcaaaagcctttgcttttgcaaaagataaaaagaaaaaatccaaagtggaccactacagaaagcaatcgagccacaaagggggaaagtaatagagaaagggacaaaggttctacagaaacactagaaaacaattaacaaaatggcactactaagtccttacctatcaataattacttccaatgtaaacagattaaattctccaaacaacaggcatagagtggctaaatggataaaaaacaagatccaactctgcgctgcctataaagagactcacttcaccataaaggacactcatagactgaaaatgaagggactgaaaaagatattccatacaaatgcaaacaaaaagagaacagagatagctatatttatttcagacaaaatagactttaggtccaaagagaacaaagctggaggcatcacactaccatgtttgaaaatatattacaaacctatagtaattaaaacagcacggcactgacataaaaacagacatgtccaccaatggaataggatggatagcccagaataaatgcatatatctataatcaatggatttttgacaaaggtgccaagactacacaatgtggaaaggacagtctcttcaataatgtcatttggaaaactggatagccacatacagaagaatggaaatggacccttatctcaccccttaacaagtatcaacttaaaatggattaaatttaggacctgaaattacaaatctactagaagaaaacttaggcgagaagctccatgacacaggtttgggcaatcatttcttgtatatgatcccctaatgcacaggcaacaaaagcaataataaacaaatgggatgacatcaaactaaaaagcttctgaacagcaaaaaacaaacaaacaggccagacgcgtaatcccaacactttggcaggccgaggcaggcggatcacaaggtcaggagttcgagaccagcctgaccaacatggtgaagccctatctctactaaaaatacaaaattagctgagcgtagtggtgcacacctgtagtcccagctactcatgaggctgaggcaaaagaatcgcttgaacccgggaggcggacgctgcagtgagccaagatcacgccattgcactccagcctgggtgacagagggagactgcatctcaaaaaaacaaacaaacaagcaaaaacaaatagagtgaagagacaacccaaagactgagaaaacgtatttacaaatcatgcatcagatatatagctaatatccggccaggcatggtggctcatgcctgtaatctcagcactttgggaggccgacgcgggtggatcacttgagcccaagaatacaagaccagtctaagcaacacagtgagaccttgtctctataaaacatacataaattagccaggcgtggtggtgtatgcctgtagtcccagctacttgggaggcagaggtgggaggatcgcttgagcccaggaggtcaaggctgcagtgagccatgatcatgccactgcactccagcctgggcaacagagtgagacactgtctcaaaaataaaaataaaaaaaaagacaaacaaatggccaacagatagatgaaagaatgctgaacatctctaatcataagagaaatgcaaattaaagccacaataaggtatcacctcacacctgttagactggctattatcaaaaaggtgaaagataagtgttagcaaggtcacagagaaatggaacacttatacactgctggtgaaactataaatacagccattttgtaaaacagtgtagaggttcctcacaaaactaaaaatagaattactatatgatccagcaatcccattactgagtatatatccaaaggaattgaaatcagtatgtcagaggtgtctgagactcacttatatttggaatctaaaaaagtcaaactcacagaagtagagagtagaatggtgattaccagtagctggggtaagtggggctggaggggaaaaggaagatattggtcaatggctacataaaattacagtcaggaggaacaggatcctggtgttgtattgcatagcatcatgattacagtaaatatattaatttttcaaaagagttaaaaaagggaactttaaatgttctcaccacaaagaaatgataaatatttgaggagatggatatactacttggcctgatttgatcagtgcagaatgtatacatgtatcaaaacatcacattgtgccccataaatatatacaattgttatttattaaagatagattttcttttttatttacttatggtaggaatggccttcattggttgcaataggaagcgaaagaggagacctgaaatcaaatgaaaaagcgtaagcatcctggggagaagcccactggatctcagttctgccctgctcaggaaagttcagtatccaggtgactgagaacagaaccggctggcaccaaagacatgattttgagggggccggagccctttccctttgcctccatacataacaggagcaggaccacacactcagtccctgacaagaaaaggagggtggattttctaaactatgatattcaccattaaaattaacaagttaacagaagtaatattttttgaaaacaggttttctaattgtactacacatgatcatgacttcttaaatggaacacatgtacatgaagactgggaaccaaacaaatgttaacttatgagtatcaactgctccttataccctcacacagtgacagcagtgggagttatttagcaggatagggctttttgctcccagcctatagtgttccagctcgtgtggttttccgctttttgaatttgtatcccagccttcatagtctatcaggagtcaactctttctttttttttttttttgttgttgttgttgttgttgagatggagcctcgctctgtcgccaggctggagtgcagtggcacaatctcggctcactgcaacctctgcctccggggttcaagcaattctcctgcctcagcctcccgagtagctgggacaacaggcgcatgccaccacacccagctgatttttgtatttttagtagagatggggtttcaccatgttggccaggatggtctcaatatcttgagctcgtgatctgcccgccttagcctcccaaaagtgctgggattacaggcgtgagccaccacacccggccttcagtagcataatactttttaaaatatggcatctaatagcttaggagacactcacattatcacatttgagcataaacctatgatggaggtattgtcttttacagataaagaaactgaggctctaagagattctgtaagttgtggaagtaaagctattgtgatcaagttgggacaggtcttccgactcccaagtcttttgacctatccactctccccaccatcactgtgcagtgagagggacaaagggcttggcatggtatcagaaactaaactgttttctcaaaaccaggctaaatattctccccagtgagtaaactcagttgtagccaaactaaatgctgttccatagtcaatcaatgaatgtagtaaatggactctgtcaggcatatgcactactaagggattcccccctttttcaaaattcaaactttattcttcagactgtcagtttttagaatagtgctaaggttttgcttttaaatgaaacggaagacagatattttggccacggaagacttgcacattactcagagcaaatattaccagcattcacaatgtccccctcacaagaatagcagattagtcaactaaatattagctaacaaccatgctattgctatctaaagggaactttgtctaactgcataacattgtaacaaatgctcttctaattagatatataatcctgaagggaaacaagatcatactttgaaacagaggattttaataggacagagaagcagcaaagatagaaatatctactaaagatattctagacacctaaccatttcattcccactttaaaattgaaagaataaaaacgtgttaaggaaatagcttaatcctggggaagggtgggctttaaaagctatagatcgtaatttaagaaagcaaacaaacatttcaagcacaccaagggcattccaaatacccatgagccaccatcagcttaagcaataaaacattacaaatacaactcaagccctgcatgactcctcccagattcccttatccttcatctgtcctcagaagtaaccactatcctgaatttggtgtttgtgtttcccacgtttaaatatttttacatgggtaggaatccataaaaaatatagtaacattatttttcatatttatttttacaaatgtcattgcatatattttgataacacaatacctgcactatacacacagttcaaaagtacaaaagcatctatggtgcaacacaatgtcctcctttacctagtcccctatactgagcaactaacgtaaccagtcttgtgtgtatctttaaagagacatactctatatataaaagcagtcacatttaagatacagatttgcccctgccttttatacataagtggtaggcatattgaacacactgttctactttttcctcttaaaaatacaccttggaaattgttctctaaaatatacaaagttcctccctttttcttccttaatgtttgcaaggtatttcactatatggataaaccataactattactattagaaaggttacttcgaaagttttgtattaatatttacaacaatatggcagcgaataacccattatttcatacacgagtacatctataaaataattcctagaagttgaattgttaggttaattttaataaatgctgtcactctctcatgtagaggtaggataccaatttatactctaccagcattgtatgagtggttctgtaggtttctaaaatttatataaataacagcaaactatacatattcttatacaacttgctttcgaggtctaaccttatatttttaagattcattcacactgatatatatagctctagttcatgtttataatttttacttaaaggaatttttaaataacttctactatgattcattcacaaagtacctatgtagctgaaattgcagttttacacagaaatacttacgaacttaggccaagcatggtggctcatgcctgtaatcccagcactgtgggaggctgaggtgggtggatcacctgaggtcaggagttcgagactaacctggccgacgtggtgaaaccccatctctactaaaaatacaaaaaaaaaatagctgggcgtagtggtgggcgcctataatcccagccacttgggaggctgaggctggagaatcgcttgaacccgggaggtggaagttgcagtgagctgagatcgcaccattgcactccagcctgggcgacaagagtggaactccatctcaaaaaaaaaaaaagaaaaagaaaaaaaagaaatacttgccaacttaatagtttatatgtataaataactcatttgccgaagatacacccagcctaccaaagagaccatcttctctagaaaaactaacaaagactgccattttaatgatattactctgctcatccatgctttttttgggcagagggaaggcccacaagggcacagaacctaacatcttgataactagaaggaaaaaaaaaagatgccttggaaacaataaagacaattcaagcataatcacaaaataaccctagttttctgtaaactttcctctcaaaatgctaccactaagtaaccaaacaaattttttggcctgtaacaggaaacaatcactccgaacttccagcctactctccccgcaaaattaaatttcctataagcatggaatatcatacttagactttttctgcatatcaatatcatatattttattagatccctcttcatgttaaatttaccaatatgtataagtaatttttaaagctttctttactccaaattgtctaaacatatggttaaccctattatttgcaagaattcttgcataattaaggctgttggtgtttaattaccaacatcaccacaatagtggccatttctgtgtgttcactgagtatccatgtccccctttctctctcctaacaacatccatttatgtgtaggtgtctaccctgtccccccacactatccaagtacttagaagatgtctcccagcccagcacggtggttcaggcctgtaatcccagcactttgggaggccgaggcgggtgggatcacctgaggtcaggagttcaagaccagcctggccaacatgatgaaaccccatctctactaaaaatacaaaaattagcaggacgtggtggcacacgtctgtaatcccagctactagggaagttgaggcagaagaatcacttgaacctgggaggcagaggttgcaatgagctgagattgcgccaatgcactccagcctgggtgacaagagcaaaactgtctccaaaaaaaaaaaaaagtgttccctgttcaccacatgcacactaaaatctatctactgctttttgattttttgatgatggccattcttgcaggagtgaggtggtatcacattgtggttctgatttgcatttccctgatcattagggatgctgagcattttttcatgtttgctggccatttgtatatcttcttttgagaactgtctattcatatccttagcccactttttgatgggactatttgttttttcttacttatttgtttgagttcattgtggattctggatattagtactttttcagatgtattgattaggaagattttctcccactgtgtgggttgtctgtttactctgctgttccttttcctgtgcaaaagctcttcaatttaattaggtcccatctatttatctttgtttttattgcatttgcttttgggttcttagtcattaaatccttgcctaagccaatgtctagaagggtttttccaatgttatcttctagaatttttatagtttcaggtcttaggtttaagtccttaatccatcttgagttgatttttatataaggttgagagatgagaatccagtttcattctcctacatgtggctggccaattatcccagcacaatttgttgaaaagggtgaacagggaacacttctacactgctggtgggaatgtaaactagcacagctgctatggaaaacagtgtagatattccttaaagaactaaaagtagaactaccatttgatccagcaatctcttctgaaaagaagtcattattcgaaaaagatacttgcacatgcatgtttatagcagcacaattcacaattgcaaaatcgtggaaccaatccaaatgcccatcactcaatgtatggataaagaaactgtggtgtatacatatatatacacacacacacacacacacacacacaaaatggaatactacacagccataaaaaggaatgaattaacagcatttgcagtgacttggataagagtggagactattattctaagtgaagtaactcaggaatggaaaaccaacacagtatgttctaatcactgatatgtgggagctaagctatgaggacgcaaaggcataagaatgatacagtggactatggggacttgagggggaagagtgggagaggggtgagggataaaagactacaaatatgatgcaatgtatactgctcaggtgatgggtgcaccaaaatctcacaaatcaccactaaagaatttactcatgcaaccaaataccatctgtaccccaataacttaaagaaaaatttaaaaaataaaacaaattttaaaaaaaagatgtctcccacccacccacctctgttgcacacacacatcaaagggtgggtcatactcctccaagggcaatgccatcccccttgctaatgcctgcttaggaatacaagcataagccaactggcacatggcattcctagccagagggactggatgagccaatgagactcataagagatatgctggccttccctgctggaaggacttatctgtggaaagagaaccacagataagttctttactaggcaaagctagattttctattacttgtggcaaaaagcatcccaactgttaacttaaaaaatgaacaggttaaagattctgatcaacatcaacaaatgtgatcatgaacaaatttaaccatatctatgaaacctatgatccttggactaatattggcctttgtacatttggagagtttgttgactttaacagaatatggtactccaagagaagttagtgtgggtggggaagtgaaggttaagaaacagcaaagtcactggagacattcgtgtcacagccatatcacagatcaaatccagaagatgaaaaatctcttcctgctttactacctgccatgccaaaaaccacttagcaaatacgaaaacagacctggccgggcacagtggctcacgcctgtaatcccagcactttgggaggctgaggtgggtagatcacctgaggtcaggagttcgagaccagccgggccaacatggtgaaaccccatctctactaaaaatatgaaattagccgggtgtggtggtgggcgcctgtaattccagctactcaggaggctgaggcaggagaactgcttgaacccaggaagcggaggttgcaatgagccaagatcacaccacacggcactccagcctgggcaacagagcaagaccccatctcgggaaaagaaaaaagaaaaaagaaaaaaaaatagacctgactttattcaagcattcaagtctatattaggggaatgatgaacaccctaatccaggcagaactctgggaagggatgggggcaaaaatgaacatttttttttttacaaacacttgtaaactaaaaagcagtttgtaattgctaacaagaaatatcatagccaaagataaagttaaaacttccatggcacagaaacatcttactggccttatatggacctgtcctaatagctgttattacccaattctggcatttgcttcttacttcctcctgacattgtccgccttgcagattttcataagaaggttcaggcagttgcttccctgtgggatatacaacaattttccaattctatgactcagaaaatggcaagagaaggaagcgttcttctcttctaaccctaaataaaatcagaaactgtttatttagctctggaagagtaaggctcagttgagttaccgtacagactttggcaaactttttttctttcaagtcaaatatttaccaagaacttagtatatgcaagtcagtctattatttatccaaagccaatgcatgaattatttttatcagttccaaacttcctttctctgcatcccttataacaaagtcaaatatgttaaagaaaaaaaaaatcatgccttacaaaacttgcaattaaacgtttttttgccagaattggtggactgtagagcaagtttatttccagaatagtgttttgaaagagtccacacttttcttttaatttcaatagctttaggggtacaagtggcttttggttacatagatgaactgcatagtggtgaagtctgggcttttagtgtacccgtcacccgaatgctgtacaatgcacccaatacacctttcttaaaacaaaagttcgaatgatgtgcacttaaagagtttattagaatacaaataacctttgaaaataagtggaaatgaactgtactaataaagtaataaatactatctggaggcaacatctgaactaacaacgaagtttcgcacggagaaactcctgttaattcggaaacactaaaggcacagtctcattcagaacgtaaaccatgcatcgcaaatactgaaccagtttatactcattaactgctccgaaggaaaccagtgatcctttccgacgacatggtctttaaaaaaaatgatgtcggctacccacaaagaaaccttacttctgcggaaacacatttcgcactcgggaaacagcaggggccggtaaatcgacagcctcctacagaggacggaaataccgacaacgccaaggaccgccaaggaagcgatgggctggccctgagccaagggagcacaacccgggcgcacaagatgccgcctccccggggatcgcgcccggcgccccctcccagcacccagagcgcgccgcgccgcccgcctgccccacctgggaaagtttgcaccttcgcatcccagcccctcgtacctaccagcccctcaggccgcggcgccgtcgccatggcgactggcccctaccccacccccacccccacccggcctgtgctggccgcgccgcagccccgcggcggctggggagagctcccgcaggatccgggacaggggctgcccagccctggaaagaagggacgcagcgggcgggggaggatgaagaggtgcggaaagcggaagtcgtgcggctcctcagctggggccaagcctagtcccgcggggttctcacccttcactttgccgaaggtgccgacccccagcgtgtcacccagaatgtagtggccgatcttcacccgcccgtcgtgtttctgcttctcggctgtcgccatctttctccaggaactgagtctgcgcatggcgctgcgggagggggcggagggggcgggcagggccgcgccgggggcgggcggggagggggtggggacgcgggagggcagccaccgagccgagtcaccgccctgcgccgccagcccaggccccgcagcctacgtcgggcgcagacgctccccctggcggggcgggcgggggctgccaggagaatcaccagtacccgcctcctcgccccgcatcctcgggcctgagcgcccgcccaccggcacgcggaggggcttcctggaacgattaggcggaccgtcgcccccaggctcctttctcccctggcggagtttctgcccgctgcgatcttccctaactaccactctgcggtcgcagaagaccatccagaggggagatgaggactgggaagcccgcttgagtgatgcacatctgtggcttgttacgagagccgcgtgaattaaagcaaggcaggggacaccgccctgccactgctttctaaccttgattttcatctttccttctcggatggaatctagaagccgcaggagttttcacttgcgtctgtgatggagtttcccgctccccgcccccccgcaccaacccgagctcttttttcgcttggagcccgtaagttgctagagggcaccacgatggctctaggagcgctgtcggtgttttcttctggaggtgatcctgaaatttcctccccaaagcaagctctgttgcgaggagcaggctggggatatgtgcaagtgaatgtgtattccaagagggggatgatacgcagatcttttggtgtataggaattaatacttttagattatcagtaaaatgtatactttcactggactgagagagaacaaggcttacggttacatcaaccggatcaacaaatatttattgtacttgtaatgagtaatacttagtctattatataaacataaatggaaccataccatagcataaagtctgtttatttttcataaaatgtttgagtttgttactcaattccactcctctgattagtagtcaaaatcaagtgttctgttttaaaaagtttatattctctcaattttggaatgtcatagcattgggccagtgtcaatggcccaaaaaaacaaaatttaccttcatgaaaagagtataaaaaaagaaaaaaactaaaaatgtcatttttaatcccacaaaaatcaattacccaactctcctgattttctcctctctgtttctgaaatcaaagtaacatgcattaggcactgttttgttccgaggaagatattgcaggagaagcaaaagtttctgcctttgagcttagaattacaccagataagcagggaacagttccagctagccttaatcaagttcctactgtattgaggactgcacattgtttgaagggcaaaaagttaagaaatctttgattactgatgtatttggggggcaggtggtgtagtggttactgttttaacttttggtgtctggctttttcacttttatctgtttgacttttgagtttctacacaaggcatctctgtaaagcagaatttttggattttggatctctgtaaaacagaaatagctctctgga[450 bp omitted]agaattatagatcaaaaaattggatagaaacttagacatcatcttatccagtttcccatagtctctgtttaaagcagctttaattgctcagtgttttaattttggttttgtttcttttccattcatgttgagttaaaaaccgaatccaattcactgtttgtaagactactgtcttgccccccgcccggccggccgccacgtccgggaggtgaggggcgcctctgcccggccgcccctactgggaagtgaggacccctctgcccggccagccgccccgtccgggagggaggtgggggggtcagccccccgcccggccagccgccccatccgggagggaggtgggggggtcagcccccgcccggccagccgccccgtccgggagggaggtggggggggtcagcccccgcccggccagccgccccgtctgggagggaggtggggggatcagccccccgcctggccagccgccccgtccgggaggtgaggggcgcctctgcccggccgcccctactgggaagtgaggacccctctgcccggccagccgccccgtccgggagggaggtgggggggtcagccccccgcccggccagccgccctatccaggagatgaggggcgcctctgcccggccgcccctactgggaagtgaggagcccctctgcccggccagccgccccgtctgggagggtggtgggggggtcagccccccgcccggccagccgccctatccaggaggtgaggggcgcctctgcccggccgcccctactgggaagtgaggagcccctctgctcggccagccgcccagtccgggagggaggtgggggggtcagccccccgcccggccagccgccctatccaggaggtgaggggcgcctctgcccggccgcccctactgggaagtgaggagcccctctgcccggccagccgccccgtctgggagggtggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccgctattgtcctatgaccctgccaaatccccctctgcgagaaacacccaagaatgatcaataaaaaaaaaataaaaaataaaaaaaaaattaaaaaaaaaaaaaaagactactgtcttaagaagcctcctgtattcctttgctttttctcttaattacctttttaaattttttgtcacattttcttccaccctgtcttcctttcattctcccattgatctatccccaaatgttcacttccttcattcttcaagcttttgttaactgccagacgctatagaaaattacatttttctaaaaaatgaaaagtcatagtccctaccttgaaagagctcatggtctacagtagcagtcctctatattccaccatcccccacccatccaggagagataatatttacatactcaccattctaccagggggaagcaaagataaggtagaccctggcttactcccagtttcctgacctatctgttgtaactctaccccatctcagtaaaatgtattggaatataagtgggcaggagttacattagagaagtaactttttttttttaaacaggcgtttattctgttgcccaggctagagtgcagtggttagatcacagctcactgtaacctcaaactcttggactcaagcattcctcctacttcagcctcgagagagtagctaggactaacggtacgcaccaccacgcccgactatttttatttcatttgttgtagagatggggatctccctatattaaagaggccagtctagaacccctggcctcaagcgatcctcccaccacagactcccaaagtgctaggactgcaggcatgagccaccaagcctggcctatagaagtaacttgactcctttctagtttaagtgggggaaaagcagaccgggcacagtggctcacatttgtaatcccagcactttgggaggccaaggcgggcagatcgcctgagatcaagagttcgagaccagcctgaccaacatggagaaaccccacctctactaaaaatacaaaattagctgggtgtcgtggtgtgtgcctgtaaccccagcttttcaggaggctgagacaggagaatcatttgaaccccggaggcagaggttgcagtgagctgagatcgtgccattgcactccagcctgggcaacaagattgaaactccatctcaaaaaaaaaaaagtagggaaaaagtaaattgtttgcaaacttaagcactgtagcttttatcagtacaaataaattacagtacatctcagcactgatgaagacatacgaacattgtggtggagaatgtccagcctcatggaggagctgtgtggttagcagttagcggcttcctctctagccctttagacattgtaagggagcagatgcctcctcggaggtcattacagcattacagcattactagactctacactgccaggtggatattaaacttctccagtgactatctctaaatatggtggctggaactaaaacttctgagtactacaccactattaatgcagcctaatatttccttggcttacttgtagctacattgtaactaatattttagttttgttaaacaaacactatgtactgggcagtttgctagatcctagggactcaaaaaacaaaggaacatggctctgccttctaataggagacaaagcaatgttataggtgctataataaaaacacaagtctaggcaatgtagtaagattctgtctttacaaaaaaaaaatattcagaattagctgagtctggtggtgcacacctacagtcatagatactttggaggctgaggtgtgaggatcagttgagctcaggaggtagaggctgcagtgagctatgattatgccactgtactccagcctgggtgacagagcaagaccctatctcttaaaaaatgaataaaaataaaaacatatatggtgctaaagtccgttatgagaggtcaggataacctttacctgtggaggtctgccaaagctttaacttgaatctgtttatggagaagtattaagagatgatgttttctacacacaaaaaaagggaggccacccaggcacagtggctcacgcctgtaatcccagcactttgggaggctgaggcaggaggatcacttgagctcaggagtttgagaccagcctgggcaacattgtgagacctcatctctacaaaaaatacaaaaaatcagccaggcgtggtggtgcttgcctgaagtcccagctactcaggaggctgaggtgggagaatcatctgagcctaggaggtcaaggctgcgtgtgtcatgttcatgccactgcactccaggctgagtgacaaagtgagaccctgtctcaaagatataaaaataaaaaagtaaagaaggccgggtgcagtggctcatgcctgtaatcctaacactttgggaggccgaagcgggcggattgcctgagttcaggagttcgagaccagcctgggcaacatggtaaaaccctgtctttactaaaatacaaaaaattagccaggcatggcggtgtgtacctgtaatcccactactcgggaggctgagacaggagaatcgcttgcacctggaaggcaaatgttgcagtgagccaagattgcaccaccgcactccagcctgggtgagagagcgagactccatctcaaaaaaaaaaaaaagtaaagggagaaacaggtggcatgggggatggagggaacttggggaaggcattccaggtaggaaaaagagcagatataaaatcacagagggggccgggcacggcagctcatgcctgtaatcccagcactttgggaggtgaggtgggcggatcaccaaatgtcaggagttcgagaccagcctagccaacatggtgaaacctcgtctctactaaaaataaaaaaattagctgggcatggtgttgggcgcctgtaataccagctactaggggggctgaggcaggagaatcacttgaacccgggaggcggaggttgcagtgagccgagatcgcgccactgcacttcagcctggatggcagagcgagactccatctcaaaaaaaaaaaaaagaaaatcagagggaagtaggctgtttagggaagagctaattgttacaggggctggaatctgacgtacagagggacttgttagaagaaatgagaggtaaacccactaaagttaaatagacgaaatcctgaaatgcctcatgtgcttctcagtttggacattatcttgtagagtgataagtcatggaaagatgtgcagtagatgcaatttagaaataaattattttctccaaaattggtagctgtgggtatatttgggaagagaaattaggtgactaagagtcaggggcaaggggcagacttttctctgtttaccctttgtaaatttcaatttagagccttatgcatatgttacagaatcaaaaaagttaacttttagaaaaatttctaaaaactctgactttattttggaggatatagattagagaagagcaagaccaaagtggtaaattaggaaacttgcaatcacctaatgaagaaatgaggcagccaccacgtacgaaaaggaaaaactcaagatctattcataaagtggaattagaaaggaaggaatggagtgatgtgcatagagagggaaaggaaggaatctttttttttttttttttgagacgaagtctcactctgttgcccaggatggagtccagtgacacaatctctgctcactgcaatctccgcctcccaggtacacgagattctcctgcctcagcctcccgagtacctgggattacaggcgcctgccaccacacccagctaattttttgtatttttagtagagatggggtttcactgtgttagccaggatggtctcaaactcctgaccttgtgatccgcctgccacggcctcccaaagtgctaggattacaggcatgagccaccgtgcccgtccaggaaggaatcttaattacctcccaggattctggtaggattttagaggaatggatgttcaactgaaattatgaatatttgtaacattaagacatcaaagaggccaggtgtggtggctcacgcctgtaatcccagcactttgggagggcaaggcgggcggatcacaaggtcaggagatcaagaccatcctggctaacacggtgaaaccccatctctacaaaaaatacaaaaaattagccaggcgtggtggcacgcacctgtagtcccagctgctcgggaagctgaggtaggagaatcgcttgaacccgggaggtggaggtttcagtgagccgagattgtgccactgcactccagcctgggtgacagagcgagactccaactcaaaaaaaaaaaacaaaaaacaaaaaacatcaaagagactttcaggtaaagaggtaaagatatccatgatgatactggtcatgcaggtctataactccaaagataagtcagtctaatggttaacaatgtattgtatatttcaaaatagcttaaagagatcatctgaaatgtttacaatacatagaaataataaatactcaaaatgctagatatcctaaataccctgagttgatcgttacatattctatgcatgcaacaaaacatcacatgtatcccataaatatgtggaaatattatatatcaataaaatacttattaatttattttaaaaatcagcccagtgttatagattgtttgtcatcaccgaacaaatggcaggtgaagtagagcaatgaatatggatgtggtctctccactttataaagggatccaagggcaaagcacttacttagaaaacatggataattaaaggatcctgaagcaatacaaacctgtggaagagacagaacagcagtccatttatattagaagctccccaataagttacagtgattaaaattagcttgtagaaaattgtctccccttacctatgatagatgatttctagctcctggtttagaaagagacaagctttttctttgtcacccaggctgcagtgcagtgggtgtgatcatggctcactgcagcctcagcctcgggactcaagggatcctctcatgtcagcctcctgagtagctgggaccacaggcatgtgccaccatgcccagctcatttcttaaattttttgtagagatggggtctcactatgttccccgggctggtcttcaactcctgggctaaaggaattctgcctcagcttcttaaagtgctgggatacaggtgtgagccaccgcactgggccttgaaattattttaggctaagatatttgcaaccccttcatagtgatgaattttaagctcagttgcccttgtagaacaggcccagacctattttttgtttttggttttttgtttgagacggagtcttgctctgtcgcccaggctggagtgcagtgacatgatcttggctcactgcaacctccgtctcccggtttcaagtgattctcctgcctcagcctcccaggtagctgggactacaggtgcgcatcaccatgcctggctaatttttgtatttttcatacagacagggtttcacttatgttgggcaggctggtctcgaactcctgacctcgtgatgcacccaccttggcctcccaaagtgctgggattacaggcgtgagccacacagttttcccataactgtcttctagggaaaatcttggcaccgttcacaaggactctgtcggcccatctccatgtggatgtggttggttagtcctggttggattccttagtgttaataagaagatatcaaccctgtccacccctcagttgacttgctgattatcagacgtatggatctatacataatcagcagtacaaattatattcatttgccagaagacgtaactctaaattctttggtgccctattcttatcagctaagagaaagtatatccttggatgggcacctgaagaatatgctgatagcctaaactgtacccttggatcatttgagaccaatagcaagggagagtaatttgtcctgttttttggtcactgttagaattgcttttactgaattatactttggtagtacaaagagctgataaacatgtagatgcctttagtaagctaattatttgactctccattcaaaccaggaatttagtctccctcaaaacaaaattatttaaaaatctatccaacattagctgggcgcggtagctcacccctgtaatcccagcactttgggatccgtccaccgaggcgggaggatcacaaggtcaggagatcgagaccatcctggctaacacggtgaaactccatctctactaaaaatacaaaaaattaggcaggcatggtggcacgcgcctgtagtcccagctactccggaggctgaggcaggagaatcgcttgaggcagaggttgcagtgagctaagattgtgccattgcactccagcctgggctacacagcgagactctgtctcaaaagaaaaaaaaaatctgtccaacatttatttgagtggaaaggcagagaaagaggacggctggatcagtgccccagcaaacaatgaccttgtggtaaccagactctgacttcttagacgtgtgtttgtgggttggggagttttatccgcccctgaccaagtggtttgtcaaagtagttctgtttaaccacatccctctgagaagagctcaggtaagaagctcaggtaaatagaaattctagtgatgttttcaggcctcagggggcgggttgggggtggtggtggtggtgtgtataatatcacttatagattacctcctgtgcagctggcccagctcagctccctccaaccttgtgctgctgccctccaacctcaggccctgggggatgttctaagaaacaaatctgcaaagctttttcaattcagctgactcacactgacagctaactctaacaaagatgtagtcacttaaaggcatgcattttagtattctaacctcatcccttgatttatcttactttccttcctctaagatccttattttcttgtttatttattacttactttgctggatattattctctaagcttcccaaatactttctggtttgtttgttttgttttgtttttgggggatggagtctcactctgtcacccaggctggagtgcaatggcacgattccagctcactccaacctctgcctcccaggctcgagtgattcttccacctcagcctcccaagtagctgggaccacagatgcggccaccatgactggctaatttttgtatatttggtagagatggggtttcaccctgttggccaggctggtctcgaactcctgacctcaggcgatccgcccacctcggctacccaaagtactgggattacagtcatgagccacagtgccctgccttcccaaatgctttttgaaaatagactttatttttcaggacagctttagatttacagaaaaattgtgaaactaatatagagttatcatataccctacatgcagttttcccgattatcaacaccttacattctgtagtacatttgttatgatttgtgaaccaatcaatattgatatattatgagtaactaaagtcttcactttattccacaccttagtttttacctaagttcctttttttgttctaggatcccatccaggatactttatttatgtatttatgtatttatttatttatttattttttagattggagtctcgctctgtcgcccaggttggagtgcagtggcgggatctcggctcactgccacttccgcctcctgggttcaagcgattcttgtgcctcagcctcccaagtagctgggactacaggtgtgtgccacctgtagcagtgctaatttttgtatttttagtagagatggagtttcaccatgttggccaggctagtctggaactcctaaccttgtgatccacctgcattggcctcccaaagtgctgggattacaggcatgagccactgctccgagccttgtcttatacttagatgttatggattgaatgtttgtgtccctcccaaaattcatgtattgaaattctaattctccgtgtgattatattaggaggtgggtctttggtgggtaattaggtcatgaaggtagagccctcataaatgaaagcgactccagagaagtctctggctctttcctttcaccacatgaggctacaacaaaaagtcagcagtctgcaaacccaaaggaggcccgcatcagaacccaaccatactggcaccctgatttcaagcttgcagcttccattactgtgagaaatttctgttgtttataaagccacccagtctatggtattctgttacagcaactgaatgagataggggaaaaaaaaacacttttttatagtttcaaacaccactcaatacaacacttttgacaccagattctccagcagacaccaactgcatgtcctataattccgttctgacttatttctatgtttgtctacttagaggtaatgccagatcccataggttaagggttcagtctcataagactctacacccccacaactccaggttgtgacttgtatatgtttctgtccaactgggtataaatcagaggttcccacaaccccctcctcaggttcttttaatttgtaaagcactcacagaacccagagaaacagtttacttatgtttactagtttattataaaggatattattacaaaggatacagatgaatagctggatggaagagattcatagggcaaagcatctgggaaggggcgtggagcttccatgccctctcaaggcacaccaccccccaggaacctccacatatccagcagtccagaagctctccaaacactgtccttctggatttttatggaggatccattaaataggcatgagtgattacatcattggccattggtaataaactcaaccttcagcccctctcccctctccagaggttgggaggtaggacagaaaagtttcaatcctctaattacatagttggctcccttggtacccagcctccatcgtgaaggctgtccatgagcccatcaaaagttgccttattagaacaaaaaatgttcctatcacccaggaaattccaagagatttaggagctccgtgtcaggaaatgaagacaaagaccaaatattagaggaaaagattttcctggtgcccctgtttatgagtgctttaggaaccagcagcagagaccaaatatatatatacacatacatatatatacacacacatacatacatacacttacatatatatacacatacatatatatgtgtatatatatatatattttttgagacagagtttcgctcttgtcgcccaggctggagtgcaatggcgtaatctcagctcaccgcaacctctgcctcccgggttcaagcaattctcctgcctcagcctcccgagtagctggaattacaggcatgcgccaccacgcacagctaattttgtatttttagtagagacggggtttctccatgttggtcgggctggtctcgaactcctgacctcaggtgatccgccctcctcagcctcccaaagtgctgggattacaggcgtgagccaccacgctcagccccccaagtatgtatttattttatcacaatattacagcatcccaagctaagagagttgccatatctccttaggagcttctgacaatatctcagacattctttgtttttgatgacctttacagttctgtggtgcattggtccattgttttgtagagcatccctctgttggaattcctctggtgtttttctcataactagactagtattatgggtttgggggaggaagaacacagagataatggtccatatcatatcaagggtacatactgtcaacatgagttatcactgtagacgtttaccttggttgcctagctaaggtttatttgtcaggtttttctatgtaaagttactgtttttcccccctttctattatgtaatatttggaaggaagtcagtgagcacagcccacacttaagaaatggaaatttatgctccctgttttctagagtgggatgtctaccaaaattatttggaattcttcgtggaagatttatctcttcttctcaatttatttatgtattcaatcaatcatttatttatagcagtgtggactcatgggcttattttatgcactggattataaactaatgtcaatttatcttattgctcaagttattccagctttagtccttgggtgctctttcagttggctcctgtatccctttgatatacctccatcaacatagtttgtattgtttctttgtttagcactttcttactttctgccactacaagatgctccagacccattttgtatatcccctgccctagttttagaatcagccatttctccaaggagtcccgattgcttttattggagaatggtaatagaaaccaagattcagtgctaggtttgctcattgtttctggagtgctgttgcatctagatcctatctgctgacagagcaaagaaatagatgtgtgtgtattaaccaataaaaatatacatatttctaaatatttccacatgtggaaccatcctgtcttaatatgattgagctgctataactcaatcataaccatataaactgggtagcttataaacaacagaaatttattgctcacagttccgaaggctggaagtccaagataaaggtgctggcagatttggtgtctagtgagggcctgtttcctggttcatagattgtgctttcttgctttgtcctcacatggtagaagaggtaaggcagctctctggctataagggcactgatcccactcatgaaggctttaaccttataacctaatcacctctcagggccccacctcctaatactatcacattggtgattagatttcaacatataaggtttggggggacacgaacattcagaccatagcacatccttatctatgttaagctaaacatgacttcatactgatccatacaatcaattctaatccactaccccatggattgttctagcctcctacctttgcttatctataaactcccactccaacagtaagaaagctagcttccataatctactatccatttacttaattgttcaagtgtacatttatagtaatatgcaaattgttaaccttatccttgtcaatatcaattttttttaccatcttcttaagtccagtgcttttgtgcaattccttttgcttttagtcttacagactccactcatttccaagggtaatcttagactctgccatttccctagataagcacgttatttcctccactcttttctttttctttctttctttcttttttctttctttctttttttttttttttttttttggaaagacagggtctcactatgtccccccagctggagtgcagtggcacagtgttggctcactgcaacctccacctcctgggttcaagccaccctcccatctcagcctccagagtagctggggctacaggcacacacaaccacacccggctatttttttgtattttttggttagatgaggtttcgctgtgttgcccaggctggtctcgaactcctaggctcaagtgatccacccacctcagcctcccaaagtgctgggatttcaggcgtgagccaccatgcctggccatcctccacttttatttatttatttatttttgagacagagttttgctcttgttgcccaggctggagtgcaatgacgcgatctctgctcaccctgcaacctccgccacccgggttcaagctattctcctgcctcagcctcccgagtagctgggattacaggcatgcaccaccacatccagctaattttgtatttttagtagagacggggtttctccatgttggtcaggctggtcttgaactcccgacctcaggtgatccacccacctcaacctcccaaagtgctgggattacaggtgtgagccaccgtgcctggcccatcctccactcttttcagtgaggttgtttcatacatgtatcataccagataggttatgttgtcacaatctgcattccatctgggatttcccccagtcccccagtctctgttttaatcacttgctgttctccctgttggtgaaggagggattcctgccctagggtaatggggatgaccaaacacataacacccaacacaacagatgatgtgaacagcagtctgttagttacatatactctcagcctggaaaagaacaccgcataccactcagggccacactctgcattcaggagcagaatgaacaatcaagctgtgggaggcaggctttgtggtatcaagaggatggggtgcccctggttcctgtggaggatgtaattggttgtttgagtaattccaagagctggcaggaaactgaaacccactactcagggattagcaaaactttgcccgtccatttgacaaagagctgggggagcttacacatgggagcagagtgggaaggagaacttaccactaggcaatttaaggccctcccagttttaccagatgtcaagacaacacataatattgagccttaattttaggccttacaccacaaccacaacctccaaaatgttttatggggtgttttgttttgttttttgagacagggtctcactctgtagccctgactagagtgcagtgacatgatcatggctcactacagtctcaatctctcgggctcatctgatcctcccagctcagcctcctaagtagctgggactacagatgcataccaccatgcctggctcattttttatatgttttgtagagacagggtttcgccattttgcccaggctggtcttgaactcctgggctcaagcgatttgcccacttcagtcacccaaagtgctgagattacaggcatgagccaccacgcccagcccaaaatgatttttttaaggatttgcatactttaaggttcactttgtgctataaagttctgtaggttttgacaactgtataatgtcatatatccactattacagtatcatacagaatagtttcatcaccctaaaataataattccctgtgcttcacctatttaacccttcacctctttttactgtctctatagtttgcctttttcagaatgtcatataattggactcatacagtatatagtctttccagactggcttatttcccttagcaatgtgcatttaaggttcatccatatcttttctgacagcctcaaatgcttttgcaagaagcaaaatataaaacataaaaacatttaagcaagattggtctccacttgaatatattttttcaaacatttgaaaatagtttatactttttaaaggaatcttacaatggtatagttttgtcaaatattacattaaatgtatatttcttttttttgagatggagtctcgttctgtcgccaggctggagtgcagtggcacgatcttggctcactgcaacttctgccttacaggttcaagtgattctcatacctcggcctcccgagtagctgagactacaggtgagagccaccacacccagctaatttttttgtatttttagcagagacagagtttcaccatcttggccaggatggtcttgatctcttgacctcgtgatctgcccgcctcagcctcccaaagtgctgggattataggcatgagccacagcacccggcccattaactgtatgtttcaagagaaaatactccaaagaactaagcaattgtatagctttggtggtttcagtaattaataatgtaagaaagaaaagataaagacctaattatttttctttttctgtaaagaacattattccttacgtaatgctatggtgtgaatgtttgtgtcctgccaaaattcagatgttgaaaactaaccctcaatgatattaagaggtggggcctttgggaggtgattagatcatgagaactttgctcttgtgcatgagatttaatggccttattaaaatggccccagagagctgcttttcccttctgttacgtgaggatagcaagaaggcaccatctttgaagcagagagcccttaccagacaccaagactgtctgtgccttgatgttgatttcacagcctctagaactgtgagctatacatttctattgtttatacattatccagtctaaggcattttgttatagcagcccaaacaaattaagacacatacataatcagtatatggaattactaatttaattctcacagtctttgtatctgttatttctcttacacagagtaaaacaattaaattcaagtatatcatgaaatgtgttgagcttttaatttcagaaattaagctggttttatgagggaagttcactttctttctgttaggaatttgttcggatatactttattttttctgaaatgggtcaaattgcttaactaagaaattttaacacagaggattttctaggtgcttcattggattacgtatgctataattggcctttactaaaagccttttttttttggtctggaattaagactttatcatgttttttacttgcttaggcttctatgtacttattattaattcaacccaaactctctaccaattgtctgaaatatttcaagacattgaaatgcatacggtgtgttatcagtttcatcttgaacacagctatcctggagctttcttacctgcttcaattgtttgcctcccactcccgtctcacagttatcacccaaaatttttccttcaacaccatcctggatatgccttttctccttctcttgtgttggatttattgttttctgcatgccatagttttccttttgtgtgtttttgtttttctttttttttcctccctagttttaggagaaacgtgtcccacaagtagttttatgagaaaggctcagggaagcacatttttctgagactatatttgttgaaaatctttattctattcttacactttatagtttggctggatatatatatatatagggttttaagttggaaaacatttccttcagaattttgaaggtattgctccatcgtcttctaatttctcttattctttcttttcaaagttaagtttactgaagtataatttacatacagtaaaattcaccctaagtgtagagttttatatatatatatgtatgtgtatatatatgtgtgtatatatatatgtgtatatatatatatgtgtgtgtgtgtatatatattttattaatttttttttaagtaaagacggagtctcacattgttgctcaggctggtctcgaactcctgagcacaagtaatcctcctgcctcggcctcccgaagtgctaggattacagatttgagccaccctgcctggcctaggtgtagagttctatgagcttcaaaaaatgtatatagttgtggccaggtgcagtggctcatgcctgtaatcccacacttttggaggccaaggcgggcagatcacctgaggtcaggagctcgagaccagcctgaccaatatggagatacccctctctactaaaaatataaaattggccagatgtggtggcacatgcctgtaatcccagctactagggaggctgaggcaggagaatcacttggacccgggaggtggaggttgcggggagctgagattgcgccattgcactccagcctgggcaacaagagcaaaactccatctcaaaaaaaaaaaaagaaagaaaaaagaaaagaaactgtatatagttgtgtaaattccataataaagatatgaaatacctccatcacccaaaaacattcccttatgcctttttgatttctgtccctctagttttgccttcttcagaatgtcatataaagagaattgtggccaggtacagtggctcatgcctataatcccagcattttgggaggccaaggcaggtggtccatttgatgtcaagagttcgagaccaggctgggcgtggtggctcacgcctgtaatcccagcactttgggaggccaaggcgggcagatcccaaaggtcgggagttggagaccagcctgggcaacatggcaaaatcccgtttctactaaaaatacaaaaattagccgggcctggtcgtgggtgcctgtaatcctagctactagggaggctgaggcaggagaattgcttgaacccaggaggcagaagttgcaatgagcgagatcataccattgtactccagcctgggcaacagagtgagactccatctcaaaaaaaaaaaaaatagttcaagaccagcctggccaatatggtgaaaccctatctctactaaaaatacaaaaattaggtgggcatggtggtgagcacctgtaatcccagctactccagaggctgaggcaggagaattgcttgaatccaggaggcgggggctgcagtgggtcaagatcttgccactgcactgcacaccagcctgggagacacagcaagactctgtctgaaaaaaaaaaaaaaaaaaaaaaaaaaaggacctgtacagtatgcagccttttgtatccaactcctttcacttagcataatccttttgttttgagactcatccatattgtgttgcatgtatcagtagttcatttatttttattgatgaatagtattccattgtatgcatataccaaaatttgtccattctctacttacaatgtttaagttgtttccagttcttggagcaggaatagccttctataaacattcacacacaagactgtgttttcattcttctcgagtagatatagttaagagtgggattgctggggttgtatagtaaatgtattgttcactttataagaaacagccgcattaaaaattttttatttcaatagtttttagggtccaggtggtttctggttacatggatacattctttagtggtgatttctgaaactttaacgcacccatcacccaagcagtgtacagtgtacccaatatacagtcttttatacctaattttcctcctgaacttccctgataagtccccaaagtccattacatcattcttatgcctttgcatcctcatagattagctgccacttataagtgagaacatatatttggtttttcattcctgagttgcttcacttagaataatggccactagctccatccaagttgctgcaaaagacattatttcattcctttttatggctgagtagtattctactgtgtatataaaacacattttctttatccactcgttggttgatgggcacttaagttggttatctttgcaattgcgaattgtgagaaacagccaaatttttttcaaagtggccgtatcatttttcatttctaccagcaaagaatttctcattggcacttgatattgtcattgtatattttttattttagccattctagtagatgtgcaatattattccattgtatttcaatttgcatttccctaaggactaatgatgttgagcatctttgcatctgtttatttgccatgcatatttattatttgatgaactatctgttcagatattttgcccatttaaaaaaattggttttggccaggctcggtggctcacgcctgtaatcccagcactttgggaggccgaggcggatggatcatgaggtcaggagatcgagaccgtcctggctaacacggtaaaaccccgtctctactaaaaatacaaaaaaaaaattagccgggtgtggtggcaggtgcctgtagtcccagctactcaggaggctgaggcaggagaatggcgtgaacccaagaggcaaagcttgcagtgagccgagatcgagatcatgccactgcactccagcctgggtgacagagtgagactctgtctcaaaaaaaaaaaaaatgttttttgttttcttttctttttttttttttttgagatggagtctcactctgtgcagtggcatgatctccactcactgcaacctccgcctcccaggttcaagtgatatgtatgtgtatatatatatatatatatatatacatatcatacatgtatttatatattttctccaaacctttttattttcttgtgtcttttggaaaacagagagtttagttgtgataaagcccaatttatcatttaaaaaaatagatagtgctttttatgtcgtatctaagaaatctttgcctaaccctaagtcacaaagattttctcctgtttttctcataggtttttagaattttaggttttacatttatatcgttgatccatcctgacttagtggtacaagtcaaggtttgagagtcttttaattttattaaaaatattttttctgttcacctgcagttccatgcagagattctacttatttatttatttaactctgttaagtctcagaacagagactctatttttattttatttttgcatatggatgtctagttgttccagtacaatttgctgaaaagattatcctttcttgattgaattaccttgacatctttgtcaaaaatcaatgaccatatttctgtgagcctatatctggattccattatgtttcactggtgtatatatctattattacaccaatactcactatcttgactactgaagctagtaaagccttggttgtttttgtttgtttgtttgtttgtttgtttgaagagctgttttactattccattaagatatgccataatttatttaactcaacctcaacctctacttaggggatttagttgtttctacttttctttttcttttcttttcttttcttttttttttttttttttgagacacagtttcactcttgttgcccaggctggagtgcaatggcatgatctcagctcactgcaacctccacctcccgggttcaagcgattctcctgtctcagcctcctgagtagctgggattacaggtgcccaccactacgcccagctaattttgggtatttttagtagagaggggttttcaccatgttggccaggctggactcctgacctcaggtgatccacccacctcagcctcccaaagtgctgggattacaggtgtgagccaccgtgcccagccttcacttttcactcttgttgcccaggctggagtgcaatggtgcgatctcggctcactgcagctctgcctcctgtgttcaaacgattctcctgcctcagcctcccaagtagctgggattacaggtgcctgctaccatgcccggctaattttctgtatttttagtagagatgtgggttttcaccatgttgggtaggctggtcttctagtgatctacccaccttggcttcccaaagttctgggattacaggcatgagccacgcctggccagttgtttctacttttctacttcctttttctttttttcttttcttttttttttttttttttgagacagaatctcactctgtcacccaggttggagtgcagtagcatgctcacagctgcagcctcaacctcctgggctcaagtgatcctgccacctcagcctccctggtagctggggctacaagtatgtgctatgatgcctggctaaattttgtattttttgtggagatggggtttcgccatgttgtccaggctggtcttgaacttctgggttcaagcaatctgtctaccttggcctcccacagtgctgggattacaggcatgagccaccacatcctgtaatcccagcacagctgctctattttcttgtattataaataatacagcaacaaatttccatgggtaaaacattgtgtctttgtgatagtgtacatgtttagcatttgggaatgctggtccaatgtttcccaaaatttcctcctagttattaggtctagtttcaggtccaggcccacttgcatcagctgtatcatgtaatcaaccaagctgtgtgtggctgtgttctaaggcactatgtctgatcttaaacagtgtgccttacctactagctctatgttaaagattccctactttcttccctctttggtcagttcatgcaagccatagaaaggtacttccttaagaaaacaaaaataagatgcccttttagagttgaaaaagtgtgtgtcaggtcatcaaggatattctgcctgcttgacaattatttttgatcattagcaaaccagtgttcaaacaagttttgattgggagtgaatcactttgctgattaatcactgaggcaagttgtaaaactattcttcgtctgtttgggctgctgtaacaaaataccatgaactgggtagattattcttaggctattcttgcatttctataaagaaatacctgagattgggtaatttacaaagaaaagaggtttcattagctcatagctctgcaggctgtacaggaaacatggcaacgacatctgctcagcttctggggaggcctcaaggagcttttactcatggtggaagccaaagcgggagcaggcatcttacatggtacgacaggagcaagcgagagtggtgggaggtgccacacactttcaaacgaccagatctcatgagaattcactagctagaggatggcaccaagccatgaggggtctgcccctcatgacccaaatacctcccacctggccccacttccaccattggggattactgttcaacatgaaatttggtggagacatatattcaaacgatactatatattcatatatatattcaaactatatcaattatatacaacgaaaatgtatttctcacagttctggaggctgggaagtccaagatcaaggtgtaggcagattcagtgtctagtgagggccatttctgctcccaggatggtatcttgaatgctgcatccttacaaatgctgtgtcctcatatggtggaagggatagaaagacaaaaggggacaaacgctatttccttatgtgatggaaggcttagggcaaacagggccatactgggtgtgaagcctgttttataaagtccttattcgcattcatggggatgagccctcatgacctcactacctcctaaaggccccacccctcaatactataacattgggacattaagtttccacttgaattttggagtgagctattgttagaatatttatccccatcaaaatgtatgttgaaatttaattgtcattataacagtgttaagtgggacctttaagaagtgatcctggctgggcaaggtggctcacacttgtgatcccagcactttgggaggctgaggtgggtggatcatttgaggtcaggagttcgagactagcctgaccaacatggtaaaaccccatctctgcaaaaaaaattcaaaaattagctgggtgtggtggcatgtactgtagtaccagctacttgggaggctgagccaggagaattggttgaactagggaggcggagattgcagtgagccgagatgacaccacggcactccagcctcggtgacagagcgagactccgtctcaaaaacaaaacaaaaaagaagaggtgatcctgctctcatgagtggaattaataagggtgaattcagcctccttttgtctctcttgtccttcgttcttctgccatatgaagatgcagtaagaaggcccacacaagctgcctgcaccttgatcttggacttccagtctctaaaattgtaacagtataaattcctgttctttgtaaatatccagtctcagttattctgttatagcagcaaaaaacagactaagacaaaagaacacaaacacaaaccatagcaagctctaagctgtattaaaatgatatttgggaccgggcgcaatgactcatgcctgtaatcccagcactctgggaggccgaggtgggtggatcacctgaggtcaggagttcgagaccagcctgaccaacatggagaaaccccgtctctactacaaatacaaaattagctgggcgtgatggtgcatgcctataatcccagctacttgggaggctgaggcaggagaatcgcttgaagccgggaggcagaggttgcagggtaagccgagataacgccattgcactcctgcctgggcaacaagagcaaaactccatctcaaaaaaaaaaaaaaaaaaaaaaaagataattggtaaacgtcagaaaggggtctgtcattcctccagggctaggctcctgcaatgtggtggcttctccagcattagactcctgccatgtgcactgaccagaggcacctcatgactacaagcttcccaaagaacctttttgagcagcttcacagcagaatgctgttgacaagccacctcctcagtgcaactggtgctctttctggtggttttccaggatgtcccagaggcaagacacatcatctagtgagctatgttgcactttctctgacatctagatctcagctctggggataaggaggactcttccttgggtgctgtatctcagctccagggacagtggctactccatttctgctttctctttagagttctttttaacttctaatacccagcccctcattacctgaatcccttaaacttcgtgttcaaattactgttatttctttctcttcactgaactctgatatgctgtttttattagatgtttaaatgttttattttacattctgctgctgagcaatgtttaaatttttatactctacatgttatttatacgtacatagtgaattaccatgttttagtccaataatcaaggttttttgttggtggtggtttttttgagacacagttttgctctgtcacccaggctggaatgcagtggcacaatctcagctcactgcaacctccgcctactgggttcaagcaatttttgtgcctcagtcccccgaggagctgggattacagctgcttgcctccatgaccaactaattttttgtatttttagtagagatggggtttcagcatgttgtccaggctggtctcaaactcctgagctcaggcaatctgcctgccttggcctcccaaagtgctgggattacaggcgtgagccaccacggctggcccaaggtttacttattgcaaagaaataagaaaaacttggttagtgggctaaaacatggtagttcattacatacatatagtgcctgtctatgcttgcatctacagattttcaacattggtctgaactcaagacgttgaaaaatgccagagggcagagtgtgatactatccttaaatctccaggtagtacatctattcagaccccaagagttgtctgataaatatgaaatctattcaaaatttaactgttcaaaaattttaaaacttttgaggattttactccacaatatgtgctcttatagaacctttcttgtggttgtggggggatcagaaaagggcagatttgatctaatcagaattactggaaaatggcttgctattacctcttagatgagctaacccaatgctaaaattactattattgagacagagtctcactctgtcgcccaggctggagtgcaatggtgcaatcttggctcactgcaacttccacctcccaggttcaagcaattctcgtctcggcctcctcaatagctgggactacaggggcgcgccaccaagcccagctaatttttgtatttttttagtacagacggggtttcaccatattgcccagggtggtcttgaactcctgacctcgtgatcttcccgcctcagcctcccaaagtgctgggattacaggcgtgagccaccgcgcctggcccaatgctaaaattatatgtgagtggtgtcttagatctctgtactttatggcgtatgattagcactatcatagtatggatccttatcatagtatggatatggatatggatccatatcatagtatggatcctatttaagacaaatttgctgcaaaagtagtatttcattgtacaatatctttattaaagaaatgcattccagcaacactgtcagcatctttattaccaaagaaatacataactttaacagataatctctgtatcttagtttttgcctttgcaaaacaaatggagatatatcaactctcatacaattctaaaagcattgtgctgtgctgcctcacaggggtacgttcccagaggtttctctctctagagcaatccctaataggacaattgttcactctgaggcttctggcttcttatctctcctctcttggggagctgctgcttctctgtaggttgcttccctgtgacgcagggaccatagtttctgctctaataacaccttttccactctgacgtagctgagccatacactacattgccttagtcctgttcaccctttggtgattctgttccatttgccacctggcctcttcctcctcagtcacttttttctttttttgagacagtctcgctgtcactgaggctggagtgcagtggtgcaatctcagctcactgcagtctcaacttcctgggctcaggtgatcctcctgcctcagccttcggagtagctgggattacaggtgtgtgccactgcacctggctaatttttgtatttttagtggagacggggtttcgccatgttggccaggctggtctcaaactcctgacctcaggtgatctacccgcctcagagcctcccaaggcgtgtgggattacagatgtgagcctccgcacccggccgctcctcagtcaattctaaacaactgtcctcacttgaggaagctggcctttctcctgtactgttttaccagttgtctttttaaaaaataactttcctccaaataacttactaattttattcatataacactcctcaggagttcaaataattttaatcatttttaaggcaaagaaaatactttttacatttgctagatgtttatttgcagagctacataaatataaccttattagaatgggatttttcctactttgggtaactatcaaaagtctcacacacacacacaacccaaagaaaacatatccaagaacgtggtcagttttcagtttttatcattatttattattttattttttatatcccagccctcccatgtaagactggtcattttttagaatcctcagccatatcaaggatacagaaggggtctaggatagagaccaatgaagaaatttctttggagaattgttaagtgctcaattcagccttcttggacaaaggagttactaccttctactttgaaacccagtgaaaggaacttcaaggaagcccttcagagagctttgaaatgtgtttcgtacaaccatttagctggggagcccagagagggctgctgccatgcgatctccctgaaattgtttttttcaggccagggatgtgagaatgtttcctgaggaccagatgtgtgacactcaggagagagccggcataaaatagcccccagaggtaaagaaaacctcaggactgaggctggatactaagggttaggaaagaattacagacttttcttgagacagggtctttgtcatccaggctggagtgcagtggcacaatcaaggttcactgcagccttgacctcccaggctcaagcaatccttccacctcagctccctgagtagctgggactacaggcacataccaccatgcctggctaattttttgtatttttaatggagaagaggtttcaccaggttgcccaggctggtctcaaactcttgggctcaagccaatggcacctctgagcctcccaaagtgctgggatgacaagcatgaacctccgaacctggcagagtattttaaattgagatgggtccatcagatacaaggataactacccagcagggaacctccaaagaggtcatacaaatgcctgagacagaaaaagtcgatttaattatctgcggggcccagggattatgaagccagccagccaaggaagaactaccctatctcctcactcctcaccttttgtacctccagtctacactttaatcccactgagttaacttgcagctcacagctccagaaaagtataaggagaaagctgaaatcagaggaatcgtgccctccactgccagcttgcagtttaaagcacacccaagctataattaagattaccttctgacgattacataggactgcacgttttacctattgaaataaaactgttttcgcaactaatcatgatgaaaatactttttgttatctgtgagtaatctaaaaatacatgggtcaggtcaagtcttcatcctggggcaccagggtatactcccaccgtataaagacacaaacataaaagcaatgttttgatctgaatccaatccacacacgatgcttattctacatactcgtgtacatgagaaccatttttccattgcaacttttcttgtcaaaacatccttctacttacaaggaagattttgcttaagtccttcctttatccttttttttttttgagatggagtctcgctctgccgcccgccgttctctcagctcactgcaacctctgccccccaggctcaagcgattctctcgcctcagcctcctgagtagctgggattacaggtgtgcaccaccaggcctggccagtccttccattcttagttcttgaggttatgcagtgtctttgccctgtgcttctcttgtattatgatccaaactcctttgtttaaaaaaaaataaaacacctaaatataatccaaatgtgctaataaatgtgaaacagcctctttctctgaaacaagttcttcagtaaaataattctgtaatgtattgctttgcttttcttacatgaagttatgctattacaaaattaagtttcaattacaggcaaggttaaactctgcaagcaacccaaaactcaaaaagggctgaatgataagtcattcaggtaaagacaaaagaatggctccttatcattcaacttaaccaaccttctaaaggttcctccatccccactgtctattacgctcgtggtatccttgtcttacacacttatcactatctgcaattgtctattatgtcaccttccacaaacatacatacagtatatacatgattgaaatctgtcagggcagggtctttgttttgttttccacttaaaagtttctgggcctagatagcttttgacacatagtagtcactaaatagatacttgcttcatgaatgaagggcaccatttagtcaataaaagggaaccacagaataggtaaacttccaaaagtatctagtgttgtcttttaaactaaactccccattcctcactgcccaatctcgtgacctcttggcaaactggtttttctttgctgctctaacatgagagaggtttatgaaaagtaaagactagcctaaattttgccaaatccagaattttaaaatatatcttcattctctttggcctcagccacatgtgactgagtgcccccctcaaacaatccccttccttggtttgtgtgactccatccaattctagttcctgggctaattctgcaaccactggagtcagagggcagaaaacacatctggttttgctcccactgtatctctaacatggcttggcacacagtaggtgcaccatacataaatatgtcaacaaatgaacttctccctctctccacttctgtctccaatggacatctccccaaatcttactttgagactctaaattatctttttgtttttggagtctgtaaattcacaaatggtttccaccaatactaagtcaaggatagttactgaagttcatcgatgaactcaagccctcttgcttactctgacttctacatgcctatcaaatctcagtgttctcattttcatgcttaaattatacagaaatgggaagcttggaagttagctactcacttgcacattcaagttttagatgttttctgtagagaactcccggacagccccacagccactgccttagtctgtcatgattttcacatgaactatttaagaacctgttacctagtttccagcttcaagactcatcacatgcacactaacactttccacattcatcttgctagaataactattcctaacattctggtttaaatcctctgtaatttctcaagacaaattcttcataatctgatcgctgctcttccctgaattcttttcttaccaaccctacaccccatccttctaacctgacaaccaaggtgtccagtttcatagttatgccctcctctgactggttaccattatgtcagctgtttcattgctggcaaagccacttaccttctctctcatcatgattccttcaagtcctccctggctcagcttaaatcttagcctggcttcacctattgagtgacaaactcctttccaatgctctcacagaaactcatgcatttatccatcatagtgtgtgtgtgtgtgtgtatatatatatatatatatatcaacaatatataattgtgtctcaattagaggtgaggcctctgcagctcaccgcaacctccgtctcccaggttcaagcaattctcctgcctcagcctccctagtagctgggattacaggcatgcaccaccacgcccggctaatatttttgtatttttagtagagacggggtttctccatgttggtcaggctggtctcgaactccccacctcacgtgaactgcccaccttggcctcccaaagtgctgcgactataggacgtgagctaccgtacccggccgccacagattcaacctttctatttttgtaactttacagaacataaccagttacatgtggaaacaggtagtctgctttgacagctgggggcaaatcaacctgactttgtgaactaagatgggagggaagtaggggctggagggaggcttttcaggcagaggacagagttgaaaagcagatggggtacttaggaaaaataaatttaacatttttgcacaccaacatataacactgcagagaagataaaagcataatttctgctgaaaaatttaaagtataatgggtatctatacataactataacttaaggcaggactgaagtgctgttaaagatagaaatatagacaataggtggggtgtggtggctcgtccctgtaatcccagcactttgggaggccaagatgagaggatcacttgaaaccaggagtccaagaccagcctgggcaacatagtttaactccatctccaatgcaagatccactgcttattttgtttcatttgaaaatttgagtcattagttcaaggatttttttttttttttgaggtggagtctcactgtgccaccaggctggagcacagtggcatgatctcagctcactgcaacctctgcctcccaggttcaagcgattctcctgcctcagcctctcaagtagctaagactacaggcacatgccaccacacccagctaatttttgtatttttagtagagttggggtctcaccatgtgggccagggtgatctcgatctcttgaccttgtgatccgcccacctcggcctcccaaagtgccaggattacagccgtgagccaccacaccggcctcaagggttgtttatatgggggtcagggtaccttcactagacttagacttctgaagcccaaactggccaaacttcaccagctttacattatacccacagcaactcagctgtctttcaaggtcattgttcaatcttcaacagactatcttcacttgaaaatttgatgatgacagccgggagtggtggctcacgcctgtaatcctagcactttgggaggccgaggcggcggatcacgaggtcgagttcgagaccagcctggtcaacatgttgaaacccagtctctactaagaatacaaaaagaattagtcgagtgaatctccatctctacaaaaaacacaaaaattagccaggtgtggtggtgtgcatctgtagtcccagctactcagaaggctgaggcaggagaaccacttgacttgagcccaggaattagaggctgcagtgagccaggattgcgccattgcactatctgtaaacaagaaaggcaatggcaattggactctaaccatacatctttaaagtatagtctcacatttcgggaggaagcccaagagagatttaatcagcagggtttctttataagtgaatgttctgaagctgagacctgaagggtaaattaggagttaaaatacaagatgagagtagcaattagctagcacattataaagccattccaggttacaagtaaaagtgatacccttccaaggccaggttaagaacctcagatgttattctaaacacagtggagaattataatttaaatagcatgacttggctacatcactattttatgtagctgttccagcaattcatgttcccttcaactgcccctgccctctcactcagcagtccagttgactttgtcccttcattttaaaaaaacaaaaaaaacccccaaccctgtcaataaaccacgaaaactaggaaggcacgacagcaagtttcagtgctttaacacagaaacacccaattaccaagttgagggctaaaaaaattcgaccaagtagtcccacatcattgcctttagtctacaaatctcagggattatacttgattttcctttatttcctgctcaatctttacttgcacccaagccctactttttctcaaacctatttacatattcttaagttgactcacacctagcaggcttttttcacttagctagccaccttacacacagcccacaagtcaggtgtgccaagtgagcattacagatactaggataagatcatcttttgaaaaacagaagccacctaaactcctacccatacgtttccagtggtactcccaagctctatgtgactaataatcatccccctagtcatgacagcatagcagatgaacatgttgctaaaggtaatttaaacatcatactctttcaaatttactcaaacatctaaaatacccacctatgccacatgagctgtgctattttaatctgctatattgtcttccagtgccctctgcttcaaggactcctggaattctgcttgtttctcattgcctttaaccgtgttacaaacccagtccaaaagtaaacattccaaaacagtcacttaacaagtaaatctgatatgaagctagcccagtccctaaacctacagtatttcactgatactacaagcctaattgattaaaaataccttaccaaaaccagatatgtattttttaaaaccagaacatttattgcatgactaatcgttgacattcttaagatgaactggatgctgcaacagctgccctcttgggtttaggtgttgttccttcacggaatccatgcctgcaggatgtcaaaaacaagaacaagttacttcagcaacatcgatgcatacattttaatttttgttaaacagatttcaatgcgcttatctcagttaaatgctgaaatcaatactgcattcatatgttcagacatttatttttacaacatcactgataagctgaaattcttcactttgcttaaagatacccattttcggatatagttaactgcaactgcaataaaggctcaaaaacttatttggctatactagtcattgggccagtatgtttgttcatatttggcaagagatcacagattatttgtgaaaatggttccctatactgagaatagatcccaactactttcactaagcaaggaaaaaacaattagcatgtttaatggcagacattttctaaaccaagagctttgcattttaacttatttaacatctgtatctactctaagaagtatctactctaagaaaggtcaactatcctacttttaaaagcctggcttcagttcaagctcttaactcctatattgtactaacagaccactcaacattaagcccacaaaaacgttatgaccctaaatgcaaagaaagttgcttcagcacatgaacacacctatgggtgtctacaaagccctgaactgtcttgctatctttaaaactggacactccggagactgagtgggtagaggctagggattctgcaaaatattcaattttgcactggacaatcccaccacaaagaattatccagcccaaagtatcaatagctgagaattgctgaaatagaacatagtaacggaaggagcaccagctttatagttaagtctgcatcattctgaatcttagctgagatcttagatgggttaatctcttagaaactactctttaatatgcaggttctctcagctaagtctacggcggagctgagattctgcatttataactctaaggccaagacttgagtaacaagagcccaaggcaacagcagcaaccagggcaattttctacagcactcttgcccacagccactatactaaaggttgaaccaagcctgactccagaccttattcactactgtcttgacaaattttgacaccaattaaacctaataaatatcaacactttgggaccctagttcaaacaatgctcctgttatttaatttatactactgtttagtgaaaaaactactaataaaatccaaactaactgatgtcaaggttacagcggcagaagataaaagctttcaacatctggcctgagcccaggagttccgagattatcctgggtaacatgacaatatcccattctctacaataaatacaaaaattagctgggcatgtggcagcgcacacctgtagtcccgggtactcgggcggctgagatgagattacctgaggctggggagactgaggctgcactgagccgtgatcgtgccactacactcaagcctgggcaacatagtgaaaccctgcctcaaaaacaacaataaataaaaagcttccaacatctcatccccagtaaccatcagggtactgttatctttttacaagtaaacacgagggtttcattcaagcccactggaccaattatgatcgaacatacaaactgtacctgaatctgcggtatacaatttttaggtgcctcattcgaccagttccggtggtatttcgtcttttagccttggcactccagttatctaaaacataagttcagaaaagatttcaaacggtgttctcccacacaccttgtaggtgttgttaacacacgagttttatgccacctcatcggcatacagatgtacgagttttaagataggcaccaaataaagttcaaacctatgcccccacttaagtgcaatacaaacaaaagctaacacagttggcctgaaaaatgttacttacactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcacattaaaggaataaatagttctgaaacctggcaacttctagatttactcgagttctccgggaaaccaattactgataaaatttaaaggcaatcgtaaagatcgaaactgcgggagaagcctctttccacgaatgccaagtcagagaccactacccgcatttcacgttacctaaaaccctccgcaagagttgcaatgttctgaaatgcaccttatctttacagactccggccagagagcatcaccaatgaattatttcattgttacacagagccaaacattcccaaactccttccctcggctcccaaccaaggctagagccgtgaaaggtctccaaaggttggaccgaggcaaaggacacaatgcggctctagcaccacaattacggcgggataggtcccccaggcaccagttagcagtcattcttctggctcttgagggccaccgcatgcctctttccagcccaccagttccccttatccggaatcttgccagccccccaagcacagcaaacagagaggcacaaaggacgaggatggaacgcgattcacaaacaccacagtcacaactcaccatctcgcttctgcggccgagaccagaaagaccggaagagaaggcacttccgctatatcacgctcagaagcttccgcccagggaagcacttcctgcggggcgcggtgcagcgttctcgagcgtccgtcgtcgtagtgtaggtggggtcaagaggaggatgcggtaccaggcagggccgatcgcgtttcagtgccggaaaggcgggcgggactcccagttttctggcgaccggatgggcgagtcttcgtcgggcctgcttagaccctgagggccgtttagattacagttttgcttttcgtgctgctgttgctggtgctactgctactactgatcggtttcgcacgttagcagtcagatctgttgctataccgtcgattactgtcttctaggcacatggagaacctggaatgcggggctggccctgcccaggggtacccgcaccgactgagcgtccccggcgtgtaatgaccgtgtgcgcctgggataatcccttttaggagaaagcaacttctccagcagcctcctcattccgatcccggaggcttttggccgacgctgactttccctgcgagaggtcgctaggagtacggaggcatggagctggagcttagaatataaagggaaaagcagacagtgattttgttgttgttgttactgtagtaaatcagaggcaagttatctgatcccatatttcattgtgccaaggaatcacacatggaacttgttcaatatagtttccaagggcctggcgccgtggcttacgcctgtaatcccagcactttgggaggctgaggcgggcggatctcttgagcccaggcgttggagaccagcctgggcaacatagggagacactgtcgctacaaaaaaaatacaaaaaattatccaggcgtggtggcgcgcgcctgccaacccagctactcagggggtggaggtggagggaggcttgaacccggaaggtggaggttgcagtgagccgagattgcgccattgcactccagcttggatgacggagtgagactctgtctcaaaaaaaactgagaaaactaaaaataaaatgttgccagagctgctttccgttctaggagggagaatctgttttctttcctttctcagcttctagagactgcccaaactccttggtttattgctcccttgcatcttcaaaaccagtgatactgtagttcccccccgtttctgtgggttaagttccaacaccctcagtggatgcctgaaaccacaataccaaaccctatatatactgttttttcggtacatgtgtacctgtgatgaagttaaatttatgaattaggcaccataaaagattaacaacaactaatagaacaatcataacagtatactgtaataaaagttatgtgaatgtggtcggtctctttttctcaaaatatcttattgtcctgtactcaactatttttaaaccatggttggccatggggtaacaaaccctgaaatcctgcaaagggaaaccttggataagtggagactactgtagtctttctcacattgcattactctttattctgcatctgtcttattctttttcctttccttttatttttatttgtagtagagacaaggtctcactgttgtccagactggtcttgaactcctgaatcttcctgtcttggtctctcaaagggttcgggtgccctgccatccttctcctacttttaaggccccttgtgattacattgactccatccaggtaacttccttatctcgagtttcgctaattagcaaccttaattccctctgcaattataattgtcctttgccacataacctaatttattcgtaggttgaggggattaataccttgttatctttggagacagccattattctgcctaccacggggactatgagaaatgaggtcagtgtagaaaaggtaggacaggtgtcaaccattaaggaaccaagcagtgtgacaggcattatgtcagtctctttactccagacattcccagaattgaagacaggagagaattatttttcctcctctctctagtgttcggtggttctttttggtgtatgtcaaaccatgtaaattttgccctgatcaagtaaacccttggctttctttaaagaggtctatgaaggctagtcagaccctccaattttctatacaattgctaggtttaggtcagggctagtgactgtatcaactttttttttttttttttttttgagacagggtctcacctgtcacctggcctggagtgcagtggtgccatcgcgactcactgcaacctctacctcccgggttcaagcaattcttgtgcctcagcctcccaagtagctgggactacaggcgcacgccaccaccacgcctggctaatattttgtatttttagtagagacagggtttcaccatgttggccaggctggtctcgaactcctgacctccagtgatcagcaccccctcagtctcccaaagttctgggatgacaggtgtgagccaccacgcccagccaggactagatcaacatctgaaacggatgatctaaggctgttagcctaggcattcaccccctgacattttgctttttggcagtgatagaaactatgttaagtcctgcatccatggttctgatacaatcaagtctcttgaccaccaggactcagcactgagacctgcctctttttatttctacaatacatgaaattactgttgacttttgtctttaaaacatcacataaattcattaggagcaattcaagggagaatttactgtacattcatacctatgataaagtttaatttatgaattagcacggtaagattaacaacaactaataataaggctgggtgcggtggcttacacctgtatcccagcactttgggaggctgaggcaggcagatcacctgaggttgggagttcgagactagcctaacaaaacaaaacaaaaaaagctcaaaaaacaacaataataaaatagaacacatttaaaacttttaatcctgtgttattattctgatttgaggtctatactttcaattttgtacctcctggctatattttatataatagagaacatcctggttacactcatccttcccccacctcacttcctttgcattctaaggctgtggtatgcaaatttctgttattaagaaacaatttttttttttgagacggagttttgctcttgttgcccaggctggagtgcaatgatgctatcttggctcaccgcaacctccgtctcccggggtcaagtgattctcctgcctcagcctctcaagtagctgggattacaggcatcgaccaccatgcccggctaattttgtatttttagtagagatggggtttctccatgttggtcaggctggtcttgaactcccgacctcaggtgatccgcccacctcagcctcccaaagtgctgggattacaggcgtgagccaccgcacccggccatcaacaaacaatttaaactagacagcctggcatggtggcttacacttgtaatcgcagcactctgggaggctaaggtgggaggatcacttgagcccaggacagcctgggcaacatagagagaccccatctctacaaataataaaaaaaatatggttcacgcctgtaatcttagcactttgggaggccaaggcgggaagattgcttaaaccgaggagttcgagaccagcctggacaatgtagtgaaaccctgtctccacaaaattttttttttaaaaagagctgaacaggttggcgcaagcctatactcccagctgctcaggaagctgaggggggaggattgcttgagcccaggagtttgaggctgctgtgagctatgattgcaccattgcactccagtcagggcaacagagtgagactctgtttcaaaacaaaacaaaaggaaaacttgtagaaagaagtttaaatttcagtgctaagtttcccacttcaagtgaacacttttttcccattggctttgaaatctcagaaaggttactgtgagaaaggagcatatttagggttgagcattggagaggagactggtggtttgggacacctgttattaaagtaccttcctggtcaagttgaacaacaacaacaaaaaattggcaatctttatgacagtgccaatcaaattgtggacatgaggtgggatgcatcacttgaaagccatacttttgagatacatattttaaaactcttacctagagtataatggtggttaccagagagaggctgggagttgcggggaagggaagggtgctggtcaaaggatacaaagtcacagacaggaggaataaattataagtattgaaggtgatgtatatgttaatttgagtgaatcattccatactgcatacatataaaattactgaatatcccataactatatatgattataattggtcaaagtaaataaaaattttaaaactcttcaattttataaaactcttacctaatattaatttttaatatcatatgaggatttttttttttaagagcctaggctagagtaacttactacaacctcaaacttctgggccgaagcagctctcctgcctcagcctcctgtcccaagcagctgggactacagatgcgcaccatcacgaccagataatttttaaattttttgtagagacagggtcttgctatgttgctcaggttggcctcaaactcctggtctcaagtgatcttcctcagactcccaaagtgctgggattacaggcatgagccacctcgcccagccaggattttaaaattcttttttaaccttggagataccagaattgtattactcattatccttggttcctaatagcattggttcatgcatgttctgcttttatttacatattagctatttacctttaacaatatagtagccctgataggcccaactcctacattgtaggacatccatgatctcctccccaatcccatcccatccccaagctccccatatgcgaggtaaccatcattctgaatttcatatttatcattctttgctttttgttttgtataattttaatgacttcatgtatactcttaaatgtaagggtgtgtttattttcaacttttaaaaaggttgtcatactgtatataatcttttgggatttacagtttttccttactattgttatgatttctctatattgtgggtcactgaagttcattctttttgaatgccatgtaatattatgttataagaaatatcacagtttattcatccagtatcctgttgctagttatgcagatcgctttcaggttcttgtgaactatgaaggagtaaataaagaccaaccaggtaattttcttaaaataaataataataaaaaaccaaaaatgtaaaatattaaatagtaatgtttaaagtggaagtataaatctccctgtagtcatattctcagagataaccagtgttaaaatttgggatatctcttgtcttctttaaaatataatgcatatctgcatatacatattatatacatatactatatacacattaagttttttaaaacaaaaatgagatctataacttgctgtttccatagcaatatatcatggatatcattacttgtcaatatgtagagatgtactttatcctttttaacagttctttggtgtttcactgtcgacatgtcaatatttattccctaaaccccaactttggttattttcaattttgtactgttgtaaacaatgttgtaatgcagattcttgtacatacatcttcgggcatttgctcaattatttccttaagataatttcctagaactggaattgctgggttgaaggatatgaagttttatttttgtctgtcttcaactttatttatttattgctgtatattgccatattgcccaccaaatatcaattaataatttacattcttggcatcatagtatagttctctgagcagggaatacctagtccaacctgaagttcaagagcgacttcttggaggaggtgaccctgggtctgagtcatggtgagaatttatcaagacttcaaaagagcagataaataatccacaaggaccccggatcagagagtgctccgagctgggttgccccactgtgcttgtatctgcactctccaacactaggcatcattgacatgttaaagcttagccaaatagaattgttctttgtcattctttttttaacttttacttattcattaggatgatttcataatatatttcctggtttagaggaaacaggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctgttaattttggtacagaaaaagggagaggcgacctgtcagcattttctcaagtgtttatttagtacttttccacagtcagctgccatttgcggcttaaggcatggtaagttgactttgtatactttttggggtgagaggaagggggcagactttctgaaaaagaaaacaaaatgaaagaaaattgttgccttttatttttgttagtctttttctggagataattttcattgaaatatgaaatagggaaaaactggaatttaaaaagtttctgaaatttaacatcttattggtctactgaatcgataatttgtttttcagactgtactcaaaacttgaagttgttttagtgctaacaaactgctcattattctggcagtaacatgctaaaatctcacagttggaaggaaaatactttaataataacacaatccagggtttgtttttcaagtagatgaattcgtggatatttacagtgccaagaccacaagctgtatctttcacttagtatagccgttttgaaaatacaaggaaaataatttttaacacatagatggcaaatcagtagtttcatttttttggtgataagaatgccagcagcagctgttttctggagcaattccagtgctaattcttaaatggttcaaagataactagtagtccatgaaaaagcaattcttccagttatttagcaattctgtaaattactactaggactaggtctagctctttttctaggaatctaaaaaaaaattcaaaattattttaagggatgttagagaggtagaggctcagataaaaaggtgaatgttagtgatacctaatttaggacaagatttatatgcttagaaatttttcttttattatttctaaagcacactattccaaatagagccatttgcttactgattagaaattatttgtgatcagatttcattagcaatgaccccaagagacgtgagtctgttgtgagtcacagtaagtccacaagtaaacactgttcatatgattcaaatttttcgttttattcacttaccctgtaaggttgctaggaaggactcaaactttaagcaagacagtggtgtgatctgatttttttttttagtggaaaaaagaaagttctgaaagttgacatgttgacatgcaagttatataggaggtgttaggtattcctgtcctccagtgaaataagaggtggctgggcgctgtggctcacacctgtaatcccagcactttgggaggccggggcagatggatcacctgaggtcaggagtttgagaccagcctgaccaacatagtgaaacactgtctctactaaaaatacaaaaattagctgggcatcatggcgcatgcctgtaatcccagctacttgggagactgaggcaggggaatcacctgaacccgggaggttgaggttgcagtgagcccagatcgtgccattgcactccagcctcggcaacaagagtgaaactctgtctcaaaaaataaataaataaataaaaggagagggatgaagctttgaggcctcaggaactctagctgttatacagcttctttttcttaattgggaaaaacaattcttttctttgcagaagttttaaaacatgagaatacagtacctcctcaatctatgggggcaagcagtaattcagaagatgctttttctcctggaataaaacagcctgaagcccctgagatcacagtgttcttcagtgagaaggaacacttggatttggaaacctctgagtttttcagggacaagaaaactagttatagggaaacagctttgtctgccaggaagaatgagaaggaatatgacacaccagaagtcacattatcatattcagttgagaaagttggatgtgaagttccagcaactattacatatataaaagatggacagagatatgaggagctagatgattctttatacttaggaaaagaggaatatctaggatctgttgacacccctgaagatgcagaagccactgtggaagaggaggtttatgatgacccagagcacgttggatatgatggtgaagaggacttcgagaattcagaaaccacagagttctctggtgaagaaccaagttatgagggatcagaaaccagcctttcattggaggaggaacaggagaaaagtatagaaggtatggaaatatcttgtatagttagttaggcaacaacttaataagttaataagcttgccatgacataatggggatgggggatgaaaaagggacagatgtcagcagaaaatcaactactaagaaattcctcgtgcctctctgacctggaatctcctcgaggtaggtgttgacttaaaggagctcccaggacctaggaaatgatggacagcataagcaaaagtaaatattgattgtcagtttgtaaatttctgtagttcgtataaggagttgccaatcattaatttcccattatacgtacgaggagttgctaatcattaatttcaggctaacctatttctcaggttaaaccactttagttattttagtgcctttgtgaccagagagatatggggattatgggtttgactatttaagtgaaaacagtcagtaaatggctaagatcccaaaatattgttacttggcttgatccagtccacataatgccatcttgatgagaattatatttgtatcttgaatctgaatatttctttatttaaaaaaaatttgtttttaaacagggtctcactcaggctggagtgcagtggcacaatcatgactcaccgcagcctctacctcccaggctcgggtgatcctcctacctcagcctcctgagtagctagcattacaggtgcctgccaccacgcctggctaattttgtattttgtaaagatgggattttgccatgttgctcaggctggtctcgaactcctgggctcaagtgatctgcccaccttggccacccaaaatcctgggattacaggtgtgagccactgcacctagccaaatctgaatatttcttaatgaaaattcaaaatatgagaagtgtttcattggagtgatattgcctgggaaaacagacatcactaagttctgagtagaggatgaaaatgtagctaccatctcacattaatttcaaatcttggggactcataatccacttatgggtaggaagagagtcatttcttcctcatcacaccttgtatcagtttgtgagggatgctgtaacaaaataccacaaaatcagtggcttaaacaataaacacagatttcttgtctcactcttttggaggctagaaatctgaaatcaaagtatcaaagtactgacagggttgcttccttctttttttttttttttttttgaaacagagtctcactcgtcgcccaggctggagtgcaatggtgtgaccttgctcactgtaccctccgcctcccgggttcaagcgattcacctgcctcagctccccaggtagctgggattacaggtgcgtgccaccacgcctggctaatttttgttgttttagtagagacgaggttacaccatgttggccaggctggtctcgaactcctaacctcaagtaatccacccaccttggcctcccaaaatgctgggattaaggcatgagccactgtgcctggacaagggttggttccttctgaaggatgtgatctgaaggatcctagctttcctggtggtttgctggaaatcattgacactgcttggcttgtgcaagcatccctctgatatgccttcaccttcaaatgtccttgtccctgagtgtgcacccctttggccaaaataaaaaaggacaccagtcatattggattagggcccaccctaataacattattaaaactaattacatctgcaatggccctatttccaaataacatcacattctgaggtactgggggttaggatttcaacatatgaattttgtaagggacataattcaacccatgcctcttgccccacccccaaataacttcttaatacatgattattttggggccccattcttaatttttatttatttattttagttggtgcatagggttgaattaattaattcattgcatagtatcatcattattctgcaaaaatcccctgtttatctattctgtttttttctccatttcccatttaccttcttccgtaggtaacattctaatattgcagtgcatctcttacatattgtttggttttcatgaaattttttttctgtatcaggtactgactgggtttcaccacgttgcccaggctggtcttgaactcctggcctcaataatgctacataacaaatcatctgaaaattcagtcacttcaaacactgagagtttattattgttcacatgtctgtggttggctgggcagttctgctggtcttccctgggttcactcatgcatctgtgatgaggtggttgaaggctggtctctcatcttcaagcaggctactctgggcttgttttcagaatagatgcagtatattcttttttttttttttgagatggaggctcactctgttgcccaggctggagtgcagtggcatgatcttggctcactgcaacctctgcctcctgggttcaagcgattctcctgcctcagcctcctgagtagctgggattacaggtgcccactaccacgcctggctaatttttgtatttttagtagagatggggtttcaccatgttggccaggctggtctcgaactcttgacctcaggtgatccacccacctcggcctcccaaagtgctggaattatggacatgagccaccgcgcctggccaagtatattcttatgatgagggtaaaggagagagaaagggagagagagcaaggtggagggggggagacagagaagtagtgaaggccttttgagtcttagctttagaacgatcatcatgccatctatgccatctgtatctgtttcctagggctgctgtaacaaagtaccacaaatgagtggctttagaacaacaaaaatttcttgtctcacagttcaggaggccagaagcctgatatcaaggtatcaggagggtcatgctccctctggaggtgctaggaaaggatttgtctcaggcttctctcctagcccctggtagcttcgtgcattccttgacttacagatggccattttctccctgtgtctcttcacatcatctatcctctgtgcatgtctctgtgtctaaatttttcttttttattaagacaccaattatactgatttaggcccccctccatgaccttattttaacttaattacctctgtaaagataaagatgctatttacaaaataaagccacattctgcattactgggggacttcatatctttttgagggggacaaaattcaacccataacaccattacttctgccacattctgttgaccaaagcaagtctcaaagccaggtttagggttgggggaaaacaagttctacttcttgcaaaataagatagcaaagactatggataccagaaagccattaactggggacattattacaatcagtctaacatctttagtaaaacagatcaagagaagtcttaataataatgtagttatgatctgcaatgtaattctaatggctgcccatccactctagttgactggaggcacgtggctattctttgtttctttcccaagtaatatttgtctgtgcagctgagaaatgaaaaaaatagttctaaatcaaaggaaggtcttcatgctctttgtcatgtgaaattttatgtaaaaaatatcacagtgtcacagtctcagaaaggcttaaactattgccttgtgtgctctgcactatagaagttcaacttgtatagacagtatcaattgactctcttccccctccagcttgttgttgggttcaaccattgggtggaaccaatatgtttacctttccctgtggcctttcttttttcctgaagatccaggttttcattttatattattttcctttagcctgaaaaatttatttattttttctcttagtacaagtctgctggtggtaaattctcttagtttttgtttattgaaagatatttttattttgccttcattccagaaggttgcttttgctggatataggattctacaacttttgcctttaacatgttatggatgccattcctctgtcttttagcttccattgtttctgatgctaaatcttcagtcattttatcattgatcctctgtaagtgctgtgtcatttatctctggttgttttcaagattttttcttaattttttttgagcagttgactctgatgtgtctggggtgattttttttttctcttagtgtttgcagagtttcctgaatctatacaaaaacttttaatcaaatttggaaacttttcagctgttatttaccgagatttttttctttctcacttcttctcttctctctttctgagacttcgagtacatgaattttagagttttaaaaatattgttctacaggttccagagactttgctcagttttctttaatattttttctctctgttcttcaggttagatatttactttcttctgtcatctccaatttgttgttagcccatctagtgattttaaacaaattcatatattgtgatttttaattccagaatttcctgtttaaaaatactttatatttttttctgagaattcctatttaatcattcattgtggacttacttaattttaattgtttttttttttttttttgagacagagtcttactctgttgctcaggctagagtgcagtggcacaatcttggctcactgcagcctcagtctcctaggctgaggctcaagccatcctcccacctcggcctctcaagtagctagggctacaggcacagaccgccaggcctggttaattttgtattttttgtagagacagggttttcacgatgttgcccaggctggttttgaactcctgggctcaagtgatcctcctgcctcagcctcccactgttttggaattacaggcatgagccaccatgcctgactgtaaaattcttatatgctaaatctaacatctaggtcattttggattcagtgtccattgagtatgagttacatttcttgtttcttcctatgtctattagctttggattgtgttctatccattgtatataataggtcatagagactctagattgttatatttctcccaagagtctgaatattattttagtctgtttttgtctccagttaacctaactgtatttaaattcaaaatttagactccttttccatgggtggcagctgaaatctctgtttatttctttttgccttagctgagttatttttatgaatttttaatttataaaattgagattagtttcctgatattattgcttacttttttcacctagctctgtgcttaattagatacatctctgttttgtgtgtacatctactctgttgctttgatctgctccatagtgacactgttattaccttgtcgacacacctggcttggatcctgtgggtattgatgtctttctttttttttgagatgacaggctggagtgcagggccacaatcttggctcactgcaaccctgcaacctccacctcctgggttcaagtgattctcctgcctcagcctcctgagtagctgggactacaggcacctgccaccacacctggctaatttttgtatttttagtagagacggggtgtcattatgttggccaggctggtctcgaactcctgacctcaggtgatctgccgacctcatcctcccaaagtgctgggattataggtgcgagccactgcacccagccatgggtacgaatttctggctgaagaagtagagaattgctttcctaaggcaaagtatgagacaggaaaaagcagaacttaaaagctgtcctgcaacctattctctcactgcttcctctgtgaactctttcttcatgctagattcaacttccccctcacctttttgccccaacacatatatcagttcaagcaactttgagactactcaagggcttcttatagttacttttattaattcctaaaatctatgcttttctcttatttctgttgtttcttcaaagctatttttaagggtaattttacatttttacactagctggccgtctgtcaggagtagaaaatctaggctgatcttctctctctgttatgtactatctctgtatttataagatgtaggtaggccagccagggtggctcatgcctacaatcccaacactttgggaggctgaggcaggcagattaattgagcccaggagttgagaccagcctgggcaaaatggtgagaccctgtctctacaaaatgaagaaatgaaaagttaggtggggttgatggtgtgcacttgtggtcccagctactccaaaggctgaggcaggaggatcacctgaacccaggaagttgagactgcagtgagctgagattgcaccactgcactccagcctaggtaacagtacaagaccctgtctcaaaaaaaaaaagtaggtagaagatagtttggaaaatgggagatcaggaaaaattaggtatagcatgtaaactccgagaaaaactttgaaggaaataaaatcttcagttcctgtaaacttcagcaagagataaatttaagaaagaaccagtatcggccaggtgcggtggctaacgcctgtaatcccaggactttgggaggccgaggcaggcgcatcacgaggtcaggagatcgagaccatcctggctaacatagtgaaaccctgtctctactaaaaatacaaaaaattagccaggtgtggtggcacccgcatatggtcccagctacttgggaggctgaggcaggagaatcgcttgaacccaggaggtggaggtttcagtgagctgagatcgtgccactgcactccagcctgggtgacagagtgacactccatctcaaaaaaaaaaaaaaaaaaaagccaggcacagtggctcacacctgtaatcctagcactttgggaggctgaggagggtggattgcctgagctcaggagttcgagaccagcctgggcaacacagtgaaccatctctactaaaatacaaaaaaaaaaaaaaaattagctgggtgtgacggcgggcgcctgtagtcccagctactcgggagggtgagacaggagaatcacttgaacccgagaggcggaagttgcagtgagccgagatcgagccactgcactccagcctggtgacagagtgagactccgtctccaaaaaaaaaaaaaaaaaaaaaaaaaccagtatcaacctagagtatttctcatagatgtatataatttaacattaataaatttttttttcattgctgcatgtaaatgttagcacatttttttaaataaaaaacctaaatgatcatccataggcaattgttaaatagttacatccatccaaaccatggagtaccatgaaatagctaaaatgagttaggtagatcagtatatatgctgacttgaaataatttgcaaggaataccactaagtgaaaagaagctgaagaatcatttgtttagtataatatcatttatgtaaaaaaaaatagcatgggctgggcacggtggctcatgcctgtaatccctcattttgggaggctgaggcaggtggattacttgaggtcaggagttcgagaccagcctggccaacatggtgaaaccccatctctacaaatacaaaaattagcttggtgtggtggcacatgcctgtaatcccagctactcgggaggctgaggctgggagaattacttgaacccaggaggtggatgttgcagtgagctgagatcttgccactgcaccctagcctgggcaacagagccagactccatctaaaaaaaaaaaatagaatctactaagtaaaactatatatttctatatatgcatgcatacttaagtacttgcatagaaaaaggatgggaagcaaacatactgtaccatattgatatctcccctaaaaacgaagctgacttgccagaatggtgaaaggagacttccactttatttatattgtttcagctttttgcagtgaaaatgtagattagaccgggtgtaggggcttatgtctatcctagcactttgggaggctgaggcaggctgatcacttgagtctagttcaagaccagcctagccaacatggtgaaatcccatctctactaaaaatacaaaaattagccgggcatggtggcatacacctgtagtcccagctacttgggaggctgagacacaagaatagcttgaacccaggaggtggaggttgcagtgagctgagatggctccattgcactccagcctgggtgacagttttctttcaaactctgcctcaaagcaaaaaataatgcagatgacttaattttaaaagtcaggctgggcacagtgactcatgcctgtaatcccagcactttgggagtttcgcttgagatcagttcagagtcagcctgggcaacatagaaagaccccatctctattaaaaaaaaaaagtagccaggcatggtggtgggtgactgtagtctcagctacttgggaggctaagatggtaggattgcttgagcccagggtgatgatcatgcccctggattccagcctaggtgatggagtgagactgtctcaaaaaaagaagtcgatggggaaaattgaaactctgaacatggcattcactattatcttctctcctacagaaagaaaaaaggtgtttaaagatgtcctgttatgtttgaacatggatagaagcagaaaggttctgccagattttgttaaacaattctccttagatcgaggatgtaagtggacccctgagagtccaggagacttagcctggaatttcctgatgaaagttcaagcacgagatgtgaccgctagggattcaatcctcagtcacaaggttctggatgaagatagcaaggaggatttgctggctggagtggagaatttggaaattcgagacatacaaaccattaatccccttgacgtgctttgtgccaccatgctgtgttcagatagctctttgcaacgccaagtcatgtcaaacatgtatcagtgccagtttgctcttcccctgctactgccagatgcagaaaacaacaaaagcatcttaatgctgggggccatgaaagacattgtgaagaagcagtcaacacagttttcaggggggcctacagaggatacagaaaagtttctgactctcatgaagatgcctgtcatctcttttgtgcgtctaggatactgtagcttctctaagtccagaatcctcaacacacttctcagccctgcccagttgaaattacacaaaatctttcttcatcaagatttgcctcttttggtgcttccccggcaaatctctgatggcctggttgagataacatggtgttttcctgatagcgatgatagaaaggaaaacccctttttccaaaagcctgttgctctggctaatctccgtggaaatctagaaagcttttggactcagtttggttttttgatggaagtttcttcagctgtgttttttttcactgactgtttaggtgagaaggaatgggacttgctaatgtttttaggagaggctgccattgaaagatgctactttgttctcagttcccaagccagggagagtgaagaggctcaaatttttcagaggatactgaacttgaagccagcacagctactgttttgggagaggggagatgctggggatagaaggaagaacatggagggccttcaagctgccctccaggaagtgatgttctcttcttgcctcagatgtgtgtctgtggaggatatggccgccctggccagggagctggggattcaggtagatgaagactttgaaaacactcagagaattcaagtttcctctggagaaaacatggctgggacagctgaaggtgagggtcagcaaagacacagtcagctaaaaagctcatctaaaagccaggctctaatgccaattcaagagcctgggactcaatgtgagctcagccagaatcttcagaatctctatggtaccccagtattcaggcctgttctagagaactcctggctctttccaaccagaattggaggtaactttaaccatgtttccttgaaagcctcctgggttatgggccgcccctttgggtcagagcagaggcctaagtggttccatcctttgccttttcagaatgcaggggcccagggccgaggtaaaagttttggtattcaatccttccatccccagatattttattcaggtgaaagattcatgaaattttccagagttgctcggggatgtcactcgaatggaacatttgggagactgccaagacccatttgtcagcatgtacaggcctgccctgagagaccacaaatgatgggaactcttgaaaggtctagggcagtagcctccaagataggtcactcctattccctggattcacagccagcaagagcagtagggaagccatggcctcagcaagcttgcaccagggtaacagagttaactgaagcaactggaaaactgataagaacatcccatattggaaagcctcaccctcagtcctttcaaccagcagcagccacacaaaaactaagacctgcttctcagcaaggagtccagatgaagacacaaggtggggcttcaaatccagctctccaaatagggtcccatcccatgtgcaagagctctcagttcaaatccgatcagtccaacccatccacagtcaaacactcccagcctaaacccttccattctgtgccctctcaacctaaatcctctcagacaaaatcctgtcagtcccagccctcccaaactaaaccttctccatgcaaatctactcagcctaagccaagccagccctggcctccccagtctaagccttctcagcccagaccccctcaacctaagtcatcctcaaccaatccttcacaagctaaggcacaccactcaaaagcagggcagaagaggggagggaagcattaaagagctaactccagagatctataaagcatatcctttacccaggccattcctatcatatagtaagcagaagagttgccatgaaagtaaaagactactgtcattagcatgtaaaacaaagaaagatatacatgactgaattggatatctttgtttgtttgtttgagacagagtttcactcttgttgcccaggctggagtgcaatggcacgatctcggctcaccgcaacctctgcttcctggcttaaagtgattctcctgcctcagcctctcgagtagctgggattacaggcatgcaccaccacacccagctaattttgtatttttagtagaggcagggtttctccatgttggtcaggctggtcttgaactcccgacctcaggtgatccgcccacctaggcctctcaaagtgttgggattacgtgtgtaagccacagtgcccagcccgaattggatatctttaagatatctgtaagtgttatatccctaaccaagaagaaaaatatgaaaataattaagactagaatcaagcagtagataattgaatccaatcttgggtattattagataatgtataacttgcacccagggaatgggggtctatgagacaaccccacttggagaagaatggggttagggtctctaattgcaaagtgactgtacaataggacgaaagttgcctctgtgtctgagaaagtatcttagttgttggctgctccagaggtatctttgtcaaaagcttctggttcaatatcagccactgagcagataaccctgcttatttggtgtggttaaatcaactagcttctgctaatagccccaatttgcttgaatgggaaaactctctcatttgacccttataggtagaaataatgaattaacaaccaataaaattaatcatttggcattaactttgtgaaagatctatgtttgtttcatatttgatatggtttggctctgtctccacccaaatcttatctcgaattgtaatccccatgtccctcaggagggaccagggacctggtgggaggtgattggattatggggccggtttcctccatgctgttcctgtgatagtgagtgagttctcacgagatctgatgatttatttttatttttttgagatggaatctcgctctgtcaccgaggctggagtgcagtgacatgaacttggctcattgcaacctctacctcccaggttcaagcaattttcctgcctcatcctcccaagtagctgggattacaggtgtctgccaccacacttagctaatttttgtatttagtagagatgcagtttcaccatgttggccaggctggtctcagactcctgatcgcaagtaatccacctaccttggcctcccatactgctgggatcacagacatgagccaccaagtccagccgagatctgatggtttaaaagtgtgccacttacccccttgttctctctgtcttctgtcgccacgtaagacataccttgcttcctcttcaccttccatcatgattgtgtttcctgaggcctccccagccatgcagatctgtgagtcaataacttctttcctttataaattactcagtctcagatagttcttttttttttttttagatggagtcttgctccgtcacccaggctggagtgcagtggcgcacgccgatcttggctcactgcaacctctgcctcctggcttcaagcgattctcctgcctcagcctcccaagtagctgggactacaggcgcctgccaccacgcctggctaatttttgtatttttagtagagacagggtttcatcatgtttgccaggctggtctcgaactcctgaccttgtgatctacctgcctcagcctctcaaagttttgggattacaggcgtgagccaccgtgcacggcctcaggtagttctttatagcagtgtgaaaacagactaatacaatagtttaaatatttgtaatagttaagaaaattggacttattagagggtctggtattaatatactaatacctcatgattcaaatttaaaatgttattgagttttcttttttttttttatactttaagttttagggtacatgtgcacattgtgcaggttagttacatatgtatacatgtgccatactggtgcgctgcacccactaactcgtcatctagcattaggtgtatctcccaatgccatccctcccccctccccccaccccaccacagtccccagagtgtgatattcccattcctgtgtccctgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccttgaggaatcgccacactgacttccacaatagttgaactagtttacagtcccaccaacagtgtaaaagtgttcctatttctccacatcctctccagcacctgttgtttcctgactttttaatgattgccattctaaccagtgtgagatggtatctcattgtggttttgatttgcatttctctgatggccagtgatatgttaatgagttttcagttttagagttgtaattttcttaagttaaaagataagtttacaaaaaacattgaaatgttaaagagaacttaagattcacaaaatttatacttttattagattcatattattctaaacatttgggtaaattctgcttgttagaggcattaaggaaaaatagtgtattaaatttaaaatatttaagtcacatttagttaactaggtttgtaaatgacatcaaatatggataaaaggacactttaaaagtatctgttaaaagtcactagattaagaataaaataataacatttataaattgaacttaatagcttcagtttgtgaattggcaactctagtaaaattaatattaatttaaagcactacagtagtccccaaatagtctttcatatgtaaaaaaagtaccttcaagtacatcaaaaaagaaaaagtcatattgacaaatgaatgagagctggtctttgaaa

SEQ ID NO: 139 - DNA, 2050 bp, Homo sapiens
tacatcaagtgaagataatattttgtttccttcccactttttctctaacacaagccaccccagttctcccttctgacaacaggcaagtggaccctagtagaccttccagaaaagccttagagagcacccccaaatgctcacatttgtcagctgtaattccaccctcagttaaaacctgattctcaatgtgacttggccaacgcagcttgcaaagcaagaacgtcttcatctaaggttgaaaacatcagttgtttgggttgtgagaaaagaaaagcccacaaggtttccgaggcttggtgctgtttctcactgtcctcagctcctgattctgcagctggttctctctccaagcactagcaaaaccctgccctaggagcccccagactctgagagcccatgaccaaaaagaaaaggaaagccaagttggggaagaacaggggcccccaactccacagccctccactctgcccagagggcccaccctgggctgcctggaaccccctaaagttgccacccccgcaacacagtagtggggcagttcctggcagcgcctgcagcccatgggctggctctgtacccgcagccccgccaagcgtctgttatcttatttactggaatctgcacagccaggctctagctcaccggtgactaaggagctgcagccattattaccaggcagatggcagactccctaaaagcagacattaaacaataaaatgccaccacataccttgcccacaaaataaaatcaaaacaaacacctaagtctggctttgcttttcttctgctctctccctacctcccctgggtcagagcacagggggagaggtgcacggggcaccgagaaggaaatttacgatcgaggaagaccatacggacatgcccagtgaccttcagaaggtggcagtagcagaaccaccatgggaccccaggtggcggagagggcagaccctgtccatgtgtgacaggtggggcagaaccaccagctaggacaggtgggattggaagaacaaaggaacgacagggaccctgcagaacccacagccctctcgcctcagtcgcctgatgaatagtcaaagtgctaagacctggagaattccatcaaaaactcagttgctcccactgctttggaaggtgttctgctgggctctgccaggacaggccacggctgacggctcacctgaagagagggacctgctatttatgaagcatctattatgtgctggcagctgccccttactcctgcaaggcaggtactgtctccattcttagaagaaaaatcaggctcaggagaaggaaataatttgcccgtggtagccagggggtgaacagcagaatgctctgccaggcccaggccacgaggcctctggggtgaagaaggaacaccccccagttcttgggcatcaggtgcttgtgattccattctatttttctcttaactcataattcagtaattgaggctagagctttgccatctcacattaaacccttttaggactccagggccttaactcacacttgtgggaaggatgtttggttcaggccaatgaaaggcttggctggaaagcccacaaagctgacaggtgtgcagggctgatgacaggtcagtgcactgtcccactggtgccgggctgctgaggcttcaggacaagcctgcccactaggaagggagggaaggtattgagccttgaacgagccacttacctgtaggtccaacctaggtttcctgctacgtcaccagcccccaacaagagctaaaggtaggttttcactaccggacattcaccatgtggctcataagtacagttggagggacaactttggagttgtccgagggcccgagtttgagctctagtttgccatttactggttatgcaatctcagtaaattattcaaattcatggagcctcaatttccttgtgtaaaagggaaatctcccaggatcatcatgaaaattataataattaacattcatgaaactgccacacatggtgccagatgcctaataatcaatcaatcaatatttaccaaaatatgcaatacagacagc

SEQ ID NO: 140 - DNA, 180393 bp, Homo sapiens
gggccataattctatgaaacttgtaatgctaatgctaaatcaagggttgtgaaaacactgccatctttatacaaaacccaacctccagccgggtgtggtggctcacacctgaaatctcagcactttgggaggccgaggcgggcggatcatctgaggtcgggagttccagaccagcctgaccaacatggagaaaccctgtctctactaaaaatacaaaattagccgggcatggtggcacatgcctgtaatcccagctactcaggaaggctgaggcaggagaatcacttgaacccgggagctggaggttgctgtgagcctaggccactgcactccagcctgggcaacaagagcgaaactcggtctcaaaaaacaaacaaacaaacaaaaacccaacctccaagttcctccacttaacatttaaaaactctagaaaggagggtgggtcggctgggtgcagtggctcatgcctgtaatcccagcactttgggaggccgaggcgggcagatcaagaggtcaggagattgggaccatcagttggtcccaattggtcagattgggctaacacggtgaaaccccgtttctactaaaaatgcaaaaagttagccgggcagggtggcacctgcctgtagtcccagctactcgggaggctgaggcaagagaatcgcctgaacccaggaggcggaagttgtagtgagccgagatcgcgccactgcattccagcctcagcgacagagcgagactccatctcaaaaaaaaaaaaagaaaggagggtgggtcaatcaggcaccacaactctgtggctcatccccctcccctccccctctgttatcagccactctccctgctgctcctcttcgagtcccaggggaacatcacttactcctttttagactctggcccatcatttcccttagcatagctaagatgggttgggagatccaaaaggatgttagtttaaatttttaaagtactgaacatactcagtaccaatgaacacatctggtgcctagattgggttttctaaatactgttctctgctaaaaggaatcagagctttctgaagacctggttgatctcaagactggggcagacaaggagaaagattagcctgaaacatttttgttgtgccaggaaataaggcagtgctgggaaaaaaaaaaaaaaaaaaaagtaatgttggctgggtgccgtggctcacgcctgtaacgcctgcactttgggaggccaaggtggttggatcacttgaggtcaggagttcgagaccagcctggccaacatggcgaaaccccatctctactaaaaatacaaaaattggctgggcgcggtgtctcacgcctgtaatcccagcactttgggaggccgagatgggcggatcacgaggtcaggagatcgagaccatcctggctaacacggtgaaaccccgtctctactaaaatatgaaaacaaaaaattagccaggtgtggtggtgggcgcctgtagtcccagccactcaggaggctgaggcaggagaatggtgtaaactcaggaggcggagcttgcaatgagccgagatcgcaccactgcactccagcctgggtgacagagcgagactccgtcgcaaaaaaaaaaaaaaaaaaaaacaagcaaacaaacaaattagccgggcgtggtggcgggtacctgtaatcccagctactcaggaggctgaggcaggagaactgcttgaacccagaaggcagaggttgcagtgagccaagatcgcgccactgcacttcagcctaggtgacagagccagactgtgtctcaaaaaaaaaaagaaaaaaagtaatgtcaaaagacatggaagtgccgggtgactcatgtctgtagtcgcagcacttcaggaggccaaggtgggaggatcacttaaggccaggagttggagactggcctgggcaacatagtgagatcctgtcttcacacacacacacacacacacacacacacacaaattttttaaaggacatggaagccaaattaaaggggctccctccggtcaaaactggaataatttgagcattaaaataagaactgaaattaattataatctattgaataaaaccaaagtccatattgataatacacatgaatgaaaaaggagtggggagggctcttttttatagtctaatgccaaatgacaaaaatggagggaatgctggagttagaaaatcaacattgtgcaaccaatatgataaaaactggctaggggccaggtgcagtggctcacacctgtaatcccagcactttgggaggctaaggtgggtggatgacttgagatcaagagttcgagaccagcctggccaatatggtgaaaccccatgtctactaaaaattaaaaaaaaaaaaaaattagccgggcgtggtgtcatatgcctgtagtcccagctactcaggaagctgaagcaggagaatcacttgagcccgggagtcagaggttacagtgagccgagactgcaccactgcactcccgccttggtgacagagcgagactctgtctcaataaacaaacaaacaaacaattggctagggtaaaatcatgaatggatactgatgcagggcaggcaagccccatagtagggcttagcccatgagggtctgtggcttcacccaggaaagagggcaagctggtggtagggtagaagaaaacagccttattgaagtggcagtgttacagctctgtgactgctctgcagagcagggctaccccatcggcagtgtgctgacagtagccgcttagggcagtttagaggtcatatttacacctccttttaattacaagtagattaaggagtggtttatgcagaaatttctagagaattggtagtaacttttgggtcatcgggtcatcaccatggaaaagggtggtaactcctaggtattgccatggcgatggcacacttgtgggtgtgtgtcttatggaaagctgcttccgccccattcctgttttagctagtcttcaatttggtccagtgtccaagccctgcctgtggaatcaagtcccgcttcctacctcaatactaaatctaggtggggaaagtatgaagctgggcagggttatttgcatgatctcaaagtgtctccccacagattgtttacaaattgttacaagttcacaagttacaaaatagtaactatatatcatggagaaaccagacaacatcatgagcaagtttgacattgattaaattaacatcaccagtaaggagcaggtagacattgtagggcttgggtagggcttccccttaaaagaacacaacacaatttatgtcatatttcaggtcagatgcataacctaaactcggtcatgagaaaacaccaggaaaacacaaattgatgaacattctataaaatagctggcctgtatttctttttaatgccagtgtcattaatgacaaagaaaggctgaggaactattttagatcaaaggagacaaagagcatgacaacaaaatgcaatccatgctcctgaactgggccttgtactggagggaggagtgctatcaagggtgttattgggacagttgacaatggtggaatatgaattttatagtgccaatgttaaatttcctgtatttgatcattgtaccatgatatacattttgttaattatagagacagggtcttgctctgttgcccaggatggagtgcagtggctcaatcatagctcactgcagcttcaaactcctacgttcaagcaatcctcccacctcagcctccagagcagctgggactataggagcatgccaccatgctgggctaacttatttattattttttttatagaaacaggatcttgctgtgttgtccaggcttattttgaactcctggagtcaagggataccttgacccacgtcagcctctcaaagcgttggggttgcaagtgtgagccaccttgcctagcctgtaccatgatttttttttttttttttttttgagacggagtctcactctgtcgcccaggctggagtgcagtggcatgatctcagctcactgcaacctccgcttccagggttcaagtgattctcctgcctcagcctcccaagtagctgggattacaggcatgcaccaccacacctgtctaaacatgtaccatgattatttaagagaatattcttgttgttgagaaatatgcattatagtattaagagataaagggtcataatatatgcactgactctcacatgattcagaaaaaaatgagtataatgcatttagagagagaatgacaaagcaaatttgtcaaaatgtgagaaatggataaatctgggtaaagaatatataggaggtctctgtaactaagaataatgacaagaatgcaacttttctataagtttgaaattatttcagaataaaaaggttttgactatagtcctctgctgtaccagttgagttattgaaggatgctataaaaaaggtttttaaaaggcacataaacagaagagaaacagtcaaatgaggactagggtgtataaggacagttccaagtggccagttgaattctgactttagcttgttctcttttatctactttttttttttttagacagagtttcgcacttgttgcccagactggggtgcaatggcacgatctcggctcaccacaacctccacctcccaggttcaagcgattctcctaccttagcctcccgagtagctgggatttatctactttcttaaaagggctcttactctcaacctcagagagctgctatgacatcataggtaccccatccagcttctgaccttcccaggtcccggccttcctccctgtgaagggcaacatcttccttccccagtcaaggggaggctggtccctggatcctagagactaggatactttgattccttttgctcttaccgaaaccaaaaccaaaaccaaatgccaacaaaaaactattctagagtttctaaggatcatgtctgcgagccaggattcctgatccagagacaacggccccaatgggatggagcccaaaggtgtcattgagagtaactggaatgagattgttgacagctttgatgacatgaacctctcagagtcccttctccgtggcatctacgcctatggtttagagaagccgtctgccatccagcagcgagccattctaccttgtatcaagggttatcacgtgattgctcaagcccaatctggggctgggaaaatggccacatttgccatattgattctgcagcagattgaattagatctaaaagccacccaggccttgctcctagcacccactcaagaattggctcagcagatacagaaggtggtcatggcactaggagactacatgggtgcctcctgtcatgcctgtatcaggggcaccaacatgcgtgctgaggtgcagaaactgcagacgaagctcctcacatcattgtgggtacccctggccatgtgtttgatatgcttaacgggagatacctgtctcccaaatacatcaagatgtttgtactggacgaagctgacgaaatgttaagccgtggattcaaggaccagatctatgacatattccaaaagctcaacagcaacacccaggtagttttgctgtcagctgcgatgccttctgatgtgcttgaggtgaccaagaagttcatgagggacctcattcggattcttgtcacgaaggaagtgttgaccttggagggtatccgccaattctacatcaatttggaacgagaggagtggaagctggacacactatgtgacttgtatgaaaccctgaccatcaccccaggcagtcatcttcatcaacacccggaggaaggtggactggctcaccgagaagatgcatgctcgagatttcactgtcttcaccattcgtggagatatggaccaaaacgaacaagacgtgatcttgagggagtttcgttatggctctagcagttttgattaccactgacctgctggccagaggcattgatgtgcaacaggtttctttagtcaccaactatgaccttcccaccaacagggaaaaccatatccatagaatcggtcgaggtggacggtttggccgtaaaggtgtggctattaacgtggtgacagaagaagacaagaggactcttcgagacatcgagatcttctacaactcctccattgaggaaatgcccctcaatgttgctgacctcatctgaggggctgtcctgccacccagccccagccagggctctatctcggggggctgaggagcagcaggagtggggagggaagggagccaagggatggacatcttgtcatttttttctttgaataaatgtcactttttgaggcaaaaacaaaacaaaacaaaacactctaacattgcaacccactcaggcgtttccaatgcctttattttcctatttgagggaaatatcatttccccaggccaagggcaagatgggtgactaaacctggaaatggcctcaaccttcctgcaagtagtagatccacagcacatggttaataatttatgctattaaggttaggctactaaggctattaaggtgtacggtcctaacggacacacctatgaattagatatacctgtcaacagaagccggtcagatccatggttaagaaccagaataagatggtctgagtttagtttctgactccaccacttacaagttgtgtgactggctgggtgtggcggctctgcctagaatcctggccctttggaaggttgaggctggaaggttgctttgagcccaggagtttgagaccagcctgggcaacatagccagaccctgtctctattttatgtaggaggctgaggtaggcggatcacgaggtcaggagatcgagaccatcctggctaacatggtgaaaccccctctctactaaaaatacaaaaaaattagccgggcgtggtggcaggcgcctgtagtcccagctactcgggaggctgaggcaggagaatggcgtgaacccgggaggcagagcttgcagtgagccgagatcgcgccactgcactccagcctgggcgacagagcgagactccaactcaaaaaaaaaaaaaaaatgttgtataactgagagaaggcaactagttcccggagctcatgaaccattcactcaacaaagtaaccacctcataagcaccagacactattttgggaggtagcaaaatgtaagctctctgcgctcagagcttacattccagttagatgagacagaaactttaaaaataaataattaaaatatagcatatactattattgaatccagagattccgaggctgaattttgggaaaggaggaaaagaaacatcagttttataaagttaaaaggaaaaaaaaaaaaacaggtgattaactgattttatgttctgttcttctggccttctctttaaaatatttctcaaatggagattattcaaggaatttgaagattttatttttgttttctggctttgctttgagttgaaaagaagcttttttttctgtatttgagacattttgcaaatacacagaatcctttaagagtagagtttggagtttacattgaaggtctcaaaaattctattattaggggaaattaaaataccattcataatgagaatcacaattttataggggaattactagtaatttatgaaaggctttttttctccaaatggtcaaaagaattgtgttggaaatttggatgttcttttgctatggttcgtacagtctgtatttgcctcttcaaataactttggatgacttttacatggccacattactgtttccataaatgatatttttaggaactggaaataacaaaaagttctggtagtcttgccacttgtccttaataacttgtgtagctaaatatctctttcccaaaaagtgagtgagaagcaataccagctaggattttaaatgataaatggatgggctgggcgcggtggctcacaccagtaataccagtactttgggaggccgaggcgggaggatcacttgaggtcaggagttcgagaccagcctggccaacatggtgaaaccccatttctactaaaaatacaaaaaattagtcgggtgtggtagcacgcacctgtaatcccagctacttgggaggctgaggcaggagactcacttgaacccggaaggcggaggttgcagtgagcggaaatcacgccattgcactccagcttgggcaacaagagcgaaactctgtctcaaaaaaaaaaagttaaatgatgtttttatgtaagacagtaagaaaaccacaggacatacagtggtttggttgctggttagttgtctttattgttaacttttctattgtttaaatttcagaagaaaaatctttgtgtgcatgttaagatttttcaagattgataattacataaggctctggtctcaagatccaatcagtacccattttgtttcaatgtcaccaaagtaaaattgattatagggtgactctgcttttttcttttttttatatatacgtatttttttttattatacttaaagttctagggtgcatgtgcacaacgtgcaggtttgttgcatatgtatacatgtgccatgttggtgtgctgcacccattaactcgtcatttacattaggtatatcaactctgcttttttctctcccattaaaggtttttgggaaaaaaaaacattgttcctctcttacacatgcttttttattttacctttttgagacaaattctcacgctgttactcaggctggagtgctgatgcaatcacagctcactgcagcctcaacctcctgggcccaagcaatcttaccacctcctctgagacagctgagaccacaggtgtgcaccatcatgtctggctaattttaaaaaatttttctttttttagagatggggtcttgctatgttgcccaggctggtcttgaactcccagactcaagcgattctcccacatcagcctcacaaagtgctaggattataggcatgagccaccacacctggccacatcttgtttaaaaaaaaaaataaagatcctcattatttgattgaatgttttgttttgcttcgttttttgagacagagtctcgctctgtcgcccaggctaaggtgcgatggcgtgatctcagctcactgcaagctccgcttcctgggttcaagcgattctcccaccttaaccttccgagtagctgggattacaggcgccagccatcatgcctggctaatttttgtatttttagtagagacggagtttcaccatgttggccaggctggtctcgaactcctgacctcaggtgatccacccgcctcggcctcccaaagtgctgggattacaggcgtgagccactgtgctcggccggttgaatgttaataaattttaaaaacataccaaaagaatgcagttgaaattttaactttattattttcctattacaaaagcaacacatattcattacataataaaagggagggagctcaaaagatataaagaagtctatgttttttttgtttgtttgtttttttaaaggagtctgttttaaaattgcctattatcctattccagggaaaactattaacattttgccatatttcattttatcagtcttttcctatgtatttttgaacacagctcaaatattactctatataaagacttgtattcagctttttcaacataaattacattaaagttatttttatgtcaataaaaattatctttgtaaacaaaattttaatggcaaaataacatttcatcatatagacatactgtaatttatttaaacactctcctaaaatcaaatatttagttaggagaaagttagtaggtcaaagcatataaacattgcgcaggtcactgtggcctaaaaaggctgttcttttttattttttttggaacagagtctcgtactgttgcccagcctggagtgcaggggtgcaatctcggctcactgcaacctctgccccctgggttcaagcaattctgccccaacctcctgagtagctgggtttacaggcacaggccaccatgctcggctaatttttgtatttttagtagagacagggtttcaccttattggccaggctggtctcgaactcctgacctcaagtgatccacccgcctcggcctcccaaagtgctgggattacaggcgtgagccactgcacccggcctcaaaggctgggagggaatgcagtgactctgcgggtgaggggtggtatcaaggccggcagcaagacagagaaggctcacaggtcctggcctagccgctccagctcgttgaggaggaagtccatatcagcacaggtcagtgcagagttggccacaaccacacggaagaagttgccccgggtcccgtggggctggtagccaatcatcatggagccctccttcaccatgcgctccttgagcacgggggccacctgtggaagggtggagagagattccagctgcagcctgggtcggctgacaggtaggctggcttcttgtcctgccaggcttccagaggtgcttttccttcccacccagccaccttctgggggtagcacaccttgctcagaccttgaccttggcctcagtttacctttctgtcatatctaacctgcttggccttcgctatcttctgcttttctccccatttctcctgtctccaagaaatctgtcctgtgggacattttctgccaaatcttgactttctcttgattcctaacactgctttagtctaacttcaagccttggtcatctaagccttagtcaacaccttcttctcccctctcttaattcctgtaatatttttgataatattaatctgtgccctgtgatctagcaagtaatttacaacactgccttgaacacattgcttccaagtaggtaactcttgccttataataacaactccataagggcaagaacatttgtcctttcagatcatctgcagcacctagtaccactctatctttagggaccaggatataacacagctcctcgcctccagatggcacttctagactggctttctcgggttgctgtgtccctagcacgggtaataaggcttttccatgatcattctgcctcatatctgtcctgggcctgagttcccagcccaattgccagcacaaggctctgtgtactacacactggtgacttctctgacttctcctgtaacacacgtcgctgcttcttacttcccagaaacataccttcctccccatccccacccctaccgaaaagagagcatccacgcctcagagcaagagaccagcaaggagacctgccatgccactcccagccaacagggggcagaagcgcatcagttgcatcagctccctaacgggtaaagagagcagcacagcacgcctacctttgacagcctttcgtggtaatctggactctcctgcttccctcgcaggctggggggtacgaaccagaaacacacattgacaaactcaggctgagaggaatgagaaagaggaaggtgtgagctgagaaagggggaccgttttccctctccctgcccctttcccctctccctgcccttttccctccactagggctttagttggggcttgggggctgcaaaagagctaggctggggcaggggccacaaaatagaaaggggtcctacctccatgactagctcaaacccttcccgcttcttcatttcctccaccaggtacctgtgaacagagagtgagaaaccataggcggggaggaaaagcagagatccagacagaagaggcccacgtagaatgagccacagagagaccgagagaaaagtaatcccgggagcaggaaagagggaggggcatggacccaggagaggggaacagggacgaccccccacctcctcccgcctaccgggcaaggacaaaggcctggtcgatgcgccgctccagcccttgatcgccctgtgccttccacatgagccacagcttcagacagtccacacggcggccacactgcaccaccttgtctcccgtgtccagagccacatcgtagaacttgtcctgctggaaaaggtagctggcctgggacccatggcagcgcttgagcaggttctgtgtgggggtgaggagattgtcagaccctaccctctccaccgaggctttcctccagggctgcactgtgggggtcttagctcaggataccctcttctttccctggagccagatggcactgctgggacggctgcctgctggctccaacacctttctttgggtttcctcccaatacccagggttcttcccaaactctgatggcaacctcaagctagaaactccaggatacctctgactccaacttcaagctggaaacttttcttttaagagaggccactgggggagtgaaggagcctaatacaggttagggtggtagctgagatgcagcttcagaagggatggtaaagagaatagagaaaggcctgaactttatctaaggtgggatagagaaggcagagctccagagagaggtggggctggtgcaggggcaggggcagacccaccgaggtatcctggagaagaagtgcagagcattgcaggcctgctgcgaggagcttgtggggattccaggccacagagtcagccctggatggggtggagcaaaggcaggtcagtggctcctcctccagctgcccaaccagagcccttcctccttttccaggtccccagcaaaggggctttggtctcaccctcaccccagcatcaggaagaactgccatgtctgacctcccagctccaatcaatcctctctccagtccccctcccctcagcctcctaccccagccatgttaaactccctagtccatgatgattctctggaccaatggtttgaagggcgggatttgggaagaaggggactgtatgcacctctggatcccatccaggagatgcctgtgtgtctgtgacagcaggacgctcccaccccaggcagcctgtggagcaggaggaacaacgtgggccttggccttggctcagcccaccccaccgcacccccaagccgaagtcccactcacatccacatgcagccatagcccatgacgctggcacacatcagcaattgcctccagggggtcaaaggcccctagcacagtggtgccagaggtggcactgaccaggaacggcacagcaccctgttgccaaaatgtagagggagaaagatgtaaagtcatctcaaaagctactcagagcctgatgctgggcccagctctaagctctttgcatgcctaaaatggcccatttcaacctcacaacaatgtgttactgtcctttttaatgtgcagccagggacactgagattcaaagatccaagcagaagctgcagagatggacttcgaacctaggttttcatttccaaagctcatactctcaaagaacttgaatgttttactggaagatccaatgctattgaaaaaaaattgagtcaggcatagtggctcacacctataatctcggcacttcaggaggccaaggcaggattgcctgaggccaggagttcaagaccagcctgggcaaaatagcaagaccccatctctaaaaaaatttttttgtttaattagccaagtgtagtgggcatgcctgtagtcccagctactcaggaggctgagatgggaggattgcttgagcccaggagtttgaggttacaatgagctatgattttgccactgcactccagcctgggcaacagaatgaaagcctgcctcaaaaaatataaacaaataggccaggcacggtggctcacacctgtaatcccagcactttgagaagccaaggcaggtggatcacttgaggccaggagttcaagaccagcctggccaacatggcaaaaccccgtctctattaaaaaatacagaaattatctgggtgtggtggtgcacgcctgtaatcccagctacttgggaggcggaagccgaggcagaggcatgagaatcgcttgaacccgggaggcagaggttgcactgagccaagatcacaccattgtactccagcctgggcaaaagagcaagattctgtctcaaaaataaataaataggctgggtacggtggctcacacctgtaatcccagcactttgggaggccgacgcgggtggatcacgagatcaggagttcaagaccagcctggccaagatggtgaaaccctgtctctcctaaaactacaaaaattagccaggcacagtggcaggcgcctgtaatcccagctactcaggaggctgaggcaggagaatcacttgaacctgggcagcagaggttgcagtgagccaagattgtgccactgcactccagtctgggtgacaaagtgaaactctgtctctaaataaataaataaatttgaatagtacaaaagtttatgcagaaattgaattagtaatttttaaaactactacagctggatgtggtagctcatgcctgtaatcccagcactttgggaggccaaggcaggagaattgcttgagcctaggagttcaagaccagcctgggcaacctagtgagacctcacctctacaaacgaaaaaaaaatacataggctgggcgtggtggcttatgcctggaatcccagcactttgggaggccgaggcgggcggatcacctgaggtccagagttcgagactagcctgaccaacatggaacaaccctgtctctactaaaaatacaaaattagccaggcatggtggcacatgcctgtaatcccagctactctggaggttgaggcaggagaatggcttaaacccgggaggcggaggttgctgtgagccaagatcacgccattgcacctcagcctgggcaacaagagcaaaactctgtctcaaaaaaaaaaaaaagaaaaaaaatagacaggtgtataggggtgcactcctatagtcccagctacctgggaggctgaggtgggaggatcacttgagcctgggagatcaaggctgcagtgaaccatgattgcaccactgctctacagcctggtcaacagagtgaggccctgtctccaaaaacaaacaaaaaaaatctaccacagtgggagtctgaggcaggaggatcacttgagcccaggtggtcaaggctgcagtgagccctgatcgtgccactgcactccagcctcagcaacagagcaagaccctgtctccattttttttaagttaaaaagaaaagaaaggcccaggcagagatggctttgctgatgaattccatcaaacatttaatgaaaaattggtaacagatcacaaactcttccaaaagacagaatatacaaaaatcaattgtatctctatacacattagcaatgaacaatctaaaaatgaaattaagaaaacaatttcatttacaaaaacaccaaaaaagaataaaatacttaatctatttaacaaaagaagtataaagcatatactctgaaaactacaaaacactgtggaaattaaagacctaaataaatgaaaatatgtttcatgttgatgaatgaacacaattcctatcaaaatcccagttgccctctttgcagaaatggacaagctgatcttaaattcatatggaaattcaagaaacccagactagcgaaaaacaatcttgaagaaaagaacaaagttggaggactcacacatcctgatttcaaaacatactacaaagctacagctgaatcaagacaatgtagtctacaggatagacatgtagatcagtggaacagaactgagaacccagaaataaccctcacatttacagtcaagtgatttacaacaaggatgccaagacaatttattaaagaaagaattgtcttttcaacaaatggtgttggaacaactggatatccacatgcaaacaatgcagtttgaatgcttttctcacatcacaccctcaaattaattcatattggatcacaggcctaaatcccagggctaaaactataaaactcttagaagaaaatataggagtaaatctttgtgagcttggattaggttaaatataacaccaaaagcagaagcaaccaaagaaaaaacagataaattggacttcaaaatttaaaacctttgtacttcaaaggacactatcaaaaaagtgaaaagtccaatagcaaagacatggaatcaacctaggtacccaccaacagtggattagattttttttaatgtggcatatacaaaccatgaagtattatgcagccataaaaaagaatgaaatcatgtcctctgcagcaacatggatgcagctggaggccagtatcctaagtgagttaacacagaaacagaaaaccaaataccacatgttctcataagtgggagctaaatactgagtccacatggacagaaagatgggaacaaaagacagtggggactataagaagcgggagggaggggagaaaaggttgaaaacatacctattgggtactatgctcactacctgggtgatgggttcaatcgtgccccaaacctcagaatcacaaaatatacccttataacaaacctgcacatgtacttactgaatccaaaataaaagtttcaaaaaagtgaaaagtcaacctagagaatggaaagaacatatctgaaaatcatatatctgataagggacttgcatctagaatatatgaagaactcttacaactcagtaataaaaagacaacataatttttttaatgggcaaaggatctgactagacttttttcaataaagataaataaattgctaataagcacatgaaaagatgctcaaccatcactaatcattagggaaatacaaatcaaaactacaatgagttaccacctcacacctattaggataactactatcaaagtaacagaaaatgaggggatgcatggctcatgcctgtaatcccagtactgttgagaggctgaggtgggagaatggcttgagcctaggagttttgagaccagcctgggcagcacagcgaaatggaattttggtagagatgtgtctctaccaaaaataatttttaaaattggccaagtgtggcagcctgtgcctgtggtcctagctccttgggaggctgagatgggagaatcatttgagcccaggaggtcgaggctgcagtgaaccatgatcgcaccactgcactccagcctgggtgacagagcaagaccctctctcaaaaaaaaaacaaaacaaaacagaaaataacaagcgttggccaggcgcggtggctcacgcctgtgatcccagcactttgggaggccgaggcgggtggatcacaaggttgggagatcgagaccatcctggctaacacggtgaaaccccgtctctactaaaaatacaaaaaaaaattagctgggcgtggtggcgggagcctgtagtcccagctactcgggaggctgaagcatgagaatggtgtgaacctgggaggcggagcttgcagtgagccgagatcacgacactgcactccagcctgggtgacagagcaagactccatctcaaaaaaaaaaaaaaaaaaagaagaagaagaaaataacaagcgttgacaaggatgtgaataaattagaacccttgtgcactgcaggaatgtaaactggtacagccactatagaaaacagtatggcagttcctcaaaaaaattcaatagaattaccatatgctccagcaattccacttctgagtatacacccaaaacactgaaagcagggtctcaaagagattccaaacagcaacccaaacagataaatggataagcaaaatatggcatatatgtacaatgaaatattattcagccttaaaaaggaagaaaattctcacatgctacgacgtggatgaaccttgaagacattctgctaagtgaaataagccaatcgaaaaagacaaataccaccgggtgcggtggcccatgcctgtaatcctagcactttgggaggccaaggcaggcagatcacaaggtcagagtttgataccagcctggccaacatggtgaaaccccgtctctgctaaaaatacaaaaaattagctgggcatggtggtgcgcacctgtaaccccagctactcaggaggctgaggcaggagaactgcttgaacccaggaggtggaggtggcggtgagccgagatcgcaccattgcactccagcctgggctacaagagcgaaactccatctcgagaaaaaaaaaagaaaagaaaagacaaagacaaataccgtgtgattccacttatataagtacttagagtagtcaaagtcatggagacagaaagtagaatggtggctgccaggggctggaagagggggtaatgagttgttgtttgatgagtatggagtttcagttttataaaatgaaaagagttctgctgggtgtggtggttaatgactgtaatcctagcattttgagagaccaaggtgggcagatcacttaaggccaggagttcgagaccagcctggccaacatggcaaaaccccatctctattaaaaatacaactagccaggtttggtggcgaggggcctgtaatcccagctactcaggaggctgaggcacgagaatcgcttgaacccaggaggcagaggctgcagtgagctgagactgtgccactgccctctagcctgggggacagagtgatactctgtctcagaaaaacaaaacaaaacaaaacaaaaaaacaagatgaaaagagttctggagactggttgcaaaacaatgtgaatgtatttaacactactgaactgtacatgtaaaaatggttaagatggtaaattttatgttacacacacaaaaaaacaagtagaactggcagcagattctcaacagagactctactggcatgttgggtgagtcagttcttgttcatgtagagctatacctgctcattacaaaaatgtttaggatccctctttccctctcaataaacacagtaatgccctctggctagtgtcacaaaacaaagcaaaataaaacagttccacacacttcaaatgcccacttgatgactaggagagtgggggtagatggcagcaccagccccaagcaagtatccatggatgaggaagactacaggtggggtggaaacagtccaggcaaaggggggaagctgctccaactccatatcttcaattccagaaatatcccgtggcctctgcacatacacagaatcttcttgtctacccaaaggggcaccacctagttcatttcttttctcccttccagtctcagctcaaccatcccttctgagggaagccttccctgactccttcacctcctgattaggtcaattctcctgtattctatgctcaaagagcacaatgtacctcaccttcatagcacatatgcagcatttttacatatatttatgaatgtcagtcttccttactggaataaaaattctatgaaaaacaaaatgggtgaaggatctgaatagacatttttccaaagaagatatacaaatggccaataagtacatgacaagatgctcaatatcattagtcatcagggaaaatcaaatcaaaacacagtgagatcccacttcacacccactaagtggtataatcaaaaaaagatatgacaagtgctggtgagtatgtagagcaattggaaccctcacacactgctggtgggattgtaaactggtgcagccactctggaagacagtctggcagtttctcaaaaggttagatacagagttactatatgacccagccaattccactcctaggtatataaccaagataaatgaaaacgtattttcacacaaaaatctgtatacaaatgttcatagcagcattatgcataagagccccaaagtggaaacaacccaaatgtccatcaactgatgaatggataaataaatgtggtatatccatttaagggaatattatttggccataaaagaagtgaagggttgatacacgctacaggttggatgaaccttgaagacattatgctatgtaaaagaagctcatcacaaaaggcatgcataatatgattccagaattcacaacaggcaaatctatacagacactaagtagattactggttgcctagaactgggagctttgggagaattacagagggatggctaaagggtatggggtttctttagggggtgataaaaatgttctaatactgattgtgatgatgtttgcacaactctgcaaatatgctaaaccactaaatagtaccctttaagtgggtgaattatatgttaggtgaattatatgttatgtgaattatatatcaataaaactattaccaaaaaagtttctataataaaaagagaaacatcactattctaattgctgcccttactgctactcagaggtaacatccatatatcaataatatatactcttctaaataacaaaaatgggctcatagggctcataatgtccattctatacggcaatttgcaataaatatttaatatatacagtggagatactttcatgttagtatatatattctcacctattcttttaaatggctacccagtactctaataatagtaataaataataataacaacaataccagtagcttgtatttatacagtgcatctatgtgccaggaactattctaagtgctttacatatactaattcattcaatccttacaataaccctatgtggcaaattctatactctgtccattttacagaggaaggaactaagacacatagatataccataatttattttgtctactaatggacatttaaatttttttttaaaacatttatggccaggcatggtggctcacgcctataatcccagcactttgggaggccgaagcaggtggattgtttgaggtcaggagttcaagaccagcctggccgacgtggtgaaaccccatctctactaaaaatacaaaaattagccaggcgtgttgatgcacacctgtaatcccagctactcaggaggctgaggcatgagaatcactcgaacccgggaggtggaagttgcagtgagccgagatcgtgccattgcactccggcctgggtgacacaacgagactctgtctcaaaaaagaaaaaaaaaatggccgggtgcaatggctcatgcctgtaatcccagcactttgggaggctgaggcaggcggatcgcctgaggtcaggagtttgagaccagcctgaccaacatgcagaaaccccatctctactaaaaatacaaaattagccaggcctggtggcacacgcctataatcccagctacttgggaggctaaggcagaggaatcacttgaacctgagaggcggaggttgcagtgagtcgagatcacgccattgcactcctgcctgggcaacaggagtgaaactccatctcaaaaaaaaaaaaaaaatttttacatttatatttatttatttattattattatttttgagatcacaccactgcactccagcctgggtgactgagtgagactctgtctcaaaaactattaaaaaataaaaataaataaaattgtatagatggtgccaaaatgccctccaaggtggctgtagcagttacatacccctcgaagtagaggagagtgctaatgtcccctcatccccactactcacagccttcaccagtgcctctcccctcctcagcctctccctgcgcagaccctcacagcccacaggaaccttccacactacagcgcaggcccccagcaccctccctgtggtgctgcctgggactcgctccctcactcagccctgcctctcagaatccaacccggcgtaggtgtctgggcagagccccagaaagcaatgtagtgtcctcacccccaggctctccatggtcacttcagcccacaggggagatgggcatggagacgagagggatgaaggatgccttgagaaaggagagcccaaataaccctccaagacagttggaggctatatcaccccagcgagcctcactgactcacctcagcctcggccataccaatctgcctctccagatcctcggggaccattttccctctgaaaaagaaaatgcagagggtagagcagggacaggttctctgttgaaggcagggtaaggtggggttagcaatgcagagacaacagtgctagtttttccctcagggggtgaaacagatctcagggcagaggtgggagacgctggcaggctctggtagacaggaacagcaattctactgaatagcgaggggagagaggtccaccagcggtaagggtctgatgccagagctttctggcggcaggaagttacgctgtgcaaagctaggtcacagccatgtgggcagaaggaccttcacctctcatcagccttgaccactcggacactgtcggtgccaagtcccagaaacgcagctcccttctggatggagtagtgacactgtgggggaaggcagagggcaagttagcacaacttgatgggggaggggagagaaggtaaaagtcaagtgtgagctccaacaaatgggatcctgtagaccagggcttctcaaatgtcagcgtgcatacgaatcgcctgggtgtctggttaaaatgaaatgcaggttctggtccactaggtctggggtctagggtggggcccaagattctgcatttgtttgttttttttttttttggagacaagagtctccctctgtcacccaggctggagtgcagtggtgtcatctcggctcactgcaacttccgcctcccaggttcaagcaattctcgtgcctcagcctcctaagcagctgggactacaggtgcccaccaccatgcctggctaattttttgtattttagtaaagagggggtttcactatgtttcccagggtggtatcaaactcctgagctcaggcaatccacccacctcagcctctcaaagtgctgggattacaggcgtgagtcaccgtgcccggccagattctgcatttctaacaagccccaggtcataccaatgctgctggtccacagaccacactcttgagtaggaagagtatggactgtgtccactgcactcacggcccctcctctgcccccaaacagaaggcaatgtgaacaggagcagttacttgacctccttgattggaaggaagcacatccgcctgggggcaggctggccttggaggatgtagggagggcagggagaagacctggaaggtctctacttagctggctggagattagaatcaggagcccagggttgggcctgtgcctcttccccacctccttcgatgtgaatagggccaggggcggcagtgtgcggaggcccctctgcttgcaatccgggtagcgctgatagcgggccagatttacagcatacatgttggagatggagccacctgtcacagggagggggcggtggcaagaggaaggagcagtgggtcaagactggagcttgcctcccttccctttctaccagaagagctcatcaaagaagcaggtatgactggctcccaggccacaattctcaggatcataccatcccagaatggatccaggatcagcagatcctcttgaccacacctctccacatctggggctgcccccaagagacagcccccgtccggagatagcaggaactagaccactgaccccagggaatggtgacaaacatgagcatgaagggaccaggcagccgcctccctggcctggcctgggtccagctggagaggaatcaaagaggaatcatccctccctgccagacactagagcaagagaacggtgggggaggaggaactcataaaaagggcaaagaaaggtcctcctccttctcacaaaccagggcagaagattccgtccccagagctccagcccaccagggcccgcagtttcctcagcacctcctcttccatgagcacaaacacgggggcgatttcatatgtgtacctgccaggagagagaacgacgagaaaggagagatggggagggactgcccagacaggcccttaaactgcacaggagtcacaaaaaggaggcagtgaagagtgagcaaagcaacagtccaaggagaagaacgagttggtgacagaaccagggaagcaagaaagagaaaacaggggtcaggaggcctgagaaagtttggagaaagtgggtccaaaggatatgaggaaaaactctctgccgacagggattcccagaagcagtagagagagggcagaaccattctcctcccctacccctcaggcacctctctagcaaacctaaatcctttgtgggatggtagaggggccttgggatgctcactggctggtgttgaggctctcagtgataatgcgcccggccagagcatggggatccaacccagagaagagctggttgaagaaccgagggtgacctggagaaggagagtaagccagggagctcagagtagagctcagggcaaactcccaagtctcctcctcacagaagccagggcccaccagtcttgacactgtagcgaatcacagcccgacaccgctccaggatctgcttctgtgactcgccctggctccgcagctccaaatccagcagctgcttcagctcctcaggctccttccactcacagacctaggaagagagccggggatgctgggggcctgggatgcctgtggactggctgtcaaaccacacctccacagacacgagacacggccaacctgcactaaaaacaacttcgggatatttccaaagcaaaactctgaaaatgaacaagagtagtgaacacagtaagacccagaatgtaaatccctgaggtacccaggggggcagggatgaattctggggagaaatcttatcaaaggaggaaagttctgagccagatttggaaagagaaagagaaggcttgggccaggcgtggtagctcacgcctgtaacctcagcactttgggaggccgaggcaggcagattacctgaggtcaggagttcgagagcagcctggctaacatggtgaaaccccgtctctactaaaaatacaaaaattagccgggcgtggtggcacatgcctgtaatcccagctactcgggaggctgaggcaggagagctgcttgagcccgggagacggaggttgcagtgagccaagattgtgccactgcactccagcctggccgatagagcgagactctgtcaagaaagaaaggaagaaaggaaaaaaggaaggaagaaagaaggaaggaagggggggggagaaagaaaagaaaggaaaaaagaaaagagaaaagaaaagaaagaaagcttgatgggaaggaggaggaagaaaggactcaccttctgggagacactggttcctttctgaatggcctcatccacaacaaccccaaacacggcccggagcaaggcttccacagccactgggtccccagcaagggaggggagtgcttctgagtcagccatcaggatctgtggcagagcagagtcattccctactcagcctgtcaacccttcccggacctacccagcaggagcctcctctcccaaacgggcctgaggcccaaaccctgcagctcagtctcggcctccagtgcacagacaagggcaagtgagagtgcccagggagaaaaccagtgggaacaggtgggagagaaaaggcagtcagtgctgagcaagtggactctagtggccatttccacctaaggcagagacaagcttacctctctgctcaggagagccggaggcagggtgcacaggtagctcctcaggacagcaggaccaagatggcagaggaagtggggtgaaaagtgtacaattaagtgtttttttcataaattcacaaagttgttgcaaccatcatcactatctaacgccagaacattttcatcacccaaaaaaaaacctcagtagcagtcatttcccattctccccttccccgacccctggcaactactaatctactttgtttctgtagatttgtctagtctggccatttcatgtaaaacgggtcatacaggccaggcgcagtgggtcacgcctgtaatcccagcactttgggaggccgaggcgggcggatcacgaggtcaggagatcgagaccatcctggctaacacggtgaaaccccgtctctactaaaaatacaaaaaattagccgggtgtggtggcgggcccctgtagtcccagctagctactctggaggctgaggcaggagaatggcgtgaacccgggaggcagagcttgcagtgagcagagatcgcgccactgcaccccagcctaggcgacagagcgagactccatctcaaaaaaaaaaaaaagaaaaaaagaaaatactgaaaaagaaggaaaaagacttcaaaatattcatttgtggctatttctgggtgttgttatggatgatttttaagtttattatttatacacatctatatttttataactttatacaatcatttcacattgcttatggaattaaaataacggttctttttaaacaatataaaaattgtccgcgtgtggtggctcacacctgtaatcccagcactttgggatgctgaggtgggtggatcacctgaggtcaggggtttgagaccagcctggccaacatggcgaaacctcatttctactaaaaaatacacaattagccgggcgtggtggcgggtgcctgtaatcccagctactcaggaggctgaggcaggatccacctgaacctgtgaggcggaggttgcactgagccaagatggtaccactgcactccagcctgggcgacagagtgggactccatttcaaaaatatatatatatatggaggaattaagggggtacaagaattctaaaatatacaaatcatcaggctcaaggaatgtcccttgcacatcatgtggtttcccaactcctcaatccactgttatcaaaggtctaatggaaggcaaagggagccacacactgctcatctctattacgcaacccctcaacccccgctggctctcagggaagggaatgggttcagtttgttcagcaaacattgactgagtgttgtctacttctgagcgcctggctggcattaccctaggtgctgcatctgccctgtgggctccagctaacaggctggcaagagagacctgcatgtaaaataaagggaaattgccacaagagggagttgagaggtcaccatggaaaggcaggaaagttcaactggcccaggacaggcttcaaggacaaaacactaaggctctccttaaggcaatagagagctggtgcaggaaaagactcagcaggagtcattgcaatgctatttgaataagtgatggagtgggcctgagggaagagggagttagggaaggtcacacaggaggaggcctgcctggggacaaagggatctaggcaattgtctcctgaagcgctctcagccaggtttatggttagaaagctaaagtactctgtgctatctcccaatcaacaaaccctagtggctccacacccacattaataaaggcacaaactctcctatgtatacaatcttttctctgcttctagactgtactctcctgggtggagagaactaagtcttttccttcattaagtaaactaatagaaaacagggacccctcaaatgttagtttccatcttcttgattgtcctctcccctcccccagggacttgcacagaggcattacataaacatttgttaaatcaatcaatgatttgcaggtactggaaaaaatgctgcattctacttacatttgatttgcatcaaccaagaatctgtagtaatgataatagatttgcaaagggtgtttttccttctcatttattatcttatttgaccttcacaatagtattagaaattagcctaaataggtatttattcattcttgttttcaagatgaggattcttagctgaaagaaggtgaactaattgtccaaaattacaaaggtgacatgggaacaagcctagatcactgactttctgactttaggctacctcttccactgcatcacaggtccgtgtggcatttctcactatttctcatcattgacaaaaattaactgcagctaagataaagacagaaactgaaaatatacaaccataagaatacaagaagggggggtgaggggcgggcacagtggctcaagcctgtaatcccagcacttgggaggccgaggcaggtggatcacctgaggtcacctgaggtcaggagttcgagaccagcctgaccaacatggtgaaaccccgtctctactaaaaatacaaaaattagccgggtgtggtggtgcatgcctgtaatcccagctacttgggaggctgaggcagaagaatcgcttgaacccgggaggcagaggttgcagtgagccaagatcgcaccattgcattccagcctgggcagcaagagcaaaattccatctcaaaaaaaaaaacaagaataccagaaggggctgggagcagtggctcacgcctgtaatcccagcactttgggaggccagggcgggtggatcacgaggtcaggagatcgagaccatcctggctaatatggtgaaaccccatctctactaaaaatacaaaaaattagcccggcatggtggtgggcacctgcagtcccagctactcaggaggctgaggcaggagaacggcgagaacccgggaggcggagcttgcagtgagccgagatcatgccactgcactccagcctgggtgacagagcgagactccatctcaaaaaaaaaaaaaatatttatttattattttagagaataagttttgctgtatcacccaggctgaagtgcagtagcacaatcatgtcttactgcagcttcgaactcttgggctcaaacaattctcccacctcagcctcctgagtagctaggactacaggcacatgccagcatgccgggttaattttttaattttttgtaaacagggtctcactatgttgcccaggctggtcttaaactcttggcttcaagcaatcctcccacctcagcctcccaaagcactgggattacaggtgtgagccacctcgcctggccaaaatataatgtttttattgtgaatcagattatttattctatggtattttagtgttggttatattcttatattttatttatataatttttgtttgttaatctgacatctggtcatgttgctgaactccatagttttgatacattgtcaatcgtttctctttgtaagatgaatatatatgaaatcaaggaggctttagggtggccaggagctctcctaaaatcttagttttaatagtaaacatccctggcttgttcctagcaaagacagaaatgtttcaaatattttcccataaagcatgacttttgtctcaaaagctgaaagataagtgaaaaagagaaaatattttaaatgcagacgacaaagaatagttattatccataacacagacaggatttctaccatcaataagaaatatacaaatgatctacctttttttaatgggcaaaggatatgaacagacagtttacaaaaacaattaaaatggtcaaagagcaataaaatagtcccacctatttggaaggctgaagtgggaggatcacttgagctcacgagttggaaaccagcctaaggcaacaaagcgtggagacccatctatttatttatttatttatttatttattttttgagacagagtttcgctcttgttgcccaggctggagtgcaatggcacaatatgggctcactgcaacccccgcctcccgggttcaagtgattctcctgcctcagccacctggtaactgggattacaggcacgtgccaccaagcccagctaatttttttgtatttttagtagagatggggtttctccatgttggcccagctggtctcaaactcctggcctcaggtgatccgcccacctcggtctcccagagtgctgggattacaggcgtgagccaccgtgcctgtccagagacccatctcttaaaaaaaaaaaaggcaataagagaatattaacttcactattaatgacatgaaaattaaaacaaatactatttttcacccattaaactagtaactgtataaaaaattcatagcatacactaaacattgccaaagttgtaggaatagggaacattcacacatggttctgagtaaacatgggagttgttacaaacttttacaattcattttcacagaatctattaaaatttacatatccggccaggcatggtggctcaatcctgtaatcctagcactctaggaggccgaggccaatggatagcttgagcctaggaattcgagaccagcctgggcaacatggcaaaaccctgtctctacaaaaaacaaaaaaacaaaaaaaaaactacaaaattatccaggcacagttgcccacatctgtagtcccaactacttgggaggctaagatgggaggattccttgagcccaggaggttgaggctgcagtgtgccctgactgcaccattgcactccagcctgggcgacagaccaagaccctatctttaaacagaatgaaaatagggccgggtgtggtggctcacacctggaatcccagcactttgggaggccaaggtgggtagatgacctgaggtcaggagttcaagaccagcctgaccaacatggtgaaactccatctctactaaaaaatacaaaaaaattagccgggctggcagcaggcgccagctactcaggaggctaagccaggagaattgcttgaacctgggaggtggaggttgcagtgagccaagattgtgccattgcactctagcctgggtgacagagtgagactccatctcaaaaaaaaataaaaataaaaataaatttaaataaaagcacatatcctatctataaatccttataaatgcaaaaggtaacttttttttcttttttgagacagagtttcactcttattgcccaggaaaggcacgactctcgcctcaccacaactcccgcctcccgggttcaagtgattctcctgactcagcctctcgagtagctgggattacaggcatgtgccaccacgcccggctaattttgtatttttagaagagacgcggtttctccatgttggtcaggctggtctggaactcccgacctcagatgatccgcccacctcggcttcccaacgtgctgggattacaggtgtgagccaccctgcccggagcaaaaagataactatttaaggatgttcattattgtattgtttataaagcaaaaaaatctgaaacctaaatgttcatcaagatgggacaaggcacacacataaactggaatactgtgcaacagttttttaaatgttagctgactcagatgtctaaaatacactgtatggcgcattacaggtgctcaataaatactggttgaaaagatttttgtatgaacacagaaaaaagcctaaaagcatatataccaaactggtaagaatgattcccttcaggagcatgggataagtagagggggagaataaccattttgtgtcttttatacttttgcgttgtgtcgatttgtaaaataagtaggagctaattttcaaaaaagatttaaaagacttattcctggtgatgtttctttatctctctctttctccattttgtctctattttagaatgatcctaaaacacaaaaaacgtactttcaatggcccaaatcatggagtggctcagggaaatgaaatctgtctacaaaaaaaaaaaagttgagaatccttgtctttttttcatcatacagttttttttttcttttggtatcaccattacttctcctaaagtcacgacataatatcacctacagcagaaatgaggacttcagtggaattgacatctccttccatcaagcgcatttgcagtccatctttagcaggacctctctctaatggctaaggctaggcagaagaatttgaagacagtctggtttccattttcctaatgcagcctggcccaagagccaggactcccataagactagtctactgtgggagtcagggtcttttccacgtgtggaggctagtgtttgatgctggacggcctggagtaaagggcgaaggggagaaggtaaccaaccaggctggcctcgggattcgcagaggagggctggggctttgacttctgcagggaggtgagcagtgtggccaagggctactcaaggaacgcctctgcgagaattcagactgtggttgagcgcacaaagcaagagtgtgcgaagaaaagttaacgcctctcccagctgaccccaaaatctgctaatctgggcctgacggaaaaaattcggagaagaaccacctcggccgagttacgtgaaaaggctgggtacgaactactctggctctacttggggcgccggctcagagcgatgggcaggacgtccgcgaggaagaaagagtgacgatgatttttcaaggagtctgaaccagctcacccagcaaaccctcctcccatcgagcacccagcgtacaatcatcgaagggccgagggtcctgccctcagtctcgatggcggccggggcgcgccccggccacggcgcacgcgccggcctcagcgctccctcctccatgccctcggcgcacggcgccgcccactcacccagctgcacctctccgtgcgtccccaagctcacccgctctgaggctgcccccgctagtctagctgccgagcccggaagtggatgcagccgctcggcggagaggacgagggggagggggaagtgcttccggggaaacgggccggggttggtgtttgtaaacttgcctcggtcccggtgggggcagccgcggcggtggggttggcagggtgtgctggggcctggaggaggcgccgcgcggccagggagccagcgggaggccgcgcctggcaggtaggagcaagccccaaagaccgcagcgtcgtccgtacagacggcagcgcttcagtagctcgcaagccgtggggtgccgcgcgggaagggggaggggaggggaggaggggcgcgtggcgaagggagggggatctccgggggagggaggggaaaggccgtgcgcgcacaccgccccctgcccgcgcgtcccgccgcgtccccggcccgggagagggctctcggaggggacgcgggcgcgagcacgcatctcgcgcgcttctcggcactctccggctctgctcccggttggtgcagcgggtgcagaggctggctggccggagcgaggcgggcgacacgccgcgccgggcttcgcctgcctgtcctccacctccgcagcaagtttccctaccttcgggcggacggggagaacgcacacgtgtgggcactgccagtcccgtttctgcccgccaccgaagcacccagcgatggcccttgagctttcctccaccctagtcttgccgcctctgtaaagtgcgagcttttcgggccggcccactgggcacaaaagccccaaagggtctccgcccccttcttccattcctgagatggcaaatccaagcaactttccttttggcagagttcctccataggaggccccaattacttttgctcctgttggcttccactccttgcccaggagaccagttcctcctattgacctagaaagaaaactcttcttgactcatgtcctcgttctgagcttcacagagagcgcccagcaaaaaaaaaattcatatcgcacgttgtaatggcctgaagatgttgcatttagcagcccccctcttcctttctggtttcaggtttctgaaacagatcgtgagcttcatcaagagaattcaactggaaaaccaagactggtagactctctttttcttcagacaataggcaggagccaggcagagtccagggattcttggaacacctatcttttcttcggaggacactaagttctatttgaagacaaagttcaatatggcaacaggactgatgggacacgaaggagtcgctaccgtgatttggtgacagttcttcaaaacgacagtgtctcaaggaaaggtggacctaggaactcctgaacttttgggttgccttaagtgagaaatcagcatggctcaggtaaaaagctctagagtcctcctccaagataactgggaagcctgtttgcagtttcactcttgaatgctgccttagtcaacatattgaccaaccccagtgatccaagctctgtattaagcaccagggggagatctagaggaaggaaaggagacaggccacagcccctgccttcagggagcttccagtcaaatgaaggaggtaggctatactgcatcacaggcactgatgggacatttgcaaagcaacgtgtactcagtttacatttggtacattaagtgctgaggggtgtaagggagtgaatagtacggtgaatgcttcttttgtttttttccaacaggaatttattgagttcctgttgcatgcaaggcattgtgctgggaatacaaagatgaatacgattgtccttgtccccagtgagcttccaggctagttggggtcgggagagggatggaaagccatttatttttatattcacaatgccttgtatagtggctggctagtagtagagactctgaatctgttgattgaggaatgtgcaataataggggtatgtacataggagagaacagtacttctgcttggatagaaaaagaagatggaggttgaaagatgcataggattttgctaaacaagcgagaagggtgtttggacaaaaggaacagcatgggcaggagcttagagtcatgggaaaatgtgatgaggttccgagtactgcaggttgtttgatagttacggagtaagggatttaaatggggatagttatggaggtagtattgacagtgataggtgaggaagttgttccctgcagtaagcagagtgtaacccaaaggccttttatgcctcgctaagttaagcagcagagtagcatcagatcagtgttatgtagaaggtcattattgtggaggtagaggatggactggagagacagaatgagcagataggctgttgtagtcatctgagtagaatagctatgtgcacacatctccagagcttctcccagcttgcttctagggaacctccctaccagtctcaccaggatggcagtctgattgtagtataattggctttcctccagctgcttctgaatgcacagcttcctcctttccatatagaataggagcctgtcagtttcttcttcctttgtgttttgcaacccacttctcagcattgtattcagtcttctgagaatgctgccttccactaaggactgaactttgtgctagacactgttaagcgttttacgtcttagtttacttttcatcaaccctgtaaggataagcattatgacaggcatttttcatgtaaggaaactaaggcttgcaaaggtggaataacttgcccaagattatagagtgcaaacagctgagctaagattttaactctggatctttcactccaaagtcccagaaggtggagggaggggtcccagaacgtactgatcatctaaaaggaatttcttcataaatttgtgagtttgctgaccaacgatttcttaaaattttttttttcagtaagaaaagtattttctttaatgccggctaaccgaagtcagtttgaagaatgtagcagttttctggaaatttacttaaacataccttacttaagtaattgtttaaattatatatggagcaaggaatgtgaaaaaaaatgtgatcatacaagcacacatataaatggcctaagaggtcaagagaaatgctgaactccaaaaatcatatcagttgcaattggtaaatacttagggagtttaaaatctaaagggagaaatagcctgtagtcccaggaccttaggagactgaggctggaggattgtttaagctcaggagttccacaccagcctaggcaacatggtgaaaccccgtctctataaatacaaaaaaaaatagccgggtgtggtggcattctcctgaagtcccagttactcaggaggtagaggtagaaggatcgcttaagccagggaggtcaagagtgcagtgagccgagatcgtgccactgcactccagcctgggcgacagagtgacaccctgtctcaaccaacaagcaaaaaatgaaacaaaccgatagaaaatacagttggcaccagcaagatctgccaatcaaaagtgggctctgaagctaaggggtgtgtgtgtgtgtgtgtgtgtgtgtgtgtgtgtgtgcgcgcgcgcgctctgaagctaaggggtgtgtgtgtgtgtgtgtgtgtgtgagtgacggagggattctcgctctgttgcccaggctggagtgcagtggcgcgatttcggctcactgcagcctccgcctcccgggttcaagcaattcttctgcctcagcctcccgagtagctgggaccgcaggtgtgtgccaccacacctggctaattcttgtatttttagtatagacaaggtttcacctattgtccaggcttgtctcgaactcctgacttcgtgatccgcccgcctcattctcccaaagtgctgggattataggtgtgagccactgcactcggcccagctgagggctgttgagggaggaaggaggaaggtcctgaaggaatctcctgtgtcagtgggttagcaagatggaacctcatacccactcacagttaaggcctagaaataccttcaaagaaatatgtagccacacactgcctagtgctgatgacaaaggtgtcagtaatacttgattatttacttgatctatatttaaatgctgaaggatgacaagataagtcgttcctggtgagatgagttagggaggactcttgaaggaagcaaggctttggcagtgaggagggacattccctggagagaagcagtttgtagcagggtgtaaaaggtagttctatagaggatggcagtctgtttttgccctgccctgccaggtgacctgacacctcatctcctttcaacttaggcaagtctcctggcttgtgaaggcctagcaggtgtgagtttggttcccactgcagccagcaagaagatgatgctgagccagattgccagcaagcaggccgagaatggcgagcgggcaggtagccctgatgtgctgaggtgctcgagtcaggtacagcgcttgagtccattgtggcacctggggatcgggtggcccaagctctctgccaggagataccaagctctgattccttgatgcttcctcatagggaagtggggcaaggggatccaactggggaatggatgaacattggtatttcagaaagctaaggaaggtcttttgtgtgccttcaactcttttaagaccaggtgcttggagaggaaatagttgtatacttcctctaagctttcggggcaggtggtttactctcatttatgaattttgtctgagagctgcattgggtctcatctcatgttccgagatgggctatgagtttagatttgatttgtcttcaaagggtcaccgaaaagacagtgataagtcccggagccgcaaagatgatgacagcttgtctgaggcctctcattcaaaaaagactgttaaaaaggcaggtaatggggtgatcccccaaactcatacagtttggtaatggggtaatattcctccttcttccctctaccatgtaacctggagctttccctagatgctttgatctctgatagccagtgagtgagtcccccagatttcatccagagactaccttggtagttgatctcctgccttgctggaacagtaatggtacaggttggggagcatgagatcccagatcccgaggcatgggagcaggcaggctccagctcaagtcatactcagactgctgggtttgacaggatagacagcttacccactccacctccttccccaaagggtctcttacctccatggagtacaggagatggcagcacctttagacagcatcagagaggttcctttctccaacagctggaagtggacccagagtagaacagtgtctccaggaagagggcagtggtggcctcatgacatgcctgattattgcccccaggtggtggtagtggaacaaaatggttcttttcaagtaaagattcccaaaaattttgtttgtgaacactgctttggagcctttcggagcagttaccacctaaagaggcacatccttattcacactggtaagtctcttgtttatattcaaaagggggagaatagtctatcgcttgtattccatgtctgtttgtggctctagttgggtttattttaatgggtaagtattagaaatgaaggaagaagataagtcaatgaagcagagagattgcatggctttgtatctggtgtcactgagaccagcacctttggggacctctccccatttatgatcacttaggtgtctacacattactaagagttaaagtttctgagaaaactggaatgaggtccctactgtacatacctccccacattcacttctctgtccacctgggccaggtgagaagccatttgaatgcgatatatgtgatatgcgtttcatccagaagtaccacctggaacgccacaagcgtgtgcacagtggtgaaaagccttaccagtgtgaacggtgtcatcaggtaaggctcatccctgctacaataccccacacacacttttccttccccaagaatcagggccaccctccactcctgcctgacaaaagagccaccagcgttactcgccataatagttaacacatcggggtgaagtgcatctgtctggccttatgcagctgatcatggggagcagcaattagaacattgtaataataataataatagcattccatatcacttactctatgccaggcactgtgagagcatactttacatagatgattttatttaatcctcacattgactccctaaggtagctgtattgtccttatttcacgtatgggaaaattgagattcagagaagttaagtttcccagggacaccgcagatcacgaacagagctgggattcagtccaacttcagagctaatgcactttggaggaagagatacaatctttgccctgggggtcagtatctgatctgatgagaatgtaagagctggggccaaaacaagacaagaacaagagatgagaaatgataatagctaacacttcctggatgcattgctaggtcccaagctttgctctgcactcttacactgaatcttcagacgctagaataaaagctccatgagggcagagactttgttcctctggttctctactctgtatctgccttgagatagatactcaataaatctttgatgaataaagcagctgtgctgtgagtaggtacttttagcctcgctttgcagttttgcagatgagtatgcagattctgggctgttaggtaacttgcccaaggtcacacagctgctgagtgatagagccaagattcagccccaggcggtctggcctgagagcttggattctccaccaccgtgtgctcctgctgtctgtgcacgtgctgaggggatggagaatgtggtatctgcctcctgtgagaggaatgagttagccaacaggtagctgcgtttgtctgctcaggcacttaaccctccctttcttctcagtgtttttctcggacagatcgattactcagacacaaacggatgtgccaagggtgccagtccaagacttccgacgggcagttttctctataggcgcaaggggccccgggtggtgggagtgatcagaagaacctgccgaagagcacaccccctctggtctgatggtcccaccaccgccccatgtgaacctgtcccactcctggaggagtggacccaggagaccagaagagtgcatcaggggacagtggccccagaacctcagctctgtaaataatctgagactatgagtatctcggggaagttcttacagcattcctgggtaggggagctagtccctggacccttggctgaggtcataggtggggactcaaggtacaggaccaagactgaagtgtggctcccacaaccttggactccagctggcagctgaaatggaaaagattggggaaggggatttgtttgttctgttcttgtttttgtttatccaaaagcaacttcagcgggtaaactgtggatacaggtaatccagaggcataagagtcctggtccaaagtagggactatagctggtccagctctccccaaaaattgggtttttagttgcagtagctcctcagtgtttcacaatcctgcacttcgcctcctttttgaggaagaataaggtcaggaatggcagctgagcttactttggcttccttatacactgtagggacaaaaggaaaaacggggtggagcagacaagggctggatccaaaaagtggatggcacctcttccttcctcaagggaaaaggaagagttgtgccagtgggtgttgtcatggcccatgtcacattggcacctgatggcatcagctcaaatgcctttaggaggaaacttgggtgagagtggcccatgaagcccttttcttctttttttggggagtcggtcttggagatggtatgtggctacctcgctgccattgactcctaaagtgagacagatgtgttgagcaaggagtcatggaagtcaaagtgggttctctctccttgtgccctcttaggaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaacaagatctcggcttgcttcctgatggccatccctacccaacagagtgtgggggatgggggtgggggtgctgcagagaaaagactaaagaagaaacctaatgtaggttccattcttaaccatattctttgctcctctctgctccaataccaccaccttgtccactcccaaaaaagtaatcgggtgtgtgtgtgtgtgtgagagagagtgtgtgtgagatatgaatgcatgtatttgtatgcttgcaggagatggcatattattgagccaaacccttctctggccctcaccttcagggaggatgagtggaaaatagcctcctcttgcccaaacatgaagggtgcttgaggtctcagcaggagctgaagaacacaatttggggaacagaagggcttttgttttggagggtttttttttttaagatgaattcaacagcctggtggttaggatgtttctaacccaagccagggcttgtgaacatgaattttctaaggtgaaataaaccttttctttctgctaaagaaagaatccttatgggaagttttggggtttggttgacccccactgtaacctgacctgacctgtggcgggtacgggaactgtcttagtaatcatggagactggctgaacctgagtgccaagctgtcagtagggtctgagatgggaaactcctgaaagtatgatttcatttcccagaaaatgtaaagaatggataccagcaatgattcctggctgttacctattctggaggggtggggttggggagggggttgtccatacctctgtggtatgagtatttcagggaaaaagaaagcaggcatggcacccattcgattttccctgacagcatctgagatccttttggggagacgctgaggagtgtttgctgccatgtactcttacagctctatgctgacactcccatttgatgtggtccagaacttagacctcagtccttggatcagccctgtggtccctgcaagcaggggcatctttctgcatgtgagccagcccccttcctgttcaagggttctgctggatctgggcttttcctgtccttcacttctgggatgattcaccccacatcttccagtaccctgtaaaccattttaaaatatttagaaaactatcctcccaaaaatgcttttgaaaatgagagccctctgtccctgccacttacagctagtctctttgggataggggtgtatgtggagagattcatgtaagtctcacatgagtgacctgtgcccctatgtgtactaatgtgtgtactgggtcagaaggtgccctgggttcccacagaccttggtttcctgcctgggtgggtgggagggagggaacttcagagagtatgtgcgaacagccatagcagagccacccctgccaaggacccagtgagggaaactcaggagcaggtggttggttcagttcccgcgctgatgtctggggcagtgcatgtgtgagaagagaggcgcaaagcagtgaaaggagtgatttggcatccagagggcccgggagccccacggataccccagggaagccactgactcacaccgctgcagaggctcctgggcccaatgcccgacccctgctggccagcatggggcctagcactggaagatgcctcaggtgtgtttggagtgggggaaacggaagtagggcacgctctcagagaccaggatagagagtcagggaacctgggaaagagtagtgccagttccgggtaggctgctgcaccaggccctaccagctcaggctataaacagtctgctttgccccaagtcttttccgtccacccccaacagccttgtcatcacttagctactgatcacgcccatggcttgacattggagggttacattagtggagtccgccacagcttcgaaccctctccccagatgccctttgcctctgctgtggccctggggttttatcaactgtccccttcctatcctcctctccaccctgttttttgttttttttttttttaaataatattttgctatgggggaggggaatatcaaatggacaagatcacttttaaatggtagtttttataagatgttataaacttgtatctttttaccattaaagtgcagtgtatgttccttcgtgatatatttaggatatttaaataaaaggaaaatggggcttttctacatactatctcctctttggggaagctttttcatactggttttagttgttttccttttttctccctacataatcaccccacaacttccagcaccctataagccattttaaaaccccttctccacagaggaacaagcaagtaggagcaaaaacagggcatcagttctgagcaagacgaaaaagcacacgcagcaggacggaaggaggctagacaccaacagatgcagtgtctctgacctgggacccccctgcatccgcagcacttgagaattcataggccctttccagacctggcttcctgggtcccagggtgcaccccgggagtttcctgcacattcgcgcttgggcacctctccctgccctcaggtggcaagaggaggatggacaagagctttcccgaggcccaggctataaacagtctgctttggccttgatgaggtaaagcaaagtgacagctgtggtctgaggtaagactttattgtatacttgggtggggtagcccagatggatgcaaggttgcaggcatgggaagcagccctcttgggtgtcactctgaaaatgaagtagggtggtggccgcacctcgccagtgaattagtcccctaccaaggtcttacagacccacccttcctctcaccctccagttcccactgtcctccaaggagaagagccttgggtaagtgtccctccctccttcagagagtgggactgtctgcctcttgaaagcgaggattgatggtggtcgtgatggcacttttgtagagaggattactgtcctggagaaagatgttgcagattataagcaaaaatcccaggattcctcgtcccctttctagacctaagaggccagccttgagccgaatcctaggagctgatggaagttagcagaggggttggttacatgtgccaggggctgggggaacccagtgggaggaatcagggctggtcttgtggtgggggaacagctaaaaaggggcctaaccaggaagtctcctcacctgcttccagttgagttgttgctgctccttctcaaagcgactgtattcccggcggtcatagatttccaccgagagccggtaagccaggaccagccccagccccactgccacgatgccccctacgcagcccagcacaatggcctgcgtgtggtctgctccctctgtgaacaagaaaccagacacacttgtgggagctggagcatagggacagatcatcagttgctcacagtgtgtccagcctgtccaaccctgtctgtcactgaaagcaaagggaacccagggaggtccaaggttatcctcaccgcccagggccttagcctcgtccacttgctcaattgcctctgcctttgtcctggattcacagttctgcttcagcccccagcctgtttcccattatcttcactctgcatccccagagttgagaccctgcccatcaaacttccagggtttgtggcatccctgcccacttactttcttggggtctcactctgagcacgaccgtgcctctggcgtcatcctccaccaagaagaagaacagctggttgtccagggtccgctctttgcaccagccatcatccaagataggggccaaggccagggtcacattggtatgggcacaagctgtactgcagttggtggccagtgggccagtcctgaaggccccacactctgcacagtccctgtgtagtagatgccaataggttaccagctgggcagttgtcacccaatgccccttgcccaactacaagcaggacggagagtaggcagatgggagtagctcaacaagccccactgtgcccctgctcccaagatgcaagacctgaggcctcaccggtgtctctcgcatggtgtcttgcagcctgggcattggtcgcatagagcaccatagtagccgtccaagcactggcagcggttgcatttgcagcgtccatgcccactgcagagccctccctcgggactgatgcaactgtccatgtccccactgcattcgcatgctctgcccgtgcggttggcatgacagtgacatactccacattggcagcgaccaaagcctggggtagagccatgcagagggtgacaaccatactccacacacacagttggccatcatgtggcacgacaagcccacgcatccaatctttttgaagtatgccaaccacaccctctaacccatacaccggaatcttttgatatttgccttccatgccaggagattcccagagcctaagtgccttgggaaggcctctcagaccccgcccttctccccaaggctccaggtacctccgcagaggatgccctcatgtcgctcacagctggcatcgtcacactcgcacagatgcccagagctctgtccactgcagctgcagcgtccacattgacagtgaccctttccactgcacaggggccctgtgccattgggagcccggcacccagattccaggtctggggaggacagctctgccacagagcactcacagagccgacctaggcggccaggggcacagctggaaggggaaggcaaaggagagaagtaggtcagagggtttgatcacccctgacttgtctctcccaggaacctctaaacccaagttctcaaaagagttggagacagacaaacagctgaaaggatgttaagtatagtgaaacactgaggggtgagagagtggagggagccccagtcagggggagggcctggacatacatgggaagcttcaagggatgaaactgagtggggagtcgggatgtcgaggagactcctgtgggggggatggaaagcagcggaggaatacgggccagggttggttggttgttgggagccaggtggttgaagggaagaggaggccctcacctgcatacaccacattgtaggtgtccctggccatcactgcagtggggagcctggggctgggtgtcactgcaattacagtcacacagcgtgtgcaactccacaatcagctcctctgagaagccaagggcccggagcctcaggagatggggctctgggaggcagtgggtggcttggagagaaacccagaaagtcacctgagaagaggcaggaatcaggccatggttatacacatgcacacacacataccccaaactcaccaatcatccagaacctcaccccttagtaaatgaagggatggggtcatgttaacacccaactcctagaaacatgcctgaggaagccactcagactgctccaggaaggatggatggaggactacctcaggctctcatgtcactccctgtacctgccacccatcttttcctgcctgcttaatttcccactcccacctccccctgcccgccttctgcctgtgcttgctggctctcaccgtctggttgattcggacgtggttgcactgtcctcgatcctcagccttaccctccctcttctcaggaccctcacactgggattcgtaagaaatgtggaccccaggagggagtgaagagtgttcaagggtcacggtggaagacaggctctatgggaagagagcgagtggataaccacgtgaaggcagaaaaggactccaaccccaccttatgtcctctccaggtgttcccaattctgccagcaccctgccctctgccacctggggctccttccattctgcccagtcgaggcatttctggagggaggacccgtgagaaccttgcatagaacatacaggatccagaggcctctaatacagcatttcagtgcagctgccagcaagggccactgagggtcacaggctggccaggtgctgtaaatgtacagagaccatgtttgtgaagccccacatcaggacacataacctgggtgcatgccaggtctaaagggcagattcattacagagtttatcttgggaaatttgatactgtctcagattttcttgccataggtttaggagatgctccctgttatcaagaagcctacagcctagttgcagaggtaagacctaaaccactaagaatttttatggttccttctacctgtaaaattctatggttcttgtgaagaatagctctgaattatttataaacttagtgaaagcaggctccagatctcacattgtttatgtacagactgactggggacaaatgccagcccttctgtttgttatctttgtgaccttggacaagtcacttagcctccttgtgtgggtttcctcatctgtaaaatagggatggtaacagttatgaagcaaggcttttggcagggttaaatgaagtagcaaacagtatgtacacctaggatggtgggcgcatgaaataaaagctcagtgattgaaactttcctttcttgcccagagcagagctccatgctgtctgcatgtcagatgttttaagatttatgaatgtaagattgaacagttaatgacagccacatgcagactataggtaggagctgtggaatgttagaccaaaaagtgaccatttcctcttagttctgccaccccacccaagggcccctttccacctttccctagtgcccaccctcaccatctccccttcccctggcccctcacattataagcatccatgatgagctgtaccacgttgctggagtcctcactcagctccccaactgcagacttaggaatcagtttactcagctcctgagttttggggagttaagggaaatggtgggtcacagctctaggaaaatgggctcccggaggtctggaaggagggcatatgggggacggagaatgtatctttgggggaattgagaaaggttgggatggggctgggggatctgacatgtagacagctctcacctggtagacaggcagtgcggcactggtgacagcaaagatgggctggatatttgctgcagagagggcctgggctacctgacccacagaagggtagtcctgggacagggagcagggacaaggtgagccccacaggtttcccccacaacatgcaaggtgccctcagcccagggaatccaggaaccaaggttccaccagctggaggagccctggaggcttgctatggaataggaaggaggtagggaatggggtgacaaaggtgtcctgtctcggcagctgaaaggaggaactgctggagaagatggcagggtgtctacagggtggttactggtgaggactgtaaggctgggagtgggagtcctggaaggaaagaggtgtggctgaaatggggagaggcagggtgacaatagggactcacaaactctgtgctgcgactgtagaggccattgctgtccaagtggcagtgcccatcactgggcatgaaaatgccgcccaacttcccgtccccagctgtatggaatgtgtcgtctgaagtgaacaccagcagccgggacacatttctccagccaatctgctcctgagttacagtgggggtggtaggctatgcacctgggcatggcccttgagccaccccagccagctctgtgagccaagaatgtggccagcctcactctgagtcagcttgtccatccccttgcctccagtaccttgcttctccctgctctctccagccccctaaagaaggctgctgctagtggaggcttacttgtgaattcgaaaaacatgcctcctcctcaagatattttactccaacccaccaggtaattgctaaatatacaaactacagcaactatggtatgaatggcaccccctagaactgtgcactacacaaccataaggggcagtcctgttcccaaacagacctccaggctcagatccccgccccacctcctcacctggcagagtgcagcctgcagaatggcatcgaagccaccttcaggcgagtccagattgccggacacactctggcgccccacctcccgctcgaaggcttgtgcgtcccccgtcagggacagcacatggtgaaagctgaatggtgactggcagcgctccagccgggtggggcaggggtggcgcagtttggagggtactgtgctcacaaagggcagcaccgttttgtccacaaaggaaccaaaacctgggagaggagaggaatgaaggttgtgccagaagtcgcagggcagcaacagaggacccatgagagcgctctatgggaagtggggtggggaggacggtgatgggagagggtgcacctagggggcagggacctggtaactggcaagcaaagcagtgagaccactggctcagggaagtggcaggtagaagacattaagaggaggacacaacttcctgggcaaatgggaacttccagaaggcggaagaaggcccgggtataggatatggtagcagcatgaggcaaaggaaggaaatttgaatagaggagagttggcacagaatgtggagccagggacagtggcatctaggtcttgtccagggagacttgcatcagggcaggttccaggttggtaggcccagggcagctgtccaggcccagagagtgcctgagcacagtctctccagacgctgggtctcaggcctgtaaaacggatagtctcttgagtcctctccagctctgacctagaagatgggtgtctagggagagatgcaggaacgaacctgtggcctggctaggcctgtcaacaactgggagggcaagttggggcccttgtgagtccaggatgttggcagaggctagggcagtggttgaataggcaagggctaacagggcgggaggcagcgctcggctcaccaatgcgcacagaatgggtgacttcctgcagccggaccagcagagcgtgcccgagctggcgcacgcgttccaggtcgtccttcatggagtagctcaggtccataaggtagtacaggtccaccgggtatccctcagcacgaaggaagcggacctggagctgctggggctcccctagggggtgggcggcgggcgggtcagcagagcgcattggaacgccagcctagacctctggcctggccccgcctcccctaactcaccaggccgcagcgtgacccggacccgctgcggcgccagctgggtggcaccctctccgcgggcgccctggctgagcggctggtcctgcagcacctcctgctggccgcggggctcctccagctcctccagcgggcagcctcgagccagcagctcctctcgtcgggcgcagcgccgcgcctccgcctctcccgacgcggtgaagttctgctcagcaagaaaaggcgcgtcgggacccggtcctgcataggccctgggccccgctcccaaaaacaccctgcaaacccggccacctctaatgcccccacctccagtccactccttgagtccctgattccctcccctcttcctcgccacagctacccttgaactccggtcttttttgttgttttgttttgtttttgagacggagtctcactctgtcacccaggctggagtgctgcggtgctatctccgctcactgcaacctccacctcccgggttcaagtgattctcgtacctcagcctcccggtagctgggactacaggcatgtgccaccacgcccaggttttttgtatttttagtagagacgggatttccccatataggtcaggctggtctcaaacttttgacctcaagtgcgcccacctcagcctcccaaagtgctgggattacagacgtgaaccaccacgccttttttttttttcctactgtaaagacagggtcttgcttttttgcccagtcttgtttcgaactcctggccccaagaaatcctcctgccccagcctcccaaagtactgggattacaggcatgaaccgccaccggtggaactctggtcctttcttccttgtcagagccccacttcctatagcagtcccccacccctcccctatctcaactcccccttgccccagccacctacccctctcctccccaatagagtcacagacttcctgttgagatcttagagacttcactaccacaaaaaaacaggggccttgcctcctaggccaacctccccagcaagctcacaccaaaatgggaaggtggtcagactaagacccacagctccttggaaaggaaaggataagaacagaagaggaggcgtcctccccaccaatatgtctggtatccctgggactggttgggaagccacaggggaaggaaatggttagagcggcttctcagctggccctaggtgtcaggagactggagaagccagacacagacctgaccatctcaagagcgccagctccccagctccagcctggcacctctgcctctctgccttgtgcagactcagtatctacccttcttgtccagtcagattcactgtgtgcctttctcctgggtccctgtgtgcctttctcctgggtcctctaagcatctgtagctctgcttccatgtgaatttgcccccatctcttatctgggctcccacactgatctaaccctccatcttacactgagagaggcagacctgcccccatcccagcttgggcacccctcctgctctgctgctccatgagttctgtctctttaaagcataaacaaacaacagctttgtttgaagagccagggagacacctgctccctagcatccttcttggccacttaggtagctcaagcctttccagtccccctcaagcccatatgcttccaccccttccctttctacctgtccagtcataggctactacacacccaggaacagaatgcctccacccaaaacacagacttagaaatctaaccacacacttgctgctatggactgaactctgcacccctacccctccccacccccaccccatcctctgttgaagccctaaccctccatgtgatggtatttggagatggagcctttgggaggtacctaggcttagatgagggcctaagggtggaaccctcatgatggaattagtgcgcttacaagaagagaggcagttcccacccccatcccccaaccccatccccactatgtgaggacacagcgagaaggtagccagtctgcaagcaaggaagagggccctaactgaggaaccaaatcagccagcactttgatcttggacttcccagcttccaacattaggagaaatgaattcctgttgcttaaaccacccagcttatggtattttgttatggcagcccgcactgggtagtacctttctcccatgtttacatacacaacagctccctctacctatacacaagcatgaattcccacaagcacatactttctcccaattcatggtcacaaattctctccatatatacacaagcaaatggatacagacataatcctaagtgcacaagaaacttgcatgcatgtgtatgcacacacgtatatccacacacaggagtcctatgtgcacaaactcagtcacacatgagactgtggagtgttcccagaaaatcatacatgtgcccacacaatcacacacatatatccaggctgcacatacatatacacatacacatacacatacacatggttcaaagaccataggcccatctttaccagttgcttgcaccatgcacagctggggtgtgagaggatgcacttctggcaggagggggctggctggcaggaccccagcatggacaggtgaggattccgccattctgtggcatcccctgtggatgggatcttggcgtccaattcactctcacctctgctcaggaccagcagcaaaacaaggaccattggcaaagccaccatgccctgtaataggatataaagggggacatgtgggtcctcagggaggactctcaaactctcagtcctctaaacttagcttgtggttatcactctcaaaactctgccccaacactttatctcccctcatagtttcacttcccctgtggattcagcagtttcttcaaaataatgggaaggagcaggtatcacgcaaaggtaggggcctccggacgtggtggctcatgcctgttatctcagcactttaggaagccaaggtgggtggatcacctgagctcaggaattcgaaaccagcctagtcaacatggcgaaaccccatctctactaaaaatacaaaaattagtcaggcatggtggcgtgcacctgtaatcccagttactcaggaagctgaggcaagagaattgcttgaaccagggaggcggaggttgtagtgagccgagatcacaccactgcacaccagcctgggtgacaaagcaagaatctgtcttaaaaaaaaaaaaaataggggcctcagagaagatctgtccttcctgtgtgcagacttcatgtggccaaggtgggcaaaatggcctactaaaggatttggggactgagcctgaaagcactaaagtctgcacccagttctatttaccgagatcccaagccgtagtggtagaagagccaaacaggaaacagaccagattctggtgctgctgcagtcactcactggctgtggggcaagtcagactttctctctgggctttagtttccacatctgcaaagtggagaagttgaataaatagtctgacatacttggcggcttttacaatcttggattctaaataagagaagagggtcagtgactgggaattaaagaaaagaaagctggagcagatgagggagtgtgtgaaagagtcaaggaagaatagttctgcttggttgacatggtagcaagaggaatgaagattagaccacaagaactctctgcaggtctgggataaggggagaaaggccagtgttggcaaaaaaattttctactttctgtactttgcacaaagataatctagattgaagaaagagcctggagacagggtaataccttgagtgaccttcaggaaagccaagcaaattcctgattttaaaaaaacatattaattttttaaaatgagcaggtaattcatttaccacgcttcataagtcaaaaagttaaatcccattggcccttttttttttgcagaaatggaaaagctgatcctaaaatttatatggaattgctcggaaccccaaatagccaaaataatcttgtaaaaaagatactgcaaagctacagtgatcaagacagcattggctggtcgcagtggctcatgcgtgtaatcccagtgctggtgagaagacagcttgaacccagtagtttgaggctgcagtgagctatgatcgtgtcactgtactttgccctgggcaacagagtgaaaccctgtctcttaaaaagaaaaaaagaagacagtgtggtactggcataaggatacacatatattatacatcagtggaatagaattgaaagagtccagaaataaactatgcttctgtggccaattgatttccaacaagggtgccaaaccattcaatgagaaaaactgtcttcaaaaaatggggctggggctgggcacagtggctcatgcctgtaatcccagcactttgggaggccgaggcaggtggatcacttgaggtcaggagttcgagaccagcctggacaacatggtgaaaccccgtctctactaaaaatacaaaaactagctgggtgtggtggtgggcgcctgtaatcccagctactcaggaggctgaggcaggagaatcacatgatcccaggaggcagaggttgcagtgagctgcaattgtgccactgccctgcagcctggacaacagagtgaaactctgtcttttttgttttgttttgtttttttgagatggagtcttgctcaggctggagtgcagtcgcgccatctcagctcactgcaacctctgcctcccagattcaagcaattctctggcctcaggcgcccaagtatctgggactacaggcatgcgccaccacacccgactagtttttgtatttttagtagagagagggtttgaccacattggccgggctggtctcaaactcctgacctcaagtgatccacctgcctcaggctcccaaagtgctgggattacaggcatgagctgggattacatgcccagctgaaactccatctttaaaaaaaggccaggtaccgtggctcatgcctgtaatcccaacactttgggaggccgagacaggcagatcacaaggtcaggagttcaagaccagcctggctaacatagtgaaaccccgtctctactaaaaatacaaaaattagccgggtgtagtggcacacgccaccactttttctcaaaaaataaaaggtgctttcaacatgcaaaagaatgaagttggaccccctccccacctcacaccatatacaaaggttaactgaaaagagatcaaagccctaaatataactactaaaactataaattcttagaagaaagtatataggtaaatcttcataatcttggacttggtaatggattcttagctgtaataccaaaagcacaaacaacaaaaggaaaaacagatacattggacttcatcaaaaatttaaagttttgtgcatcaaagacaatgtcaagagagcgaagacaacccacagaatgggagaaaatatttgcagattatatatcagatgagtatccttaatatataacgaactcttacaattcaacaacaaaaagacaacccaactttcaaaatgagcaaaagacttaaaaagacatttcttcaaagaagatagacaaatagccacccagcaaatgaaaagatgctcaacactattaatcattaggaaaatgcaaatgaaacccacaatgatctgggtatggtggctcacacctgtaatcctagcactttgggaggctgaggtgggtggatcacttgaggtcaggagttcaagaccggcctgggcaacatggtgaaaccccatctttgctaaaaatacaaaacttaactgggcatggtggtacatgcctgtagctccagctactcgggaaactgaggcacaagaatcgcttgaacccgggaggcagaggcttcagtgagccaagatcgggccactgcactccagcctaggcgacagagcgagaccctgtctcaaaaaaaaaaaaaaaaaaaaaaaagaaagaaagaaaagaaaagaagaagaaaaaaaccacaatgagataccacttcacttctactagaatgactatcaaaaaatgaaaaacaatgagtgttgatgagaacatggagaaattgggatctttatacattaccgtgtaaggaatgtaaagtggtacaatctctgtggaaaacaatttggttcctcaataaattgagcataggattatcctataacctggcaatttcactcttaggtatatactcagaagaattgaaaacaggtgttcaaacaaaaactggtacagaaatgttcacagcagcactactcacaatagctaaaaggtagaaagaacccagatgtccatcaactgatgaatggataaagaaaaggtggtatatccatacagcagaacgttatttggccataaaaagcaatgaaatgggtctgggcacagtggctcacgactgtaatcccagcactttgggaggccgaggcgggtggatcacttgagatcaggagttcaaaaccagccataccaacatggtgaaaccccatatctactaaaaatacaaaaattatccaggcatggtggtggtctcctgtaaccctagctacttgggaggctgaggcaggaaaatcgcttgaacccaggaggcggaggttgcagtgagccgagattgtgccatttcattccagcctgggcaacaagagcaaaactcggtctcaaaaaaaaaaaaaaaatgaagtactgatacatacatgctacaacatggatgaaccttgaaaacatgctcagtgaacaaaaccattcatgaaaggtcacatattgtatgattccacatatggaacatatccaaactagaaaaatccacagagacagaaggtagattagtggttaccagagcttgggagaaggggaagtggggaatgactgcttaatgggcagtttcattttagggtgatgaataagttctggaattagtgaatgtacttaatgccactgaattgtacacttaaaaggggtaaaaatgataaatgtttgtgtatcttaccattttaaaaatcaaaaagttaaataagatggtgagaaatctcctactccatatgccatacccagttcccacacctaccctaaataaatatcatttactactatctttgtttcttttttctttaccttttttttttttttttttttggcagagtcccactctgtcgaccaggctggaatgcagtggcgtgatgtacaacctctgcctcctgggttcaagtgagtcgtgtgcctcatcctcctgagtagctgggattacaggtgtgagccaccacacccagctaatttttgtgtttttagtagagacagagtttcactatgttggccaggctggtctcgaacccctgacttcaagtgatccacccacctcggcctcccaaagtgctggaattacaggcatgagccactgtgcctggccttaaattgtttctagttccctatgacaaataatgctgaaatgaaaagtaatgtatgtatttatttatttattcatttgagagatagggtcttgctctgtcacccggctgtagtgtactggtgcaatcatggctcactgctgccttgaccttgccggctcaattgatccttccacctcagcctcccgagtagctggtactacaggcgcatgctaccatgtctggctaattatttttgtattattttgcagagatggggcttccccatgttgcccaggctggtctagaactcctgagctcaagcgacccacctgcctcggcctcccaaattgccgtgattacaggcgtgagccatcacccccagccaaatgtcatgtatttatcatttcacacgtctgcaactgaatctgtaggataaatccctagcagaggacgtgcaggataactagataggtatcatttgtaatactggtgtgtatttcatctacattctcatgctaagaaatatatatatataggtgggtattgccaacataaactcttcaggacttgtactggtccacattcccatcagcaatgtatgagaaaggccaactaactccttgtcataaaccatttgcatcttcttcagcctgggcccagagtcaggtccagatactctgcacagagtgtgggaaaggggtggggtgttgagtccttgaatgtcctggtcctgctccccaccacctgtgacctcaggcgccatatataacggagcctccacccctcggggagaggccagtcccagctcagcctcagcgtaacctcagccctgcttgctctgcatgcctgtggtcagggaggctggagatgctgcaacccaaagccgggttttgactcatctctcacaagtggagccccggctgccgcataggtttttcagagaccttaggcccactcatctccccttaaagggggccctgggacttcctggacagccctttcctacctttctttccaattatcctctcttctcccctccttgagaatacatgttctgccacctatttctctgtctgcttctctgtctctctctggctcctttcatttcaaaacttctattgcatctctctgctgcttttctctgctccacttcttcatagggctattttacttccttttcccctctgttcctaactatagaatggctgaatctactactccatcccactctttttacaaatggaaacctaaattccatgaggccagggtcacccagtgaactaggggcagggcaggacagggcagggccaggcctctgctgtgctttctcctttcctccctccaacccaggcactatctccatcaaaagttgtgttctctccccactagccctggtgggctctgcctaatcccatttctctttccttaggggtattctgcagtcttcccttctctctctgggaccaagtggttatttccatttttctggactccattctgactccagtacacaccctgtgacccccctcagcagctgagaaacagagcctcttccaaacccatccctaccttccaaatcaagcagaaccctctgctgcccactgggagtcacaaggaggggacggaactgagctgctgggcctcagtgtcccaggacagtggagtctgtgaccaaggtgccgattaggaagaagtctgagctgaaggcagagcattagggatagcagctgggggtgatgttggaagaaccctccctcagtataatcggtatacctgccctacttcggtatagtccttggcacatggcaggcactcagatgacagcactcatatacatccctgcctccagacccactcatgggaaactgatgcaggagagattgggcttttggagaggtggaggtgggggtactgtgaaactggaggagggaaccaggtcaggggatcttaggaatgcagaaaggagttcagagcctttctcaagtctggacaggaccctcggtatccaggtcagagccctcttcccaagaggttgggaccaggtgggccagagcttgtaaggagaggaggcagaagggctggtgccctggtactcacaggtgcgtgcagagcagtccttcctctggcggcagcagcagcctttgtgtactgatctgggagacggcagaggaggaagtgacactccccagggtggggaagatttggggttggtgggggtgactgatctagaaggtggtgcagataggggtggggctgagccaagggagtggacaatacagagatctggaagaaagaagcccatttattgaacccctgtcatgtgttgaacgtaacatattacaattaaccctcacaacaatctcataagataggggttaatattcccccaagccccaattttacagatgcagagattgaggcttggaagcaggaaataaagaattttgcccaaggtcccacagctagtaagtagctagtctaggatttaaaaaaaaaaaagaaaaaagatttttattttaaatttttattattttattttttttattttaatttaatttaacttttgagacagggtcttgctctgtttcccaggcacaatctcagctcactgtcccatggcacaatctcagctcactgcaaactccgcctcccaggttcaagcgattctcctgcctcagcctcccgaatagctgggattacaggggtgcactaccatgcccagcaacgttttatattcttaatagagacggggtttcaccatgttggccaggctggtctcaaactcttgacctcaattgatctgcccacctcggcctcccaaagtgctgggattacaggtgtgggccaccatgcccagcctgttttttatttttgagacagggtcttgctgtgttgcccaggctggtctgtaactcctggactcaagcaatcctcccactttggcctcctgagtagctgggattacaggcacactcggctggtctgggatttaaatccaggtctgcctgcctccaaaattcatgatctctccatttacttatataggaaggaacatgataggagggaataggggcagtaagtactgtagagaggccagaaattacagacttgttcattttgaaaacccaggatacattatataagtgtgcttgactacataggctctggagccaagttgctagagttcaaatcctggctctactacttactagtagtaaggagcttagctgagttacttaaacctgcctgcagctgttttctcatctgtccagcaagactcacaggattgtcgtgagaattaaaagagataattcatatcaattgcctacaagactacctggcacatactaagtaagggcttgataagagaattagtagggatgagaagtagcagaggtgagaagtgaagaggctttgagaaattcaaggtccacacaactggaaacttggaagagagaggcatagggccaggctcagagcatgtgattggggaaccaggagccaacacagtagtggatcctgggaaaggggtggaggaggtgaactgggagaagcagagagtgcaggaacaacagctgaagccaaggcaaggatgaagcccgtagggagagcaggaaaatattaatgggatttgctcctggcccatacagatcactaagagctttgagagggaactagacatgaggtctgtgttcacaggtcgatctcccctaccagaaggagcactccttgtaggcagggactggctctacaaggcttccctgctggagccaccacacctagccaagtgcccatcttatagtaggtgctcaataaatgtcagatggattgcagaggtgtagctgctaggaggggacaattggagaggaggggctctttctctgggtgggcttggctggcctcaggctatgggatagccaggacctatacccttcccccacaaccaggggttaccacggcaatgaccctccttccccacaggccctgtggtttcctctagagcttctttcactttcttcttctgctttccgccctccactcttctctcccctactcccacatcctcaacttttttgtcataaccacaggtcaccaatgaagagagccaggaacaaggtaggcaaggcactgtcccagggaaggtaggacacggaggaggggcttgaggggagtcacagagggcgaagggaagagtacagggtgcagcagtagaggccaaaggcactgcaaaggcgtgttgcagagggaaggcgtgtgggagcaaggacagatattcggaaagaaggtaacagtgcaggtggcagtgagtggaggtcatggggtgaagagtgggaacagagagggtggggggagtaaggtataaggtgatagcagggtggttggggacagaaggccagagggctccctgggtgaggggctggtgtaaaacagtaacactgtagcttagatgcgggcttcttctcttctggggccaggagccctcatgagaactaaatgaaacttcagggcaggcatggtggctcacgcctgtaatctcaacactttgggaggctgaagtaggtggatcacttgaggtcaggagttcgagaccagcctagccaacatggtgaaaccccatctctactaaaaatacaaaaattagctgagcatggtggtgcgcccctgtaatcccagctacttgggaggctgaggcaggagaatcgcttgaacccgggaggcagaagttgcagtgagccaagatcacaccactgcactccagactgggcaacaggagtgaaattccgtctcaagaaaaaaaatgaaaaacaaaaagataaataaaacttcaatggactccttccccagagaaaagcagatatgcacatatgcataactggaggtggagacaggcttacagacctctgaagtccattcatgccctcccagagatccacaggatccaacataagaacccacaccaagctagacgcagtggctcacgcctgtaatcccagcactttgggagtccaaggcaggcggatcacctgaggtcaggagttcgagaccagcctggccaacatggcgaaacctgtctctactaaaaataaaaaaaattagctgggcgtggtggtgcacccctgtaattgcagctactcgggaggctgaggcaagagaattgcttgaacctgggaagtggaggttacagtaagccgagatcacaccactgcactccagcatgggcgacagagtgagattctgaacccacacctggtggttgtgggaaacccggtcactcagggtgagtccccatgggctccctttcccccatcctgtccccaccacaatccaggcacacttcatcctgttttcttctaccaagaaagctgcaaagtccaatcaattacaagctttccctcctcactcagctccctcaccaggtcagctggtcatttccctaccacctcctaaagggagccacatctcatgagtttccatcactttattttgcaaaaatagaaaactcagcaatatgcgatacagcggggtagaggggagatgtaaacagaggggaggggacagcaccctgaccccccaagagaacacagggagccaatgggaatcttatttggcagctaaatacaaactggggattggaggaagaaaggaggggtcacaggggccctgggctcccccacccaagacccctggaggaaggggtcaattccacggtgtaaacaaaagctaataaataaatagaggcttcctctgggtcagggcgggatcagctaagcagcatcccccctccctgggccaagctgctctggggagtaaagggtggaaggcactagggagagagggatcccctggcccctctgtagtgtaggagggtccctgccccaatggctgagatggagggcaggaggagcccaaggcacatgacagggctgggggagggacttataacggagggcacagggtgaactctgcacccgagccaagaggtgcagaatggacctgcatctatctgtccctttcaccctctgttcctgccccagaaatgcagggcccagcctgcccccaccttgacctggcacaaggacggggcacagaggctagcacacaccctgcaggtgcatcacacagcattaggcaccaagggtaggagcaagaaggtgggctcagcccttctcctttgtcccctttttggtctctagtgttcctgtttgctctcagagagccaagcacctggcagaggaaggggctgtggaatggcagggtcttcctcttgccctgggaagtctaggacccatggggcagtgctgagattttagagtccaaacccaggctcatccctttgccctctctcctggtgggagcagggcaggcccccgggactggcgagggagccggttagatcaggaaggggatgaacacagaggcacccctagaaactttggcaaaaacaaggagctcattggaaggggtggggagagggcagagcaggtcctcccccagtcactggcggtctgggagatggtcagtctgctgcctgaagccccaacccccacagcggggaggtcaggggccctggtcaggctggggacttcaggccccctttgccctggcccccaggaacctcatcctcgctagaggcattggggtggggaccaggctgcgaggagtcatcctcaaacatttcagggttctccagcatctctcggattaagggaggcatcgggcctggaatctccatcttcagagtaatggccctttcagctcctacaatggagagagaaagagagaggctcaggaggacagaggcacatggcccttaaggccatctccctaacctttctcaactgcccctgactcccctagggggcgcccagcacaggcccaccacctctccgtccccagctcatcctcttctcactaggcttcctgggtgccactcctctgcctggaacctctacctggccttctctaccaggcttgctgcccattcatcccattctttcaggctgtctcttcagcgagcgcaatgcacacaacttccaaccccactccccaagtaccccactctcgaatgtccagagcttgtcacttgttcctagtcctgttctcttaataacatttattaccacagctaatatttatcaaacactatgttccagacatccttctaagcctggactgtccaatagaactttgcaatgataggaatacagtagtcattggccacatgtggcaatctgaaatgtgactactgcaactgcagaatggaatttttaattcagcacaattctaagtacactgtatatgttacaggttttttttgttgtgttgttgttgttgttgttgttttagaggcagggtcttgctgggttacccaggctggactgcagtggctattcacaggtacaatcatagctcactgcagcttccaacttctggcctcaactgatctttctgcctcagcctcctgagtagctggaactacagatgtgcaccatggtgcctggctttacattgtatattaactaatttagtcctcaagacagcgttacaaggtacgtgaagaatagcccagtttacaaacaagattaaaaaagtaaagcaatttgcccaagactttgtctctaaatatatatatacacacacacacacacacacacacacacacacacacacacacatacttggaattgtgctgaattaaaaattcaattctgcagttgcagtagtcacatttcagatgcttaatagccacatgtggctaatgactattgtattcccatcattgcagaaagttctactggacagtactggtttagaagcaatttgcccaaagtctcccactactatgtggcagagctaggattccagtgtagattgcctggttctcaactactctgttcttgtctctgtgtgtcctcctgtccgacctgggagaccaacagccctgggaagacagagaggggacacccactcatgactcacccttagtgctgatgccccggaggtcggtgattttcattagcatccttgggaacatgtagggctggctgggccgccggcgccgggcgtacagcctcagggcttccagcagtggctcctgcagcttgtccactttttcgggctcctccaggtccatgcggtctatggggacaagtatactggagtgagaggggaaggaagagatggggaagacacagtgacagatggctgatcaccaaccggcgttttgggaagcctgtacagggtttcagaactctctggatggggccaggtgcaagaattaccagcagaagagaccactgggtcctccacgccccctcccagacagattccgcatggagtggtgggaaaggagactgagcactgagcagacgccagggggcgcccccgcacctccgcagatgaggcagatggcgctgagcagccctgtctcggtgtcatccatctccaggggcaggagctgcccagcaaaggcaaagacaaggtctgtgaggggcccgaagccggcattgtgcatctgggtccggttcagggtcagcccgtcggagaaggtcatggtgtcctgctctggggtgtaccttgtgcagatacgcagcatctggaggtggggggtggaggagggttagtgctgtttctgggggatggggaaaagagggaatgagtggaaagtgaggaggttaggtccccagtgagtgcaacctgaagcaggcatggagaaggcagaggtggaggatctgaggcttggcaggggtagtcccgggaagtcaggaggagacagggcatccaaaagtctaggatcaggtcataggggcagaggctaagacgaaaagagagctgaggagtcccacatgtgtggcagggggtgcagggtaaggaaatctttgcatggatcaaggaattgttgagggtcccatatgtgggtcgggctgtggcaggacccacagggcctaacttaccaggatatctaggcaggcagctttgagcagagtgatctggtcagcaatgctgagccctgtaaagccaggcaaccgcttggcaaactccacgatcttgatgatgcacttggtagccagctcactgaacttgtcccacagccccagatccagctgcacgcggtggtctgcactggagttctgcagaggggaggggtagaaggttggaaggcaagctaaggcccacctctgggggctgtcttctctctaccaatatcccaagctctctcctctgcattctgatgccctccttgtcctcagcaccagtcgatgatagcctccaacacaacccagccccattccccaaagtgaagagtgccctgccctcactgggctctgcccattcctcaccgtggtatacttgcccagctggcagagcgaggggaaagtctcctgatgggctttgctgaccttggtgatgagctcttctaactgagggctcagctcatagctgtcaggtgacccttcttccttcacctctttcttcttcttgttccggtcatttcgcacagcttgtgggtggaggcgcaaggagagggtcaggaccctcagagcctccctttgggtgtcctctctcaccctaatttaatatgctcagtccttatcatgaatatctattctctggcactgtaattactgcctcagtttccctatcacctataatagctcctattcccaggctggttctccccagccccacccagggcctgcagcccctgctccttccccaggccattcggctccatcctgtccttcctgtcaccctgcaggagctgggggagggggggcaggatatgcaggcggcaggatatccacttatagccttggcagcacaatgggggcgaggggggggtggagaggaggagccaccccatatccatctctggctcagtccaggggagggaaagggactggcaagcccactggcttcatttcccccatgaaacagggggaatgtgagaccctacttattcacccattcagaggaagagtcaagctccctgagagggagaatgggaaatggtggggcctcctggttgaatggagctaatcaaataagactggcctgggagaaggcagcaccccagggcaggccaagtctcagaggtcagggaagtgggagtggccagaggaaagagggccacagccatagggtaggaccgaagtgctcctgcccaagccaaggatggcagcctaccttccttggacatgcccacttcgaagcacttctgtagccggcagtactggcagcgattcctggtcaccttgttgatgatacagtttttgtcgcggtgacacgtgtacaccatgttcttctggatgcttcggcgaaagaagccctggagttgagggaaagagagagggcctctgaagcacaatgctgggagtaccagcctctcactggccttgcaggttgccccaagcctgacctaatctattaaccacctatgtgcaaagcagtgctgctcagacacagcatctgtgtgcctggtctctcatcttactagggtaactggatcccccgtctgcccactcccaccacgtacacaccttgcagccttcacaagagctgaccccatagtggtagccagaggacttgtcattgcacacgaagcatggcttgtagacccgaggaggcggagggggcgagggcgagctgggcaccatctcctctgagctggtgctctgtgtctccaccgctgggagggaagcagtgatgtgagggtcaggggagaaggaccccacagacctccaggcttcctcatcacacacaccccatgtgcatttgttccttggcccactggtgacagccatcactaccacagtgcactagttccagcagtaagcactgtcagaatcctcttaatgaccactattaccacagcttgttgtgaccctagttcaccctctaccctccacagtctaaccaacttgttcacaagaatgccagccctcatcctatatgacatgtttaatcctccaaattccagaccaaggccattccggaaattgacttctctgggcctgtttccctaactatccaggaggtgggtagaagagttaaagccctgcagctctgagctctctagtcactctctgtctctttggtatatctttgtcaggtagtctacttcccactgtcctccctgtggggcaataactctgggggcaggtaggcaatgacaggcttcctgtagctgctactggccaaatgacctgctgggatgcttagcaggtaaaccaggacctcatttcctttccagtagtacaggggggataactcctcaggcttatctctctcacactacccctgaataaccatcagagacagtggagcaaatggggcaaaggtctcaggggagtgagtgagaggatgcaccacagccttggttcacgcctgaagaaactgaggccacgagaggggaagtgaccagctcagtgccacaccaccagcagatccaagtggctgtgagtcagagaagctggggaagcagaggctgaggtgtttgctcagtttctcaggtctggaagccgttggaggtgtagcaaactggagaagtcaggtgacagtaggtaaacaggactgatgggggagggaacctgtttctggaccctctctgagcttatgtcttcactctgaaaatacccaattgcagctcaaaaggggtctcagccccacagtatggggaggacatgctctgctctgttcaaaaggctgctgggtaagtgtgtgtgtgtgtgtgtgtgcgcgcgcgcgcgcgcgcgcgtgtggttggtcttcagaggctcggaaaatttgtaaattattcaacctgtaggacctgttgcccaaacctggagggcccaagttaatgcaaaaaaattcctaagaccctccctaaggtgtgtcccacgcacccacctcatgaacaccttctcccttctaaccctctgcagcccacctggtcagaagcccgccccaacgcagccagaagggcggaaggaatgcccaggatgccagggttccacgctagctccacccaccccacaggagggaagccctacccacccccaacacacatacaatcaattagcataagaatcctgccagagtgagattacccaaagaaaaaggagagaggagaggggggaaagaagggtgcctggagtctattcaagactagggatgggggctccaggaggggctggtgctgagagatgtgaggagggctggaacgcctttcccaacctctcctcactcctcagacccaccactgtgtcctccaagggcacgtgttctgcccaaggcctgtgcgtggggtggtgctcactctggcactgacgccctccctgcccgcagagcgctgcctcatttcctctcttgcgcaagggcctgggtgcggtcagactggcatggggcagtgccagccaattataagactgggggccttagggagacaggcccgggggcaacttttcctgtctaagtgatactgtcacatccccaccccctgaaccctaaagtgcagcctagtggctccgaggtcaatctgtgaggtcaaggccccagaaagctaactgggtctactccaatcagatcccctccccagactcgggcttagaccccaccattgggatgcagctcctgggttaggcaggggcccctgctggggaggatgggggtgggctctggggttttctccttttaaagcccaaattgctgaaattgaggaaattcctgaccaggctgcgcggagcttcaaacaaactctttataaccggctgtaaacgctcccagctgcgaggctcagagctgagcagcctggactcacaatctagcacacacctccttggagacacacacactcacaggttaacaacacataaggcaccaaagcaggcatattacaatgggatcctagaaccctcactggattctggcacagacacacagccagaatagagacacactcactccagctacaccgtggaggtagatgtaccagtcacaaggctgacacacaacagccagcacttggccacacaagggaacagccctaccaccagacaaacaccccagcctgccaacgcagcaccaggacaccaaagcctccaaacaggcacacacacacacacatccagcccacctccaccccccaagcacccttccctctgaaagtgtgtgcgggcaggcctgaagctggctttgtgtgtccaccaggatcccagaggccaaaattattggtcccaattaaaactcaaaaacctagggccagtcaagcccaaagggcttcttccataggcctgaaaaaagacagggtctctgcccagcccccagaagcccttcctgaaagattctttccatctcagcacccccacaacatataacataccccaactccccatcctattgggcaatgagaggaaagttaagaattcacagggatttggtgcaaagcaatagttccatgctttctcggttctttaaatgacacacttttaaattcttcccccaccccacccaaaagtaaagtcaagtccggtctcctggtttgccatctccctcttccagcttcccagttgttaaatttgagcagctctgctctggaaccaaaaaaaaaaatccgaacttgtaaacagcactgcttggtgccaaggagcgaggcgcgttggcgggggcttggtgacctggcgtgcgcactcccccagcgcccgccgccccgcccgctgcccgccccttcccacccttcccagcgtgcccccaagcccctcatccccgggccgtccgcacccaggcagcgagcacatcccagcccagggtaaatttggggggtgttccaggctgcgctcctggcccctccccacaccccacccccgccaggcactgcggcccaagcttcaaagccgcctctcatctggacttcatttttactgcctctcagtccccagctttttattactgctctggaaaggggttccagggccccaggcctggcatctcccatttcacggagggggaagatagatatttggggacccagtaatggtgctcgccctgccgctgtcaacttcaggccaccccccaccacacacacagactttgctttaaacttttcgcttcctgctgaagttgttgtgtgttggagccataggaaaaagtaatctctgcatataaccgcatacacgtttccaaacatttctttttttatatgggggtggcgtacaaaactcagccttctccctcttgtgtgcacaaccttttccacccggcatgagaacacacaggatgcactctcgaacacagcactttccaaaaccgcccccgcagccacgcaggggcacacgccctcccggcctcacgccacaaacatcccctcacaggccatgtggacctggcagctgtcgcaggcgacactggtggagagacccttgctcccacacccacaccacctaggcaaggcgctgcacactccagggattcacacgctctgcaaacgatatttttaacactgccagcttcccacatgggctttacaaacgccacccacggtcctgagtgtcatatccttccagggccacggacgtgaaggcgcaaactacccacacacctcggtctctccctatccccaggaactctggagtggcatcaaccacaggttcgagctaaacacccaccataaaaaccacacacactccaaacactactgcacacacgcaaaggagacgctgaggcccccacgtttaaagggccagtaccttacatagaaagggccagaagctcctccttgcacctcagttccactctttacacacggaaagagtaaatcccaccctctcctgcaccctacaccccagccccggactccggtacctacattgcaggctggcgggttgcggccaggcaaaagattcaagtccggcgaaacaggagccgccggtggctctgcgcagcaagccggccccgggcccggccgccccgtacagccgtcgcggacccggggcaaacgtttccatacagtcgtacatcgcgacccggcttgaagggaaactgggtgctggaaacaccaaggacccgcagccgattccccctcctcccccggcggcgccccgctccagcagggggggagggggagggctagcatagggcgctgggctgcatgcgggtaaggggtgggcggggaagaggggggatccccagcaggggaaagggactgggcggggcgcgaagctggggctgccgctttagcctccgtccagctcttatctgggtgcttcggcagctagcactggggagaccttttttaaaagcgaagcctggaggggtggggggtggggcttggagagcgaagggggccgggcaccgagatgagcaaagctgagagtggagcgcacacatacacatacgtacactcgctccgcggcgcgcgcgcttgcttagacacacatccgtgcatgcatttatcttatcaggcaccaagaatttgcaaatatgcaagagtgaacatacatgtgagcacgcatataaaatcataggtgcacacacgtttgtgcaaacacaccttgctcgggagaatgcttgcaggcatactctccacagctcataggctttgcatgcatttgcactgaggcgcgtgcccaggtcggggttggaagaaggagaggaggaaccaagcataagcatttcctttcagagttttccctctccccaaactctccctttttcacactagtcaatacaggggtgttaaggatgactggggagaggggaacgtggaggtccccgcgcgcagctgctctcctgaggctcgggacctgcactacctccacccctctcattcccaggcctggctccgccctcgccctccgcgcgcccgcttcagggccgaaaagtgcattcctgcggctcggcgcgcgctgcctcctccttccttcccgtctccccacccgcggtcctagggccggagcgcgctcccgccgtgaactctctgggaacccccctcggggcgggtggccgagcgcgctcacctcctcctgacccggccccgccccaccccgcccaggccgtcttcagcgctgccgcggagtccccccgccccctccagcgcagccagagtctacccctcctagcccgagcagtccgccctccgccgcggcccgggccgcctccctccgagtccccgaagccttatcccgcaactgacgccccctaagcgcctcgaccgtctctctcgatgctccttcttcgaacataacttcacttttagagcacaaaactaccccataagctgtgcctgccgtgccaactgcgcctcgatgaatctgcccctgatggccaactcccctcctccagtttctcactgccaagggctccctcggcaataggggcgcttctggtcactgactgttctcagggtctttaaataccctctagcctaggcataactgccctcccttcggttagtgcccctcagctctccaaggccgcaacactgttccctgggttgccccttccggcactgagcgccctcgcccggcggagaagggggtgaggtgggcggggggctggccacgtcagaagtttgccctggcccggcagggccgaatggggggaccctggccccggacagcgccagcagcggcgactcccggaaatccccccctcccccgcgccccgccctcagccgccgggccgcccggcctgcctgcccagccggctctgtcagcgccgctcacacgggcagcgccgcggagcgggagcggcgcccggcccggcccttcccccgccaggcggctgtggctgggccagggcggggcgcgcttttctaagaatctgttgtaccgggtggggggcgcactggggtgctgcaggagtggggcgcctgttggaagaataaagggcaggaaggggtgccagagtaggcgagggatggcgggcgcgggggaggggcggggggctgccggggctgggaaaaggcctgacttgtggatggcgaggaaacctcggggtggcaaggctgactagggggcttgaagcagggatggagagggaatgcactgctctttccaacccagtgtaaactcccttctcctcccccaaccccaaatacccatttctgaatccagtcacccgaaccccacaaaaaaaagaaagaaagagagagaaagaaaagaaagagaaagaaagaagaaagaaaaaggaagaaagagaaaggaggagaaagaaagagagagagagagagagaaagaaagaactttctgaatcagaatctgaccagcagcaaacaacaacaaaaacagttaagtgcaaaatagggagtaccccgaaaacaagagggaaagagccttgattagtcaacttcaagctgtcagtaccccccttccccctcagaaatctgaaaggtcccaattaagtcaggcctgcctggttggtaattagaaccagaagtggccaggccacagggaggggggttgggaggagggcacaggaggagttgggggagggctccaggaagccatgagtcctcaatagcccccgtttctcttcaccagatgcaccccactcatcaccccatctgtgtgtgcatcccaggcattgcatggagggggtccttaggaccaggcattacggtgtcaggcccgccctccccatcaaccctgacccccccattctagacagacttagtacagccttggggagaaggtaagagggtgggggatctagtgccccctcttttccccaaagtttccccagcccttattgcagcaattagacccattagccttctagcatttcatgggaaccagatgttctccaccatcctggtgggagtatgaaggggggctgctgcctgactcacccccttccctatgatccccaccaccagggcatacccccctcccagctagagccccacaaaggcatagccctagaggcaaagaggagagtaccccttcccaactaacaaagccattagcactcagattctttcggggtcaccccttagagtccctgccaccctggcaaggatgagtttggccaggacgaggcagggcagggacagctaactcctcatgcaccctgcctttccctccttgccaccttctggatggggcttgaggataactggctctgaattcctcacgctaaattctcccttttttctaaaaccttccctcgaaaagctgaaaagggggcatttcaaagtaaagcaggccctgccagaagggtaagtcctgaggtaggagtcccacctgaagggcaatgggaggggggtctctggaggagggggcagcagaagagcagaagaatagcgaggtgtgaatgagagtggggcccaaagcagggatgtgaggcgcgttgggcaggatgggggctgggaccgggtagggggccaggagaggggggtgcagcctgggccctggcggcggcggcttgcccggctccccccgccccccccccgcccaagaggtttcctgttgcaatcaaagccccgtttgtgtcggcctggagctggagcctgtgccggaggaggagagaccggggaggggaggggaaaagaggcagtcgactggggttttttcctggaggaggcctcactgcccttacccgcctgcttgttctccttgcttctcccagtgcctggcttctctgtgtctgcacctttgggcctgggtagctgtcccttgtcttgtctgtgagtctctctttttcagtttcttttaagcaagactttctctgtgccaacctgtcctcagtttctccatgtgtggtgacttagtgtggtgaaatctgggctccttgccccagggacagtggccccatggccagggcagcatcaccaggttcagaggacaaattgggctaggtcatcaggaccacagctatctgctcaggggtgggaggacggcaaggcttcccttctctttcatcacactctgttccctatagaaagcaaatctagaacacactaagattcacaaacatagagatacatagggacacagacacctgaggtttcatgcacatgcatgaacacacacgcacgcacacacacgtacacacacccctctgctttccatgagcacaggcctgtgcttgcctcagcagcacgtgctccctgagcctcccctccaccaccagacagttctgagatgcctgtctcaccccccttcagaccccgagacagccccaggaagtagagcaagacttcacttctcaacaaggatgtccccaaggtgccagggacccagcaataagatccaagagccagccccagggagaagtgccagacctcttcaagggccacctctcttagtctatgtgtgagagagaatgtgtgtgtgtcatccatagaataagggagagggtgatgagatgcacaaactcaatgtgagtatgcctttggcatcagatttaagcctctaaaccctctccactagatgctcccagccaaaaagggacagcaggtcggagaaatgagagaggacactctctcatccttctgctactctcccactctggaaggtttcccagactcctggatctcttcgtctcccctatgtcttcctctctgctaccactaggtgctgcatgccccacccccattaaagccgcatagcaacccacccccaagccttcccctcctccctcctcctgccacttccctgcccaggcctgtccttccaggctagccgcaccctccccagctacctgccctggctctggctcctcccttggatttctcctttcagccccctccttcagcatggccttcgaagatggagcccggcctgaccacttccctaccttaatctcactttgaaccctgaccttgatctcagtgtgtccatggcacaggggcgcaagggggacgtcactggggactgggtactagctctagcattatccccactaccattctctctcctctccctctccactccatctcctttacttgcctctcccagaacctgagaaaatcaagtcccaagaggctgagttgtagggttctctgccagaagtacattcatgtggggagggtggttccttcccacttccccaggtccctaggacagattcatggggtgaaaatgaagtctggggaagcccagctgtagtttccaaaaagggtactttgtgctgtcttgttcacctacatgccactcaaataacccctgttggactacagacatgccaccagcaggcttcaccaaacgccagccacagcgtcagcagcactacaaaatccctcctcactcctcacactgactctttgttgcacacactggaattctgtacatgagcagaggcccagggagatgctgggcacacacaactgcatcaagtctggaggcaccacacactcaccccttctccgatgaacacactctttccagtggagctgccagcccagcctagtcacccctttcacatacagacacacaaccctctgcgtgccccctcctggaagcagggcgccttctcttctacctctgtctctgcgctcgtggagccatgaaggatgtgcgtttatctttttgtctttttctctccaactctgtctctgaaattgctctttcccccgcccttcaatcaccttctcttggccccagttgaagccttctcttaaccagcttggaacccccacctgtaatggcctggccaggaggaatgactaccaactgggaggagaggggtcccagagggaggaggagaggagaggcccaagccttggctgctgtcagcactcaaaggcttaacccaaagagggcaggcctggggaacaagtagggatctgcacagcatgcaggctctatgccagacctgcagggagaggaggagcccagatccacatcgctggaggagaggatgcttctggaacaccccctctgcctctctggattacttatggtacaaaagctacctcctttgcagtcatttccatcctccccagaaccaagaagcacagtctcctgaccccacacatctttggggacctggcacaggatttctttcccctttttgcagcctccatgtaattcaaagcaatttcacctttttttctctctctctcagacagaatcttgctctgtcgcccaggctagagtgcagtggcgcgatcttggctcactgcaaccttcgcttctgggttcaagtgcttctcctccctcagcctcctgagtagctgggattacatgcatgcgccaccacgcccactaatttttgtatttttagtaatgatggggtttctttttttattttttatctttttgagatggagtcttgctctgtcacccaggctggagtgcagtggcacgatctcagctcaccgcaacctctgcctcccaggttcaagcgattctcctgcctcagcctcccaagtagctgggattacaggcacacgccaccatacccggctaatttttgtaattttaaagacggggtttcactatgttggtcaggctggtctcgaactcctgacctcaggtgatctgccctccttggcctcccaaagtgctgggattacaggcgtgagcctttttctttttttttttttagacagattctcactctatcgcccagactggggtgcagtggcaagatcttggctcactgcaacctctgcttcctgtgttcaagcaattctcgtgcctcagcctcccaagtagctgggactacaagtgtgcgccactacgcccagctaatttttgcatttttaacagagggggagtttcaccatgttggccaggctggtctcgaactcctggcctcaagtgacccacccacctcggcctcccaaagtgctgggattacaggcgttagccactgcacccaacccaatttcacctcttgatcacagagccaggtgactggcctcccagactcctctgcttcccagtttggctccctccaactccccactgcaagcaagcagcagattcacgctgcaccagacccacccccagctgcccacacaaaggtattcccctctactagttgactgacccaggaggcagttttagatacccaccccccaagttttaggcctgctacctccctatcctatttgacaggagaactctcatttgcaaacacttccattgagtccacatccaaactccttcctcaccaccactaccaccctccattattcactactactccattaggccaaacccctgtcccctgcctgccttcctaactggggtgccaactcttttaccatccaccctcctgatgccttcttgttaacatttgccttcattccccaagatccctgagactcacacagagaggccatctccttggggaggtcaggctggcccaggccccggaagctagggctcagcatctcgaaaggcggagaccccctgagtgcccctgggaaggcgaaggggaaacctgcccctgggtagccagatccaggccccagggcaccagccgcaaagagtcgctccttattggtggccatggcagctgcggtgtgagagtcccctggggtctgcagtgggcgggcgaggtcttcagccacagcccctgcccatgcccactgccccagcctgggaggctccgtacccgccctgcctggcctgcccactgggcctccaaaagtcctagggagaaagagagagaaaggagagatgagagaatgaccactctgaggttccaagccctgtgaccctctctcagttgcagtcttctccctctgtgctgctacagtttatcctgccctggctcagggcccttgcagtgtggtagagagggcacggcagggggttatgcaggctctgagaaactctccagaggagctccaggaaaggttaaactgaggtcccaaggtgaatgatggtctaaggacttctggtggagagaactcctagattgggaagtgatcatgaatcaccacaactgggctaagcatttgacctaaacctcacatcagtcctgtgaactgggagttatgattctcatttcacatatgaggaaactgaggtgaagtgactggcttaaggtcacatggctgcaagtgggggagcccagattcaaactctttaccatcctggagaaggcaaacataactctgttataacctgggagccctacagctctctggagaggagtacaaggcaaaggttagggggacagactctagagccagactacctggactgtaccccaccacttgctagctgtgggacttcaggcatgtcacttaatctctctgtgcctcagtttcttcatgcgtcacttgggactaataatagggcctacctcatatggttattgtgaggactaaataaattaaccaatgtcaagtgtctggcataatgtagggcacataggaaatgtgatgtaaatgtctcatattagttctctttgtaccttattttcctccatactctgcttcagtaagcacttccctctctgttttcctcaacactccctcttccagtttcctctcccaattcttcctgtctccaatttttcctcaccctgtaagccctcttgtacccactgcttcaaatctaaggatgttgatggagcccccacttgtgccaagtgtatgatgccaaggagctgcttcttggtcagctgactttacttctctgcctccttttttctctctctctctctctttttttgttttgttttgttgagacagctaatgtttatatttttagtagagatggggtttctccaggttggtcaggctggtctcgaactcccaacctcagatgatccgcccaccttggcctctcaaagtgctgggattacaggcgtgagcgacacgcccgggcattctgcctccttttctttcttatccctgggctccctgtttctaggaagttctccctgcaacctctcctcccccaaaagtaggcttccctctaagagtttaaacctgagcccaggggaaggggaggagaaggaggtagagagaggagatgggaatcctagtgctaagtaggtggttcctatcttcatcccctgacaaaggaaaagtttggctttcctaggagccccagaacttctcacctctctaggcagttagtgggctagggaggaaaagtcaccccagcctgggtatctccaccagtcagagccataacagactgctatgaagggcagagaagggccaagagactaaaatgcagagagaccatggggtgggcaggcccagaggtaggggatgggtatatctgcctttctttccatcagtatttgcttctaggatgtatagctctcagtctttatacctctggtttttatttttgtttttgcttgtttttctttctctcctctaccttggccttcaagcccttgagggtaaactgtcatggaggttacaagaacccagaccccaacgccatcacatttcactcagcccttatgaatgaagcatcccctgcccctcaccatggcaccacccatacacccagcaccctcaaactctttagcccagtgtcttcgcaggccctaaaagtctgagctccaagcctccagggtccctctccttttccttctcctattcccctccgaagttctcatccctagttaagccctgatggagccaggagtttgggggcccctgaggcccctgggccacagctcaactggccaggccacattccaggtggattaacccctccaatgacaagggtgagaagctactagaggactcccccatccccatgttccccagacttggcttagactgggaacagggctctctgccttagccctccttgtctttgcttctcacctaccaatgggaaacacaggcaggtagggcagtgggggtccccacagagggatgctcagctcctgatcctcaccaaggaatgatgctgcatgtgagccaatgagagttgtccttggccttcctcttattttgcctcagagaagggacttgggagttgagtgaagagaggaagggggtagagattcctcccatttctgagccttggttctgtcgtggctgggaagagaaggggagggtcttaaacccagggtaggagaatggactaaggaattgaaggcagtgcagagtaaaaggaagtcctaaactgaggccccaggtgccttggttctttgggggactcatggaaagtagagaacattcttcctctactaagatgccatctcaaatggtggggcagcggggatgacagactaggggagaggggctcttacaaagctgcttctcttagagctgaggtggagttgaggggagggcatggatgaagggggctgccggatggaggggggtgtgtttccctgtcgccctgcccgctccagagcctggaacaaagctgctcttgtcggccactctccacccgctgcccccctcccctctgtataaacacgaccacctttttccatgaccccatctccagcctgggcagagaacccaggcatcctctgctctagcctgggcccccagcctgctccccaggaggcagcagtgggccaggcttccttggcattgtgccatccctgggggagtccagacccttgagtctccacctctcatccccaggtgccctccctccaccctactagccccagggaggggcagtgcccaggaggcaggcaggcaatgccagtggaatgtgtgtgggcatcagagggcatggacagggtggggcagaggggggaactggaggtgccagttaggtggctttctgagccaggggtgggggtgtgccggggtgtgggggggcgtgccccatgctgcctactaggctgtaggccacagtgcgtgtgtgtgtgtgtgtgtgtgtgtgtgtgtgtgtgtgtgtgtgtgtatgtctgtctatatgggatacccaagctccaggctccctgcacacactacccccactcccctgtcttctctctacttgcctcaaggatatgagatgctggctatggtccttgaccccaactcagcatctgaccctaagggcagaagcctcagacttgaggattgggattccagctgcccaggaccagagccctaaagcgggacagtcatctcagtttcttgccctgaagacctcctactcaggctcccctgcccccaccaccactaacaaccaagcatcttcttacccgctggccgcctgcagagactggcttctacatactgggtcaggttgagggaactgggccgtagctgctaaagacagagaggcagcgtcagtggaactctgggaccagcactcctgggtccctgtcccggtcttcctgctctttctttgttccatttgggcttccctcaagaatactccagaggtgccccccaccttggctggagggagccaaggctcgcacctgggctgggaacgtgtgggagggaatccagcgcttcaaggaaagttcacagatccctatcctatgcaccagtccttcggaactcctggacgcggagggccaggctcacttgcctctggacgttttccttgccttctgatgtccaagctgtcccattccactggggagggaggaacttggaccagcatggaacatcaaatctacccctcagagcccgggggtaagggggtggtagtctttccccgcgagaggaaaccctgtcttctctcacattcccagcacaaaaatataaggaggaatgccccctggctgaagacttccccaaatgctgtcctctgctatgcaccaaaatgaagggcagatgacccagcccatcctcagcctgttaaaatcttccccattcccttcccacagcaggactggcctgggtcggggcaagaagcccccctcaagcccggcggccagcctggccagcctcgggagggcattcgcccgtgcagctcctccgcgccccctcccccagccgcctcgccggaggacccaggcgacggggcgggcgagcctgcttccccgcctgactcacctggagtgggagggggaagggaggcggcggagccccgaggtcccggcgtcgggcagtctcttggatggagcgtcgcaatgtccggggctcgccgtactggggggctcctgggggggcacggctctaggctgggactgtcccggggcctctcggagcccgcccgcccacgtgaccgccccaaaatatccgacacattttctcccaaaccgcacactgactctgcaggcggggacacggaaaatattttctttctttttctccctccccaccccccccccaacctccctccctgcccaactccctcctccccctcccgccctcgctcctccctcccctgcctgcccctgcccggctccctcctctgtgccctggggctggggggcggagggatgggtgggcgggagggggactgggcggggcggcccgggacgcctgggtctctgcccttcccatttgctaggcttccgtgactccatcctctgggaggccgggcacggctggcagaggaggtcagtgtcctggccccgtgatgccaaccttttctctctggcacttttctcctttctgccttttggggggactagttgagttgtctgtggccaggctgtgactcttgcgaggccagtctctggcgcctccccagggtaggcaatggggcggtacccactccctcccagtgctggattggccgggcaggagtatgccagatctagaatagatgctcctgcccttactctttgctcagccttcacctgcagatccaagtagcctctcccttcccctagcccacctcagtcctttggtcccaggagcaaactggttgactagtggctgttgctgggggtgctgaggccagggctcacagacatcttccctgtcatcttgcctggagtaagctccaggagttagggcgcctgggtccctggctgccagttgtcccccacctttaggcctggatttggaaggggagaggctggagaggagggcaggaggaactgtggctgggagtgggaggagccttgggctgggtgtgagagagaaagcccaggcagagggtgtgtgtctgccctagccagcaccggcctgcctgcctgcctgcctggtagatgtgccatgaatgctgttgactccgggtgtgtgtgtgtgtgcgtgtgtgtgtgtgtgtgtctgtgcaagcgcgtgcgcatgccagtgccgagagtgagtgtctgtgtctgatgggggcattatctgcttcaacatagacagactctcaaccctagagtgagagaacccagtggtttcactctgcattctactgaggacagagggagagaaaagaatgggtctgcagtccaagctctgtgcacggatcccaaacactcccatggggactggagttgggagggagaaagaggagaaggggagagtctgagctaggctgataggctggacagacatacccaaagtaccttccccagcaatgctcgcagggtgaccaggacctgggacacagactcctgggtcacgtcacattttccatactggaattacttggctttgtccttgctcccccctgggggccaggtgtcctccctcctgggaaaggctgcttttggtagccaaagtcaggtgaaggagatgggggaaagaagaggcatgctgtggttacctcagggaatgggagatggcaatgggggtgcagacaagccctctctttcactccagggataggaagagctaggaatagatactccagggtcccgtccccaggtggcctagctgctgttgactttgcttggttaccctgggagcagctctcagcagtgtgggaggggcgggtgtcagggagttggacccaggcgtccaggctggggtgggatggcgccccgcctgtgtggcagggctcctgccaagaggctgcaaagttaacccctcctgccctgccctagtggtggctggtgggaggagggcgggcccagttgtggtttgggaatgtggccctaatttccccctcccccttccagcacatctgtacttggtttacagtgaatgagcctcctgtcctcatgaaccaggcaagggcaccactccctccttggccaggcattctgacacagaaccaggcaccacccgtgacactctcctctccctgctgagtatcatctctctgaactcttcccttctccttctgtagaggggcttagggttggtcccaaagatctacagctggagctctgagacagtgcatctaggtagcaaatggggccagggaagcctaaatcgggggacaaaacacttggggtagcctctgaaaacagagggagtcagaattccaactgtctctgccctccctttgtcttggtttgtctgtctgtctgcccgggtctttgtctctggtgggcgtttgtctatccatccgtcttggtaactgtagctcctcccttctggcggcctcctcgtccccagccgacgacagcagccaagcagcgatgcccaggaagacccgccctatgccggcccctccccttgggattgccactgcttccacccccgccccctctaccgcccctccccaggacccagtgactggggtctgttcactgcagcagtttggaagtcaaaccaaacagcagcagcagattgggggacagggaagaggggcattgtgagggcttcagattcttctccccaccctccactccccagcttgcaacagagccagctttctgtccagagattccaggaggaggcttgggaagagggcttcccactctggaaactggtggagggggctcccctcattcctctttcccttgggtcatccctatttctaggctttgctctgtttgtggctgctctactttgtcaccctggcaacttggagaaatgatatcttgggggccctagtaccaggctttgtttgctcccctcatcccagagcaaagaccaaaaggagagattatgaggagaggaaaaggatgcagatatctgtcccacctgtcctgaaagtcatggggaaatgacttattcagtgccctgatgctgggggggcggacagtggtgaggatgaaaattgccccaccctaattttcaccctcaccccctcccaaccctccggcatcaggacactgaataggtcatttccccatgcccaaatctggtggtgtgggggatgtcctatgccatgctcagaggtgtctggcagatgactatagggggtggtgggggagctgtgttgcagcccccaaagacatcattaaggcatggaagtgctgtcagggcttggggaccagggcacccagggagagcgtgatgaaaacatgttttgtacaacacgtgtcctctcttttcccttcctcctctcctctcccacctcctccccctaggcaagctctgtgccagtgctggtgccagccctgcctctggtgcttgctccactccatcccttgtactaggcctattctgctgcttgccagctcgttgactctcctggtgagggagtttgtgtgtagaaggtccttaccagccccagtgctgcccagatccccacatagaataaggacttaattttgaagctcaggattttaggattagcctaaacacctctgggaatttcttccctgaacaggcaccatgcattaattcaacaaatctttattaggcatccactatgtgataagcactgtgctaggttctgggaatacccaggtatggtccctggcaagttcacagtcggatggagtcagttgttaaccaaataatccacaaaactgcaactagaataatcagtgtggagaggcatgagggaccatgagaatggagcagaggagtattctccgccaaggagatcaggaaagtcttcggagaaaaaatgagggagattagagagaaggaagggcagtgaaatatatgtgctgctcaagagtatgtgcaaaggccctggaattgatgtcctggccctcagccagtctgctccccctgcccccaaaaaagaggggccttccattcctgtgacgtgcttggatttcaatatgccaaaagggagggatggtaagtacctccttgtggtcatagcaggacgctgagatacctgaatgcattcatttcctccagaaagggaaacagagacagagagggaagacgactcacaggctgagacttgagattatactatggaaaacaaggccccatgctggcaaatcctccagggtgagggattcctgcatttgcccagctggagcctcaccagacagaaggccttctcctctgagcctgctctaccatgcccccactcccccgatccagccctgacctgtcccactccctggagctagcacgtctgcctccacagttgcctggagtgtgtgtgaggcgagtgctacaggtgtctgccagccagtgtgtgggtggatgtagctgtctgttttgcacagaatctccatccaggggatacggggttctctttcccctgtccactggagagcttccaattcctcctacccagacacaaaagttccaagtctcttccttttgaaaaggaattgggggccccttgaaagagggagcagacctctttgtgactgtgcctcctctagagccagcaaagaggtcatggaaccaatggggttaagtcccagccctgctgtgacccactttcctccctgtgcccacatcccctggggccagagtgttgggtggggccagcctggcacccccacacccacacctgggacttcccctggatggaaactcccagaacccaggcatcctgcttcccctgccaactcccaccaactgcctgggttctattcagcttcagttagatctccctgtctgccagcctttgaccaaactacatctgtgctccagcccaccctttggtgtctggctgccccttctggtggactcctttgaagaaaagatgtggagctgggggagggggctgtggagaagccatcttttattgagcacctactatgtgccatgtattgtgctagacatgtacattatctcatccccacttaacagagcagggagtaagaactggagaggttaagtgacttgctcaatattgcacagctaggaagtggcacagctaagaggagaacccagatcttggtggtcctgagctctcttcactatagcagcgttcttccacttctcttgcagctgcccacctctctatgggatgagagacttgagaaattcaatttaatccaattcagcaaacactgagtatctgctatgtgccaggtactgacaggtaccagaaataaagagatcactgtcctcgaggtctggtgagaaagacgagcatttggaagtgctctaacatcagcataatgacctgaacaaggtggcacggagctgagaaagaagcggtacttttatttcctccttctgtacagagtatataaatatattatgaacagtatacagaataaatggaataaagtcaatacctacttcattgccatccaggtcaaaaactggagtatttcctatacttcagaagttccccatgcatccctttcacaattccctcagtctcctaaaaacgaactacaatcctgacgtttgtaataatcgtaaacacagaaattacttgtttttctttatagttttagcacctgtgtatgccttcataaacaatactgctcaactttgcctgtttttgaagtttctataaatggaatgatactctattactttttgcttcctacttattttgttcaacttgtgaactatatccaagttgttacacatagctgtcttcctattattgcatagtattcattgcatggatataccacaagttatttttttcattctactgttggtgaatgtttgagttgtttttagtttggactgttataaacaatgtagccatgaacattcttgtacatgtttcccagtacacagatgcaggagtttttctaggatatagaactaagagttaaactgtatatacaggttcaattttatcagatagcaccaaatagatttccaaagtggctgtatcaattatataagaagcagaacattttttttcttttttctttttctttttctttttttttccttttagagagagtcttactctgttgccagggctggagtgcagtggtgtgatctcggctcactgcaaactccgcctcccgggttcaagcgattctcctgcctcagcctcccaagcagctgggattacaggtgcctgccactacacccagctaattttttgtatttttagtagagacggggtttcaccatgttggccaggctggtctcgaactcctgacctcgtgattcacccaccttggcctcccaaagtgctgggattacaggcattagccaccgtgcccggacttttttctttttcttttttgtgagacagagtctcgctcttgttgcccaggctggagtgcaatggcgccatctcggctcactgcaacctctgcctcccaggttcaagtgattcggcctcagcctcctgagtagctgggattacaagcacccgccaccacacccagctaatttttgtatttttagtacagacaggggtttcaccatgttggtcaggctggtcttgaactcctgacctcaggtgatttaactgtaaccgcctcggcctcccaaagtgctgggattacaggcgtgagccactgtgcccggccaagaagcagaacattcttttatttatttatttatttatttttgagacagagtcttgctctgttgcccaggctggagtgcagtggcacgatctcggctcactacaacctccacctcctgggttcacaccattctcctgcctcagcctcctgagtagctgggactacaggaacccaccatcacgcccggctaatttttttgtatttttagtagagacggggtttcaccgtgttagccaggatggtctcgatctcctgaccttgtgatctgcccacctcagcctcccaaagcgctgggattacaggcgtgagccatcacgcctggccgaagcagaacattctaaccaggagcaggcgcagggccaaaaagacccacacaatttcttgcataaaaccctcagaggttttccatttatcttatttttattttttattatttatttattttcgagacagagtctcactttgtcacccacgcaggagtgcagaggtccaaacacagctcactgcagccttgacctcccagactcaagtgatcctcctgcttaagccccccaagtagctgggactacaagcatgcgccatcacgcccaactaattttttgtattttttgtagagacggaggttttgccatgttggccaggctggttttgaacttctgagctcaacctatctgctcaccttagcctcccaaagcactaggattacaggcgtgagccaccatgccagcctttatttttagttttagtattatcttttttttttttttttttttttttttttttgagacagagtctcactatgtcgcccaggctggagtgcagtggcacaatctcagctcactgcaacctccacctcgtgggttcacaccattctcctgcctcagcctcctgagtagctgggactacaggagcccaccaccacgcccggctaatttttttgtatttttggtagagatggggtttcactgtgttagccaggatggtctcgatctcctgaccttgtgatctgcccgcctcggcctcccaaactgctgggattacaggcatgagccaccgcgccctgcctagttttattattttttgagacagggtcttgctccgtgctccaggctggagcgcagtgatgtgatctcggctcactgcagcctctgcctcttgcctcagcctgccgagtagctgggattacaggctcatgccaccaagtcggataattttttaaattttttgtagagaatgcagtctcactatattgcccaagctagtcttgagcttctgggctcaggcaatcttcccctcggcctcccagagtgctgggactacaggtgggagccacctcgtctggctggttttccctttttacttggaataagatccaagtccctgccatgtctcacaagaccctgcatggtaggacctctgccttactctctgacctgtgccactatgactctcctctttgctcctggcacttgctgtccccactctctggaatgttctcccactagataattccatgacttgctctcacttctttcaggtctttgctcagtgacaccttccctgaccactgaattttggattgccacctccagccttccttattcctttctcagctttatttttctccataacccagccactcgggttccattcagcctcggtcagctctgcctcctctgccagggtttgacagactgcatctcccccaaagcccttaagggtggtcatacctgattgggggctggtctaactgtcacttctgatggagtcacctctccgagtcactttttatcacatcaccctgggataagaatagcctttctcgggccgagtgcggtggctcacgcctgtaatcccagcactttgggaggccgaggcacgtggatcacaaggtcaggagattgagaccatcctggctaacacagtgaaaccctgtctctactaaaaatacaaaaaattagccgggtatggtggcaggtgcctgtagtcccagctactcgggaggctgaggcaggagaatggcgtgaacccgggaggtggaggttgcagtgagctaagactgtgccagtgcactccagcctgggcgacagagcgagactctgtctcaaaaaaaaaaaaaaaatagcctttctcatgctctgaaataagcttagttatatgtttacctgtttgctttttgtctccaccccacctcaccccacccctcacttcctcatttttatgggaactccataagagaggaaacttaactatcttgtccactaccaaggccagtgcctgatgcatactaggtctcaaataatagttgaccaggctggttgtcaatctcccagagacagttgagcaccccccacactcacacctgggacttgctctctctggaaattcctagaacccaggcatcccacctcctctgccagctcccaactacatcccagactccgtctttcagagccctcctgtggccactgctattgcctgctgctgcttccctgagtcccctgtgggagctgtttggggtccctgaagcagcagctctggaggttagtgttggagagactcaggcatcaggggcctagagctcaagaaatattttgtttgtttgtttgttttttggggttttatgagaccaagttttgctcttgttgcctaggctggagtacaatggcatgatctcagctcactgcaacctccacctctcgggttcaagcgattctcctgcctcagcgtcccgagtagctgggattacaggcatgtgccaccacgcccggccagttttgtatttttagtagagacagggtttctccatgttggtcaggctggtctcgatctcctgacctcgggtgatccgcccacctcagcctcccgaagtgctgggattacagacatgagccaccgtgcctggccaagaaatgctttttgattgagtaaaggagaagacttcagcaatgacagggcctcgccaggtgaagaagggagcaggggcactcagagcagaaggaccagtgtgaacaaaggactggaggcctgggagtacatgtcatatttgaagaaagtgttctgatctggtgctgttggaggattttcaggggagaggggtagtaggagagctttgccggcctggaaggggagggctggaaaaggagggctggatgtggagggctgagctccctgcaggatcagcaaggctcagcatgtcttaggtttaatcctgccccccaccgtccgcccctcctactccatccctgtcctccccttcacccagcccccagcctggccacaactgcagctgaatggacttctctctgggcctacgcttggggcctaggaataagaagcctgcccaccaagagcctcctgcctgctccaggcatggtccacctgctggctctccttgtctgtcctgtcccccatctgcctgtgccttcccctgccatggctgtcccccacccccatgctcctgcactgcctgtccctctagtgcagctccctgccccgcttgtcccagcctcccgggcccaccctgcacctgctcttgcccccgctgccctgcctgtcctcccttgacttgtccccataactcctgtgtctcatgctccggtccacccttgacctgctgccacccctcaccctgcccagtttacccttgctccatgagccgagctgcctgtttgagctcccgtttaggctgcagtgatagctgtagctgtggccaaggggctgcctggggacctccaggctcccttggctgctgtagctgctgcttcaggggacaacaacgcacttctcgggggcgctgtctgatcatttaggtggactgttgcccaccaggagactgtcagtttcctggagcacttccgtactgctgccctggcaaggaggcaggagctgggtggagtgggagagggatcagctggacccctccctcaagcaggtagaggcagctggctttccccagtcctggagaggtggcagggggaatctgctttgaagttagtttctggatgtgctcctgctggttccagaacctcttcctctgcaacctctggaatggaaggtgttcttctcagagcctcccccacggcccctgaaggtgagcaagttgtcatttcttcctctccactgagcctccattggagtctcctctgcagttcacatgaataaatggactcttcctctagaggagctggagtatcctggtccagaggccacttcttctccctctgacctacacccaagattgacccaagagtctctgaatccctgacctctcaccttgagtcaggcagagagggtcagtggcttttggaccagaagaagaggctgagtggaagatatttggttcctccctccacttggaaatccttggcatcctttgtggtcctttgtttctagccaggaaccctctgcctggatgtcttgtctttcaaatctctgagagctcactcagcctcatgacctcaatcttgcagcagtgatcccatctgtgacatccaggctcatctggcatagggatgagggaggctgggaacccttgactcaggctcctaaggatggcatccacacataggtagctgtaagtctcctgtccccagggatgggactgggagatgagacaagccaccaagagatagctgagagccaggctcggtggctcatgcctgtaatcccagcactttgggaggctgaggcaagtggatcgcctgaggtcaggagttcgataccagcctggccaatatagtgaaaccccgtctctactaaaaatacaaaaaattagctgggcatggtggcgcgcacctgtaattccagctactagggaggctaaggcaggaaaatcgcttgaacccgggaggtggaggttgcagtgagccaagaccgcgccgttgcactccagcttgggcaacaagagctaaactctgtcttaaaaaaaaaaaaaaagagatagctggaagtgggagactctggtatctgcctgggatgagctcctaggctgagagcccctgagcaccactccacgtctctccagttttctggctcctgtactaatctgttccaagcttctttttcttagctgccttctctaggactcctttcgttcttgtctttatagctgtttgtgtttccttctgtctttctacctcactctcttcatttctgtttcctcctcactctctgtcactgggacattttgccttcacctaattgtatcaccacatctgttttccccactctctatccctctattactctatctaatttgaaatcaatttaacatatgtcttcagcaccataggaaaggttaaaaaaattagcatatgtgtttttcttcccccttctcttgtctcaatccttgtcttcatgcctattttcttccttggtctttccttttccctcatatctctctgcttttctgtcctgttctgcttctgggtgcatttcattctttttgggttttgttgttagttttttgttgttgtttggttttttgagacagggctcgctctgttgcccaggctggaatgcggtggtgcaatcagagctcactgaagtttctaactcccaggctcaagcgatcccggactacaggcacgcaccaccactcctggataattttttttttaattattgtagagacagggtctcactatgttacccaggctggtcccaaacctctggcctcaagcgatcctcccacctcagcctcccaaagtgctaggatcacaggtgtaagccactgcacctgaccacatttcattcttgatctcttccatttctatttccctttctttgtctctctttctgtcttctatgtctagctgctttttcacttcctatctctctttctgccttcccatatctggtttgcttttatgctgccccatccccccatctccctatctctctgggtcctgcacaatagagcacactatgcctgtctcatgtctttgtcattgctgcccaagggccagaacactgagctctccaccagtgtctgtcatggaaacacagtccatgccctggagtgagccggggtagacatgtctaccagaatagcccctcctttccccactcactatccaggctattcattcctgctcagctttaagcccaagcctcttttctgtcttttttgtctttcttttttaatgatgcttctcccaaattcttattctggaagttggcaattaaaaaaataaaaagaaatggctgggtgcagtggctcatgcctgtaatcccagcactttgggaggctgaagtgggtggatcacttgaggtcaggagtttgagaccagcctggccaacatggtgaaaccccatcactattaaaaatacacaaattagccaggcattgtggcgtatggctgtaatcccagctacttgggaggctgaggcaggagaatcactagaacccaggaggcagaggctgcagttagccgagatcacgccactgcactccagcctgggcaacaaagtcagactccgtatcaagaaaaagaaaaaaaaaaaaaaagaattaagcacttatgctgcctgcatgtataaactatatttcaggatagccaaatagctctaattggtgaagacaacttcttatttacagaataattccagctaatgtggaaggaatacggaattagaaaaatcaccattttgtaactcctaatgaagtaactgatcaaagcaagactcgcctaatggatgaaaacaaagatgatgggtgatggagaattttacaatgggaaattgagctgccacaacctaacccacggatgaatcttagcttcactaaaagtgacacaaccaggcactgtgtacctcctgatgtgatgcaatctgaagcactcatcaccacctatgaaggaatcttgccaaagaaacaaaattgaacataaacctaatcaaacctctagtgctgacttccatttaacaggaaatacagggaatggaggaacaaataaaatgacacaataaggaagcaggtaaacacccccagaatgtgggacattctaaaggaaatctgaccccatttcgtcaactagtgaatggctgggggaaaaaaatgagaagggacttaagaagacaactattacatggaacatatggaccttgtttggttcctaatttgaacaactcaactgtaaagacagttggggatatgtaattatggactgggtattcatgataacaaggaagcagtgctaattttgttagatataaaaatggctcttgggttatagaagagaaggtcgttatttcctagagatgtatgctgaagtatggagtgaagtgacctatttaattttaaatatttcagcagagataaaaggacagaaaggagccgggtgcggtggctcacgcctgtaatcccagcactttgggaggccgaggcgggtggatcatgaggtcaggagttcaagaccagcctggccaacatcgtgaaatcccatctctactaaaaatacaaaaattagctgggcgtggaggtgcacgcctgtaatctcagctacttgggaggctgaggcaagagaatcgcttgaatccgggaggcggaggttgcagtgagccgagatcgcgccattgcactccagcctgggcaacagggcaagactccatctcaaaaaaaaaaaagaaaaggaaaaaaggacagaaagaaaggagtgacaataatcagtaattgttgaattaagaatatggaagttctgggccgggcgcagtggctcacgcctgtaatcccagcactttgggaggccgaggcgggtggctcacacggtcaggagatcgagaccattctggctaacacggtgaaaccccgtctctactaaaaatacaaaaaattagccgggcgtggtggcaggcgcctgtagtcccagctactcaggaagctgagccaggagaatggtgtgaaccggggaggcagagcttgcagtgagccgagatcacaccactgcactccagcctgggtaacggagcaagactctgtctcaaaaaaaaaaaaaaaaaaagaatatgtaagttctggctgggtgcaatggctcatacctgtaatcccaacattttgggaggccgaggtgggtggatcccctgaagtcaggagattgagaccagcctggccaacatggcgaaaccccatctctactaaaattacaaaaaattagccaggcgtggtggcgtgcacctgtaatcccagctacttgggaggctgaggcagaatcgcttgaacccgggagatggaggttgcagtgagctgagatcacaccattgcactccagcctgggtgacagagcaagatcctgtctcaaaaaaaaaaagaatatggaagttcatagaactatgctctctacctttgtgtatgtttgaacatttccataataaaagagttttaaatgatgttcctctggtaagcatggtttccagtaactcccagagcttcctccccacctgccctgaaagccaggacttcctctttggctccccacacacagatcccagctctctctcctctccacccaggccaccctttatcccctgtagttctctgctggcgcagtccccacatttagggctttcccagccatgcttcacagctctgaggggccagagagaccttaaggagtatacatattttgaataggtcctacaataaacaaaaataaaccaaaataatataatcttgcttttggtccctagtaggtgcttctgagcaaaatgcaatgcaataatggtagaaaactggcctccatcttgtgaaatagaaggcaagggatgtaaggtcatcctgtctcatccactgccttcatccaggatgacctccaccccaaaggaaataccactaagaattcaggccgggtgcagtggctcacacctgtaatcctagcactttgggaggccgaggcagggggatcacaaggtcgggagatcgagaccatcctggctaacacagtgaaaccccatctctactaaaaatacaaaaattagccgggcgtggtggcacacgcctatagtctcagctactcgggaggctggggcaggagaatcgcttgaacctgggaggcagaggttgcaatgagctgagatcacataattgcactccagcctaggcaacagagcaagactctgtctcaaaaaaaaaaaaaaaaaaaaaaaaaaaagaaagaaagaattcagagactcactgtcatgagttcaaggggctgaagcccaggactgggctggagggcacttactgagtgaccctggggaaatcatgacttttttcttttccttttccttttttttttttttttttgagacagagtttcgcttttgttgcccaggctgaagtgcaatggcgcgatctcagatcactacaacctctgcctcccaggttcaagcgattctcctgcctcagcctcctgagtagctgggactacaggcatgtgccaccctgcccaactaattttgtatttttagtagagacggggtttctctatgttggtcaggctgatctcgaacttccgacctcaggtgatctgcccacctgggcctcccaaagtgctgggatgctgggattaccggcataagccaccatacactgctttttcctttttaaaagacagggcttgttctgtcacccaggctgaagtacagtgataccatcagagctcactgcagccttgaactcctgggctcaagcaatcctcctgcctatgtctcaggaataactggggttacaggcacccaccaccatgcccagacaggagtctccctagttgcccaggctggcctcaaactcctggcttcaagagatcctcccacctcaacctcctaaagtgctagggttacagatatgagccaccaagcctagcagaaatcatgatttatttatttatttatttatttgagacagagtctcactctgttgcccaagctggagtgcagtgatgcgatcttggctcactgcaacctccacctcccgagttcaaatgattctcctgcctcagccacctgagtagctgggattacaggcatgcaccaccatggcccggctattttttttgtattttttgtagagatggggttttgccatgttggccaggctggtcttgaactcctggcttcaagagttccgcccaccttggcctcccaaagtgctgggattacaggcgcaagccaccacccctggtcagaaatcatgattttctatcttagtgtttctagatgaaagcatgggaaccatcacccctttctactttccactagtttgccagctagggatgaaagcgctttggaacttgtagggcgtaaatcagctgttttatcataagaaagtatttctccaggctggacacggtggctcatgcctgtaatcccagcactttgggaggccaaggagggtggaacccttaaggccagaagttcaagacttttttgggacagggtctcactctgtcccccaggctggagtgcagtggcatgatctcggctcactgcaacctctgcctcctgagttcaagagattctcctgcctcagcctcccaagtagctgggattacaggtgtgtgccactatcgcccagctttttgtatttttagtagtgatggggtttcaccatgttggccaggctggtctggaactcctgacttcaaataatccacccacattggcctcccaaagtgctcggattacaggcgtaagccaccatgcctggccaaaagaaagtatttctccagatgtaatcccaaaccctcctaccctacctctaagctttagtataaaaaaaaaaaaaaaccaacaggccgggcgcggatcccctaaggttgggagttcgagaccagcctgaccaacgtggagaaaccctgtctctaaaaaatacaaaattagctgggggtggtggcgcatgcctgtaatcccagctacttgggaggctgagacaggagaatcgcttgaacccgggagccggaggttgcagtgagctgagatcacgccattgcactccagcctgggcaacaagagtgaaactccgtctcaaataaaaaaaaaaaaagactgatctgctgcgcaagtaggtgaactagtataattgcagaaactatgtgagcttggaactggaaagattgggtcctgcttctaactgccttttactatgtaactctaaacatgttacctaacctttccaactctggttagtacctactgtatggattgttgtcagtcagatgagataattcacctacagcagttggactaaaccttcttaaaactccttaggtacataataactgataagtgttattatgttaatatgggccagtacttttgatagtaatttacataacttattcatttattcatagactatttatggaatatttatgattaatacttatcaatgactgctttaagtatagggaatacaggtgaacaaaacagataaaaatctgtagggaaagagatagtaaatatttacttatttacttagagacgaagtcttgctctgtcccctaggctggagtgcagtggtgtaatcttggctcactgcagcctccgcttcccaggttcaagcaattctcgtacctcagcctcctgagtaggtgggattacaagcgcgcaccaccaggcccagctaatttttttgtttatttgttttgagacggagtcttgctctgttgcccaggctggagtgcagtggtgcaatctcggcttaccgcaacctctgcctcccaggttgaagcaattctcctgcctcagcctccaaagtagctgggattacaggtgcacaccaccatgcccagcaaatttttttgtaattttagtagagacggggtttcgccatattggccaggctagtcttgaactcctgacctcatgatacgcccgcctcggcctcccaaagtgctgggattacaggtgtgagccaccgcgcccagcaattttttgtattattagtaggcatggggtttcgacatgttggccagactggtcttaaattcctggcctcaagtgattcacccaccttggcctctcaaagtgttgagattacaggtgtgagccaccacacctggccaagatagtaaataaataaacaaggaaaatacatagtgtactgcagagtaaaagcagcagagagaatagaaaattggaaggaaagtaggtagattactgtgctggaggtggtggtgttgctattttaaacaggagggccatggaaggcccctctgatcaggtgacattttttaaaattttattttattttttatttttttgtgagacagagtctcgctctgtcacccagactggagtgcagtggcgtgatcttggctcactgcaacctctgcctccctggttcaagcgattctcctgcctcagcctcccgagtaggtgggattacaggtgcccaccaccatgcctggctaatttttatatttttttactagcgacggggtttcaccatgttggccaggctgatcttgaactcctgacctcaactgatcggcctgcctcagcctcctaaactgctgggattacaggaatgagccaccaggcccagccaagatcaggtgacatttgaacagagaactggaggaggtgggggggggaaccacgtggatatcttggagaagaactgtacagggaacagtgtgcaaaagccctggtggtagccaacatagatgggagggagaggagcaggggatgaagtcagaggagtggcagagggtcagaggacagagggtcttgtaggccattataaatacttcggcttttacccttagtgagatgggaagtcattggaggctcttgaggagatgatacggaagctgtagagaggttaaatagtttttccaaggtaaaacagcttgtaagtggcagaaggtagggaattaagctccaaggctgaagttcttaaccccatgctgccactgaactttagccttctttatttgggcattgctatcctgtgacttcaaagaaactgggacactgggaagttatgcggcttgcccaaggccacacagctggtaagtgacaggggcaggactgcgccttagtctgtctgcagcccgactccaagttctttacaccacaccgcctccctcaggtgtctggaccatactggcttctcttgcatggaggtcactgcagtgggagaggaggcaaaccaaggagaccttctcggcttcgggcagcggtgctgttccttaggaagctccaacccttggctctaccggactgcgggcatctttcccgagcactgcacggaagaaaagaaaattggcacttatttcagggtggcccctcaggcatccaagagccagaggagcaggtgtcacgggatggcagcgagcgaggccaggccaggagaagcaaccgcagcctcctatggtcgccccttcccgacccaccccaggcgtcaggagttccgcgcccgggtaagggaaggagggcgggcgggcggggcggggcggggttttggcgccgcgcccccgtcacgtgatgaagccatcatggcggcggccagaggcctgcccggctcccggaagcaggctgtgaggggcgggagcgctgctggaacccgagccggagccggagccacagcggggagggtggcctggcggcctggagccggacgtgtccggggcgtccccgcagaccggggcagcaggtgaggcggagtctgggcgaggtgcaagtggatgtggcagggctgggcaggggctagggggcgcagtggggtgccagtgacctggaggagtgggcctctgagatgcacacgcatgaccctgaagcaactcgagaggcctgcgcgggtgggagggatgcccgggacagaggatgagacactgagggcaaaaagaggctccgcagcgaggacgggaggtaatagaaggaagtgtacgggagctgctgtgggaaagggcagtagaatttgcgggagcgggattattgaaagggactccctcttcacaggcaaggatgggttgagtgcccagtcctctcccctgtcttcttacccctccctgccccacagtgtcctaggagacagctttggcgtggccactcctcccacccacccaactggtccctccggtctgagatcttggggagtggagttggcagcggggttgggtggagctgccatctgcttaagacagccccttgaccgtgctgcccgaaggatggatatggctctgactcccacctctcttcccaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatcattgatttgatttactcatccttacctgtagccttatcagtagtttctggtgagtgggcagctagaggttttttttttagtttttttttgttttgttttgtttgtttttgttttgagacggagtcttgctctgtcgcccaggctggagtgcaatggcgcgatcttggctcactgcaacctccgcctcccggattcaagcaattctcctgcttcagcctcccaagtagctgggattacatgtgcctgctaccatgcccagctaatttttgtatttttaatagagatggggtttcatgttgaccaggctggtctcgaactcctcacttcaggtgatccacccacctcggcctcccaaagtgttgggattacaggcatgagccaccacgcccagcccagctagaggttttgaggtgggattatcagcaaaagttttctgtttctaacttctccaaggctgtctccagttcaaactgagaactatggaattgctctcagcagagctgtgtgggaagggcctgaggcttctaggtcctccacattcctctgttgtgggacaggcactccccccagttgtcaagcagaacccttgcttacatccagggtaagatgatctccagagcacatggagtagatgccccatatgccaggccactgagcaaagattccaggggcttgggctgctgctgtgaccactccttgggcaaagccagggcccttcctaccaaagtaagcttgcagctcagcacaggcctgctgcctcccttttgcctctgtggctatgaatgcaccatttgtccaacatcatctgggtctaccagatcctgtatccctgtgtgaaaccgaagtgaaaggctgccaaggggacagagtggtgcatggctgagggactaggatgtcttatctgtacctgactgtccccaacccagcctgaatgagggtgagggagccatcagggcaggaaacagtactagtgagccagttctgtgggtgcctccctgcctcacctctgattgtatctgcctttcctcctcccaccaaaacctgggcttctcaggggaagcacagccagctttaagaagggtggggagggaaggagggtaggctcaaggatgtgtcctggaatgtgcttgagatgggcatgggggacacataccctttctggaaaggggttaatgacctttccttgggtcccagactactcagaaagatgcaggatgttccaagacctgcaggtcccaacctgtgtggagagatagcatcagcaggtgctggtggaatgcagggtggaagggcttctgcagggtgaggccaaggggaggaatgggtggtggtctcaggtccctactcagactaggaaaaaacatgttcccccacccaggcttcagggaatagaggttgaggttaagtaagaaaaacacatatcagccaggtgtggtgacttacacctgtaatcccagcactttgggaggcccaggagtttgagaccagcctgggcaacacggcgaaaccccgtctctacaaaaaatacaaaaattagctgtgcgtagtggcatgtgcccatggtctgagttacttgggaggctgaggtgggaggatcaattgagcctgggagatcgaggctgcagtgagtgataattgagacacgccactgcactccagcctgggcaacagaatgagactgtctcaaaaaacaaaaaaaaagaaaaggcatcttttctactacccccctactcctgccacccatcatctcaagactaaagacagtcttgcaataactccacttcctctttctgccctgttgggctagacctagatatactttatagttatttgtagatgttccgtctcaagatcatgctatgatcttgaggggaagaggaaacagtcttactcacctttatctcctgcatatatacacacaattggatgctttccccatggctgtgctcagtacatatctggagaggagacaggctagctcacacctggcttttcaggagacacttggtgatttgttgttttggatgacaatatcattattatcggtttttgttttattttgtttttgagatagggtctcgctctgtcgcctaggccagagtgtagtggcaggatcatggctcactgcagcctcgacctcctgggctcaagcgatcctcccaccttagcctcccaagtagtagggactacaggcagcaccaccatacccagctaattttttaaaaatttttgtagagacaagggtctatgttgcccaggctcatctgaaactcctgggttcaagccatcctcccttctcagcctcccaaagtgctgggattacaggtgtgagccaccacacctggcctgacagtaattattagtggccctcacattcctaagtgatatggaaatagaggggtaggggagactaatgagattcctttagctttgtccctgatgagcttgcttcaaaggggctggtggcaaatagagtggagagtgttctttcctgtcagactcacagcgtgttaagagctggaaggcatcttagagattatccatttggccttaaacattttttattgagcacctgctatgccgtgtgttttaccgctaggtactggtgatatttttatttattattttattttattttattttttaagatggagtttcgctcttgtcacccaggctggagtgcagtggcacaatctcggctcaccacaacctctacctcccaggttcaagcaattctgcctcagcctcccaagtagctgggactacaggcgtgcaccaccacgcctagctaatttttgtatttttagtagagacagggtttcaccatcttggccatgctggtctcaaactcctgacctcatgatccacccgccttggcctcccaaagtgctgggattacaggcatgagcaaccgtgcccggcctatttatttatttttttgagatggagtctcgctgtattgccaggctggagtgcagtggcaccatctcggctccgaggttcaagtgattctcctgcctcagcctcccgcgtagctgggactacagacacaccccaccgcacccagttaatttttagtagagacgagatttcaccatgttggccagaatggtcttgatttcttgacctcgtgatccacccgcctcaggctcccaaagtgctgggattacaggcgtgagccaccacacctggccttatttatttatttatttatttatttatttattttacccaagaggaaaatccacttaaagaaagcaaataacttgcctaagggcatgtagcaagtgagtgataaaactaagactaaaccttgcctctttttgccaacccagtgccccctctatgacacatgctgcctctgtcccatgggacttcacttacctgtttttttagcctccagccctgcttccccacccaaagctctgtccctggagaacagcaagagagtaggagtatttggctgtctgatccacttaggggtatctatccagattattcaaatgagggactggttcaccaggtgcatactccctgcgaaatgctgctcatgatgctccaccaagaggccccatagggaagtgattaaaaatgtggatctgagggccgggtgcggtggctcacacctgtaatcccagcactttgggaggccaaggcgggcggatcatgaggtcaggagatcaagactatcctggctaacacggtgaaaccctgtctttactaaaaatacaaaaaattagccagttgtggtggtgggcgcctgtagtcccagctacttgggaggctgagggagaagaatggcatgaacccgggaggtggagcttgcagtgagccaaggtcgcaccactgcactccagcctgggcgacagagggagactccacctggaaaaaaaaaatgtggatctggccgggcacagtggctcactcctgtaatcccagcactctgggaggccaaggcaggtggatcaccagaggtcaggagtcgagaccagcctggccaacatggtgaaacccgtctctatgataatacaaaaattagccaggcatggtggtgggcgcctgtaatcccagctactcgggaggctgaagcaggagaatcgcttgaaccctggaggcggaggttgcagtgagccgagatcatgccatcatgccattcattgcactccagcctgggcaacaagagtgaaactccatctcaaaaaaaaaaaaaaaaaaagcccaactgcctggtttgaatctggctccacaactctgtgcctcagtttcctcatctgtgaaatggggaggatagtatagtttcaacccctaagggttcttgtgaggattaaatgcgtcattgtacttaagtgcttagaacagtatttggcccacagtataagcactacataagtgtttgcttttatattttattttttaacttctccaatccagctgagcctatctagatttgagtgtgggaatgagtggacaggactgtaatggggtgtagaacttcccaatgcatcttagtgattgggggattcccagcagcgtttatcctcagtactggcccagatggaattatcgagctatttgagaaggcttctactctgggatatgtgagcatctgagctgggtgtcaatgtgttccacttgaactcatttcctcttcctctagtgggaaagtcagcttggggttagactggatacaaccaccatctttcactaagaggctcctgattttctgaatttccatccagctggaaacatgattatttgatctggagcttttaagcgatcctgaggagaaaagagaaacatcctggggacccaggagccaatgaacgaggaggcaggaggactggggcaggaagacagtacagggttctgaggcctggaggatgacctcttcctggaaattcagtccctgccctgggaggggagggggctgttcccggctaatggtcagctgagtctaggtcctctccttatcgctcttcccctaaccccaatcctgtggttttcctgccctttttattatttgctgccactacctccccatagaaccacagattggaaatgtaacacaaacaaatgtcatgcttgagatcagatctgatgttataaaaatacctcacatttactttaactgtttttttcataaagttatatggtctcattgtaaaatggtcaaatgcaaatacagaaatgcatattttatatacatatgtgaatatcagtatgtgctaattacgttatagtagtatattaaaatacatatatttgtattgctatataaatatatagttgacgcttgaacaacagcaagccactgacccatggcgcagttcaaaatctgagtatggctttttctttttttttttgggggggacagggcctccctctttcacccaggctggagggcagtggcacaattttggctcactgcagcctcagcctcctggattcaagcaattctcctacctctgcctccccagtaactgggactacaaggtgtgcgccatcatgcctgactaatttttgcatttttagtagagatggggtttcaccatgttggccaggctggtctcaaactcctgatctcaagtgagccgcccaccttggcctcccaaagtgctggggttacgggagtgagccaccatgcccggctttttcttgagactgaatcttgctatgtcacccaggctggcctccaactgctgagctcaagtgatcctcccacctccacctcagcctccagactggctgggactactcaaacaccaccgtgcttggcattttttttttttttttgccttctgttgctgcctctgaaaataattcattttttttctttttcgttttaagacaaggtcttatgtcacccaggctagagtgcagtggcacgataacagttcactgcagcctcgacctcctgggctcaagcagtcctcccacctctgagtagttgggactacaggtgcacaccaccacacctagctaatttttttttttttttttttttgtagagaagatggtctcactatgtgacccaggctagtctcgaacccttgagctcaagcagtcctcccacctcagcctcccaaaatgttggaattacaggtgtgagccactgtgcctggcctgaagataattctttaaacttactttaatttttcactttttttttttttttgagatggagtcttgctctgtcgcccaggctggagtacagtggcccgaccttggctcactgcaagctccgcctcctgggttcacaccattctcctgcctcagcctcccaagtagctgggactaaaggctcccgccaccatgcccagctaattttttatatttttagtagaaatggggtttcaccgtattagccaggatggtctcgatctcctgacctcatgactcacccgcctcggcctcccaaagtgctgggattacaggctaatttttacattttaaaaaaatttttatttatttatttttttgagacagtctcaccctgtcacccaggctggagtgcaatggcatgatctcagctcactgcaaccttcgcctcctgtgttcaagcaattcttctgtctcatcctaccaagtagctgggactacaggtgcacgccaccacgtccagcaaaatttttgtatttttagtagagatggggtttcaccttgttggtcaggctggtctcgaactcctgacctcaggtgatctacctgcctcagcctcccaaagtgctgggattacaggtgcgagccaccgcgctcagccactttagtttttttagagatggagtctcattctgttgcccagactggagtgcagtggcaaggtcatagctcatgggagtcttaaactcctgggctcaagcaatcctcccacctcagcctcctgagtagctatgactacaggcattggagcaaccatgcctagctaagttttaaattttttatagagatggagtcttgctatgttgcttaggtctcaaacttctggcctcaagtgatcctcctgcctctgcctcccaagtagctgggattatagatgcaagccaccatgcccagtgattgtgtataacttttttttttctaagacagactctctctctgttgcccagctggagtgcaacggtgtgatcctgactctgcaacctccacctcccagcttcaagcgattcttctgcctcagcctcccgagtagctgggattacaggtgtgtgccaccacgcccggctaatttttgtatttttagtagagacggggttttggcaagttggccaagtgatccacctgcctcagtctccaaagagctgggcttacaggcgtgagccaccgtgcctggcctttttttttttttttttttttgagagggagtttcactctgtcgtccaggctggagtgcagtggcacaatcttggctcactgcaacctccgcctcctgggttcaagcgattctcctgcctcagcctcccgagtagctgagattacaggcatgcaccaccacacctggctatttttgtatttttagtagagatggggtttcagcatgttggccaggctagtcacgaacccctgacctcaggtgatctgcccacctcggcctcccaaagtactgggattacaggcgtgagccaccatgagcctgaccacgtataacttttgacttcctaaaaacctagctactaatagcctactgttgacctgaagccttaccaataaatcgtataaacagccaattaatacatattccgtaatatgtatgatattctatatccttacaatatatatttttttctttttttgagacggagtctcgctctgtcgcccaggctggagtgcagtggcgcaatctcggctctctgcaagctccgcctcccgggttcatgccattctcctgcctcagcctcccgagtagctgggactacaggcccccgccaccacgcccggctattttttttgtattttttagtagagatggggtttcaccgtgttagccaggatggtctcgatctcctgacctcgtgatccacctgcctcggcctcccaaagtgctgggattacaggcatgagccaccgcgcccagccttatatatatattttcgagacggagtcttgctgtcacccaggctggagggcagtggtgtgatctcggctcactgcaacctccgcctcccaggttcaagcaattctcctgcctcagcctgccgagtagctgggattacaggtgcccaccaccaagcccggctaatttttgtatttttagtagagacaggtttcaccatgttggccaggctggtcttgcactcctgacctcgtgatccatccacctcagccacccagcgtgctgggattacaggcgtgagccactgcacctggccaagaacatgttattaagaaaatcatatgccaggcaaggtggctcatgcctgtaatcccagctctttgggaggccaaggtgagcggatgactcaagggcaggagttcgagactggccaacatgacaaaactccatctctacaaaaaataccaaaaaaattagctgggcatggtggctgatgcctgtaatcccaactacttgggaggctgaggcagctgaattgcttgagcccaggaggcagaggttacagtgtgcagagattgtgtgtgccactgccctcgagcctagaaaaaagagtgagactctgtctcaaaaaagaaaaaagaaaatcataaggactcttatcataaggaaaatatgtttactactcattaagtggaagcagatcatcatcttcgttgtcttcacattgagtagaatgaggaggaggaagaggaagggttggtcttattatcgcagcagtggcagaagtggaagaaaatcctcacgtaagttcacctgtgcagttcaagcccatattgttcaagagtcaactgtactttaaatatacatatatgcatgtagaaatataaaacgtaaaaaatgacaggctcccttaatcctgctcatcagagattactactattaaatgttttgggtctagaccagcagcagatttaatatcaaagctttttttttttagacagaatctcactctactcactctgtcactcaggcggagtgcagtggtgtattctcggctcactgcaacctctgcctcccgggatgaagaaattcttgtgcctcggcctcccaagtagctgggattacaggcataagctactacacccagttcatttttgtatttttagtagagatagggttttgccatgatggccaggctggtcttgaactcctggcttccagtgatccgcctgccttagcctcccaaagtcctgagattacaggtgcgagccactacacctggccagtcttttttcttttttctttttttttaacaaaaattggatcataccgttcatatttttctgcaacttgttttttatatatcttatttttctttccttaaaagtccacaggaagactgtaacagtcattcatgcatctctgacatctttatatgatgatatgcttgatataggacatgcttttttattttattgttattttattatactttaagttctgggatacacgtgcagaacgtgcaggtttgttacataggtatacacgtaacatggtggtttgctgcacccatcaacccgtcatttacattaagtatttctcctaatgctatccctcccctagccacccatccctcaacaggaccccgtgtgtgatgctcttctccctgtgtccatgtgttcattgttcaactcccactatgagtgagaacatgcggtgtttggttttctgttcttgtgttagtttactaagaatgatcgtttccagcttcatccatgtccctgcaaaggacgtgaactcatcgtttcgtatggctgcatagtagtccatggtgtatatttgctattatttatttatttatttacttattcatttatttttgagatggagtctcgctctgtcgcccaggctggagtgcagtggcacgatggcccttggctcactgcaagctccgcctcccaggttcacgccattctcctgcctcagcctcccaagtagctgggaccacaggcgcccgccaccacgcccggctaattttttgtatttttagtagagatgggatttcaccgtgttagcctagatggtctcaatctcctgacctcgtgatccacccaccttggcctcccaaagtgctgggattacaggcgtgagccaccgcgcctggccaattttttttttttttttgagatggagtctcgctcttgtcacacaggctagagtgcaatggcacaatcgcaactcactgcaacctccacctctgggttcaagcgattctcctgcctcaacctcccaagtagctgggattacaggtgcccaccaccatgcctggctaatttttttttttttgagacagggtctcactccaggctggagtacaatggcatgatctcggctcactgcaacctctgcctcccgggttcaagcgattctcctgcctcagcctccgaagtagctgggattataggtgcccaccactatacccggctaatttttttgtatttttattagagatggggtttcaccatgttagtcaggcaggtctcgaactcctgacctcaggtgatccgcccgcctcggcctcccaaagtgctgggattacaggcgtgagccaccgcgcttggcctcatgctttattttttttgagctgggttcctgctatgttggccagcctggagtgcagtggctattctcaagtgaaatcatagctcactacatccttgaagtcctgggctcaagcaatcctcctgcctcagcctcctcccagcctcagcctcctgagtagctgggatgttaggcatgcaccatcacatccagctattatttatttatttatttatttttggtagagacagggtcccactatgttgcccaggctggtctcaaactcctgggctcaagggatcctctcacctcggcctcccaaagcgttgggattataggtgtaagccactattcctggccaaaacatgttttttttttgtttttttttttttaagacagagtgtcgctctatcgcccaggctggagtgcagtggcgcgatctcagttcactgcaaactctgcctcccaggttcacgccattctcctgcctcagcctcccgagtagctgggactacaggcgcccaccactgcgcccggctaatttttttgtatttttagtagagacggggtttcactgtgttagccaggatggtctcaatcttctgacctcgtgatccacccgcctcagtctcccaaagtgctgggattacagacctgagtcaccgcgccacacgttttttaatgactgccatcatcgttagggtcttcaaggctatctgaggccttcttctatttgaggctaaaagaactcctggaggtagtgaggcttgatgttactgtccccatttcactgagaaggaacaaattagaactggcactagaacctggctcctctgtcctgtctcattttcaaagctctttccatcatcctgtgctgcctctataagtttgtgattcacatgaggaaataatgtgactcaagttcgtattagtcagcatttattgatctgttgatacttaaagtacttcttgtaagaagtagaaaataaaaaagaaaaaagaaaacaaaagcaaaacaaaaaacaaacaaacaagaaataaaaaataataagctctctgcccttgaggagtttagaattaagtaggtatgataggctgggcatggccaggcacggtggctcatgcttgtaatcccggcattttgggaggctgaggcaggtggatcacttgaggtcaggagtttgagaccagcctggccaacatggtgaaactccgtccctactaaaaatacaaaacattagctgggcatggtgatgggtgcctgtaatcccagctacttgggaggctgaggcaggagaatcacttgaacccggaggcagaggttgcagtgagctgagatcacgccattgcactctagcctgggtgacaagagcgaaactccgtctcaaaaaaaaaaaaaaaaaaaggctgggcatagtggctcacgcctgtaattgtagcacattgagaggctaaggccggaggatcacttgagctcaggagttcaagaccaacctgggcatcatagtgagacctcgtttctatcttaaaaaaagaagaaaaaagtaggtataataaaatacgttgggaaaaagtcctagaatgcttgctaaacaataggtaaatgaacactgatagctaaggtgtaagcaagaggaattgagtactgtgatgaataattttcttttgggttttttttgtttgtttgtttgttttttggtttttttttttttgagacagagtcgtctcgctctgtagcccaggctggagtgcagtggcgcgatcttggctcactgcaagctccgcttcccgggttcacgccgttctcctagcgcagcctcccgagtagctgggactacaggagcctgcaaccacgcccggctaattttttgtatttttagtagagacggggtttcaccatgttggccaggattgtctcgatctcctgacctcgtgatccgcccgcctcggtctctcaaagtgctgggattacaggcgtgagccaccgcgcccggccttttttttggttttcttttttgagacagagtcttgctctgtcacccagactgcagtacagtggcgggatctcagctcactgcaacctccgcttcccgggttcaagcgatcctcccaagtagctgggactacaggcccccgatgccacagcagctaatttttgtatttttagtagagatggggtttcaccatgttggtcaggctggttctcaagtgatccacccacctcggcctcctaaagtgctgggattataggcgtgagccaccgcgcccggccttcttttctttctttttacaaaaataatcttccctgctagattctcaactcataaaagagctctatgatgatggagaaggatgagttatccagtagagttcatcagcgacaagctgataaccacttttgagctgaattctttggtggaggaaggaaagagacagctgaatctgtgtttggggaagtggttagtacttaaaaacataagccattaaagactgtgaaatatcccagggaatgaatttccatagttcttcctgctactcacaactcccaccccaccccactaccctctctcccccatcgaagagcaccagatcttgtctttctcatacaaccaatagaaggagtaaggctggaaggcagagagagagctggaggtcgctacgggtactcattgtagttcccctagaaaaccatctttaaaataatttcgtaggaagttgggcgtggcggtgcacgcccgtagtcagcactttgggaggctgaggtgggaggatcacttaagcccgggagtttgaagctgcagtgagctgtgatcacgccactgcactccagcctgtgtgtcagagcaagaccctatcaaaaaaaaaattcgtagaagtctaagccctttttttctagtaacccaaaccgcgtgagttcctaagttctttttgttatttctcttctcttgaaacttaaactcttgcctgagctctgaagataaaggaggaaaaggggtggcattaccgatagcgactaagcgacaggtagctgagaaactgagctctgactggaaaaaagggggaaacccgcacccccaagaggccctaacgcgcagagcagcaagaccctccggggcgccgcgggagcgcgcagcgcggcgggtaaactacaactcccagcgtgccgcgcgcccggcgttgcgccgcgcccgctgattggcagccgcggatatttgaaaggagggtctggcgcggaaaacgaaggttacattttggatcctcgcggagtactggtcaggcggttaagtcctgtacctaggaaagagggcgagctctggggcggtaaggccggaagggactcgtgagcgtgggtacgtgctgaagtgaaggggatccccagcgctgacgcgaggagaggcgtgggtggctcctggagggagtgtcgggaggccttgggactgccccgggccgctgaagggctgggccgaggcctctggggtagcgcggcgagtggtgtggtagtgcggtcggggatctgcccggaggaaggaagagcggaatcgtccttttataacgggagcacggcgtcctggcgtgggttttctccccgatgaaatttctgatgtgattctttgcctccttccacgaccttcagccctcttcccttcctccagttagcttcattaacaatcttctctaattggtctccttttccctagctctccggtgtcatgaggagcttcaaaagagtcaactttgggactctgctaagcagccagaaggaggctgaagagttgctgcccgccttgaaggtgggggtgctgcctggctcgggatacacctggctttccaaactgagctgttttgtgtttgccttttgaagagatggataagtaggcgaccctctctgagtaaccctatttctagttactttctctacctctttcctgcctttgctagccccattcatatctttctctactcctaggagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggttggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgagttaaggacctggaggtagggtggggacgtggtctgtggactcactaccagcctagggtatttggcaagatctggaggtcctggctccctccttgttaagctgctctctggacagtgcctagcgagccagcaaacagcctagtctatcctgagagggcagtggcccttctggatgtccttcctcgtgctccctgggctctgtcagctctccaggactccgggtcagtcttcagcttggagccctctttatctctactcctcataccaaccttccgcttccttcctcaggtgtatgggggctcctccaagcaacagcagtcttttcttcagatgtactttcagggacttcacctctacactgtggtggtttatgactttgcccaaggctgtcaggtactgtctgggaatcaaggtacctggactaggctcatagggtttggggttgctccactgccctcaaacagctttggggttgctccactgccctcaaacagctttggggttgcttggctttgggtgtggagtgcggtggaggtcatcttggacccagcatgactcctcactctcaaacccttcttgtcccttcagatagttgatttggctgacctgacccaactagtggacagttgtaaatctaccgttgtctggatgctggaggccttagagggcctgtcgggccaagagctgacggaccacatggggatgaccggttagtgccctgggtcccaggcacagagtttgtgggagggtcatcacccattaggcaggtgaatagtacttgctgcgtggttctgaccactgtgagggttccttatggttcaaggaggcagtgagagaaatgtttataagtaccagctactctgtgtttaacaccagtagagaagtgatgaagctaacttacaacagcagacactatttcctcgactggaatctaacttggcattaacagttgcacctaatatgcaaccttatgacctttcaacatatttttttatttctatattttttaatgtttttttttccttttcttcacttatcagaatccagaaatcattacaaatgacctttctgtatatttaagtgtttttttttttttttttttgagacaaggtcttgctctgtcacctaggctggagtgcactggcacaatcacggctcaacacagtctcaacctcccaggctcaagcgatcctcccacctcagccccgcaacgagctcaccttgcaggttcaagcgactctcctgcctcagcctcccaagtagctgggactgcaggcgcgcaccactatgcctggctaatttttgtattttttgtagagatgatgtctggccatattgtccaggctggtcttgaactcctggactcgagtgatctgcccaccttggcttccctgaaaccctgtctctactaaaaatagaaaactagccaggcaaggtggtgcatgcctgtaatcccagctacttggtaggctgaggcaggagagtcgcttgaacctgcaaggtggaggttgcagtgagccaagattgcaccactgcactccagcctgggcaagagggcactccagcctgggcaacaagagcgaaactccatctcaaaaaaaaaggagaattcttcccacagagtactgaagactgactttattttctcccagtcatctatgttgatggccaagaagctgcataaataagttattatcatttattcagcaaatatttgttgccgggcgcagtggctcacgcctgtaatcccagcactttgggaggccgaggcgggcggataacgaggtcaggagatcgagaccatcctggctaacagtgaaaccccgtctctactaaaaatacaaaaaattagccgggcgtggtggcaggcgcctgtactcccagctactcaggaggctgaggcaggagaatggtgtgaacccgggaggtggagcttgcagtgagccaagatcgtgccactgctctccagtctgagcgacagagcaagactctgtctcaaaaaaaaaaaaaaaaaatttgttgagtactcactgtgtgcaacgcactatttggagtacttggatgtgtcggtaagcaaaacaaagtttccttccctcatggagccacgttctagtttggggggaaaagataaacagattcagtaaataagtgaattatcaacatattagaacgtgataagaaatgtgggggaaaggaaaagtagagcaggataagaaagggaattgggagtctaaggtgcatgacggggggcaagttaccaccttaaatcaggtggtcagggtagacctcattgagagggtgacatgagcaaaggcttggaggatgtgagggagtcagccatgtgggttcctggaaaagaacatccctggcagaagaaacagccagtgctgaggcaggagggggtctcgtttgtaaaatgagtgcagatgggctgagtggtgtgaagggcatgggcctatttggggcaggaaggggagagccgccccttccccattcctagcagtaggggttcctgtctgatctggaagctgctgaactgaccacagatccagctgatctctgctgcctctccaggaggagagggtggtgggagcctttcctatggtcaattgtgccttttctcccctgcagcttcttacaccagtaatttggcctacagcttctatagtcacaagctctatgccgaggcctgtgccatctctgagccgctctgtcagcacctgggtttggtgaagccaggcacttatcccgaggtgcctcctgagaaggtacaagggaatgagagatgcaggaaaggagcttatgtggttggggagcggggggagcggggaagggcctcaccagcaccctgccttggagtgggaggttaatagcagcatgttgacaccagtatctggagcagtgtttcccaaacctcactgtactgttacttactgttgactcatttttttttttttttttttttgagacgagtctcgctctgtcgcccaggctggagtgcagtggcacaatcttggctcactgcaacctttgcctcagcaaaggttcaagcaattctcctgcctcagcctcccaagtagctgggattacaggtgcccaccaccacgcccagctaatttttgtattttttgtagagacggggtttcaccattttggttggccaggctggtctcaaactccagacctcaggtgatccgcctgcctcagcctcccaaagtgctgggattacaggtgtgagccaccgcagccggcctgactcactttttatatttagcctggtcctaagctactggtttccagccaagctgcacattagaatcacctgagtgacctttaagaaaattctaatgtctgccccgagttaattgcatcagaatctctagtgtttgccgggcgtgatggctcacgcctataattccagcactttgggaggctgaggcaggtggatcacctgaggtctggagtttgagaccagcctgtccaacatggtgaaaccccgtctctactgaaaatacaaacattagccaggcgtggtggcatgtgcctgtaatcccagctactttggaggctgaggcaggagaattgcctgaacccaggaggtggagtttgcagtgagccgagattgtgctactgtactccagcctgggctacagagcaagactccatctcacatctgaatattttcaaagatcccccaggtggtcctttgagcaaggagagtgagaacctgggttcttggttttttggttttttttttttttttttttttttttttttggagactgagtcttgctcttgctttgtcacccaggctggagtgcagtggcacgatctcggctcactgcaacctccacctcctgggttcaagcaattctctgcctcagcctcctgagtagctgggattataggcatgcgccaccatgcctggctaatttttgtatttttagtagagacgggggtttcatcatcttggccgggctggtcttgaactcctgacctcatgatccacccgcctcggcctcccaaagtgctgggattaccggcgcaagccaccgcgctgggcaagaaccagtgttcttaagcaagaatacctgtgaactgatgcattggcgggattggcaagcaagatgagtcatagaggggcttgggtttcatcttaactgagatgataagcctctaaaggatttaagtggaggcatgacagcagacaggcattttggatttccctgacttcgctgtgatgaatggagtgcaggagaaaagaccgggtaatcaggctgctatagtattctaggcagggaagggtgggctgaactgaagcagctgcacgagggatggaatgcagtggatcggtgcgagaagccaaggattaacctggtaggtgactggcgggagggagagcgagagaagggaacatcagagatggccccacatttcttactcaggagaaggcagtgccatttgctgagaaggattacaggagaagcaggttttcaagggtgtggatgatgaacataggggtggagtggattgcagcctctgagttgaaggcactcagagtatttcattcttaggtgtctcctgccttgggtgggtgtggctcaggaggcccacctgccaaccccgccccctcatgtggtgtatgtacctattgcatgcatatccccttccaccatacacactcactggttcctctccagtttggtctgttccctttctctggtcagttgcacaggtgcttccggctacaagtagagagtttgaagaaactgggtaaacaggcccagggctgcaagatggtgattttgtggctggcagccctgcaaccctgtagccctgaacacatggctgagccagtcactttctgggttcgggtcaagatggatgcggccagggctggagacaaggagctacagctaaagtgagttgagggccagacgcagtggctcatgcttgtaatcccagcactttgggaagccgaggcgggtggatcacttgaggtcaggagtttgagaccatggccaacatggtgaaaccccgtctctactacaaatacaaaaattagctgggcattggccgtgcacagtggctcacacatgtaatcccagcacacatgtaatcccagcactttgggaggccgaggcgggcagatcatgaggtcaggagatcgagaccatcctggctaatacggtgaaaccccatctctactaaaaatacaaaaattagctgggcgtggtggcgggtgcctgtagtcccagctactcgggaggctgaggcaggagaatggcgtgaacccgggaggcggaggttgcagtgagccgagatcgtgccactgcactccagcctgggtgacagagggagactccatctcaaaaaaaaagtgagttggggagggggtcaaccatgtttctcccatggatagggtggcttttggtactcatggtcatgtcctttcatctttatgtctgaaaaatactaattccttcattcattagttattcattgagtgcccactgtatgctagccactgtgctacttggggggtatagtggtgacagtggtcttgctttcatggagcttatattctacttggggagatatttttaaaaagtacattttgcattttgtgtctgttcctttttttttttttttttttaatagagacaaggtctcactatgttgcctaggctggtcttgaactcctgagctcaagtgatccttccaccttggcctcccaaagtgctaggattacaggcatgagccagtgcgcccagccttcacgtatgctctatgaagacaattaaactgatttgctaaaagagggagcaacttgaggtgggttatttaggaaaaccctttttgaagaagtgatagatgagacctgaggatgtgaaggaatctactttgtaaagatctcagggagcctgggcaacaaagcgagaccttgactctacttaaaaaatattagccgaatgtggtggcatgaacctatagtctatttacacttggttaggaggctgaagtgggaggatcacatgagcctggaagatcaaggctgtagtgaaccgtgatcacgctattgcactccagcctgggcaacagagtgagactgtctaaaaaaaaacaaacaaaaaactcagggaagagaattccttgcagagagagtagtaaatacaaaggttgcaaagtgggaacaaacttgggaccatgcttgagaaagccggcatgctgggggtagtagaatagcggtataggatggggaaccatatggaatgaaggtggtcaaagtgggaagcggccagatcacacagggccttataggccatggtcagggctttggaaatgattcctagtgggagcccactgccgtttgttaaacagaggagcaatgcaatctgatttaaatttttaaagccatgactggaaacctactgagcaagccaaggctggggctcctcagcatgggagcaggtagcagaggctttatgcctcctgggttccaccctggtgctgagcatgccctctctcaggactctgcgagacagcctcagtggctgggacccggagaccctggccctcctgctgagggaggagctgcaggcctacaaggcggtgcgggccgacactggacaggaacgcttcaacatcatctgtgacctcctggagctgagccccgaggagacaccagccggggcctgggcacgagccacccacctggtagaactggctcaggtgctctgctaccacgactttacgcagcagaccaactggtaaggagtagtagctgcagaggccactcttgctccttgccctaggtcctctcaccctcttgagaaccagtttccctctccacagccctgagctctcccttcatcttgtggccatgggagcacatgcaaagggcgaggccagctgttctgcagctagcccttcccagggcgctatggcagatactcatagtaggcccagcttaagcacatcttctccctgcagctctgctctggatgctatccgggaagccctgcagcttctggactctgtgaggcctgaggcccaggccagagatcagcttctggacgataaagcacaggccttgctgtggctttacatctgtactctggaagccaaaatgcaggaagtgagtgtggctgctgtggggctcaccagaactgggtgtaggaattactgtccctgggcccccaacaagttggtatcagcccttttttttgttcgttatttttagagatggggtctctctgttgcccaggctggtcttgaactcctgggctccaacaatcctcccacctcagcctgccgagtagccaggacgataggcccacaccactgtgccctgttttataccccgatcttcccatccagggtatcgagcgggatcggagagcccaggcccctggtaacttggaggaatttgaagtcaatgacctgaactatgaagataaactccaggaagatcgtttcctatacagtaacattgccttcaacctggctgcagatgctggtgaggggtaaatggagtgtggcatgggcatctccatggcttcctaagagtggaacagggacccctggtgagggaaaccctgaccttgtagggtaggaggttgtggaagcagtgggaggttggcgtaaagggcagaggatgttatggaggaagggaagttctctccagatggcccatgctgagacagcagtcattttcttctggcttaacagctcagtccaaatgcctggaccaagccctggccctgtggaaggagctgcttacaaaggggcaggccccagctgtacggtgtctccagcagacagcagcctcactgcagatcctagcagccctctaccagctggtggcaaaggtaatggggtggggcattgagggggacccatataaacaaggactagaccagaaacagctccctcgccttctttggcctgtgatcctcctgagaagccatgaaagccagtgatggaagcgcagggctgtatcaccagtcttattttaaatccaagctccctcattcattagtgtatggccttgggcaagttgcttaacctaagcccaagtttccttatctctaaaataggggccatgctactgcctcgtggcgttattattcagtgcagcagtgcatggaagaggtattgtgtaaatggtatgctcaaatgttagctttagtctgggcaacacggcgaaaccccgtctctacaagaaataaaaaaaatatagcccggtgcggtggcatgtgcctgtaatcccagctactcaggtggctgaggcaggagaatcccttgagccaggaggtagaggttgcagtgagccaagatcgcgccactgcactccatcctgggggacagagcaagatgctgtttcacgctatttcattaaaaaaaaaaaagttagctttaattattagatgatttgttacctatcagaaaaatacatagatgcctttagacacaattttacattcttacattcttatgtgtgccttctttttttttttcaagatggagtctcactctgtcgcccaggctggagtgcagtggcgcaatctgggctcactgcaacttccgccatctgggttcaagtgattctcctgcctcagcctcctgagtagctgggactacaggcacgcaaccacgcctggctacttttttgtatttttagtatagacagggtttcaccatattggccaggccggtctcgatctcctcaggtgatccacccgcctcagcctcccaaagtgctgggattacaggcgtgagccaccgcacccagctttccgccccgcccccccgccgagatagagtcttgctctgttacccaggctggagtgcagtggcgtgatctcagctcactgcaacctccacctcctgggttcaagcgattctcctggctcactcagcctcctgagtagctgggactacaggcgcataccaccacaccctgctaattttgtattattggtagagatggggtttcactatgttggccaggctgatctcgaactcctgatctcaggtgacccgtctgcctcagcctttcaaagtgctggggttacaggcatgagccactgtgcctggcctataaggccatgtacattcttatttcagggagtttcacaaaattcctgaagctctaccctagactccacattaggaaacaaacaaacaaacaaaaagcctttatacatgctgttaactatgagctattaaaccatatttctagcaggggaagctacctcagccctagatttgagacttggttctgccacatacctgttatatgaacttagacaagcaacttaacccatgtgagtcttagcttcctgtactgtaaaattgggattagacttgttatgaaggttaaatgcactgatgcatgtaagcctgggcacagtgcctggcacatagtaagaactcagaaaatcctggctattgatgatgaatggcatctaggctttaaaacagtaggggtggggtgatgattgcttcatctgggtaactacattccacccaggccctgaggtcaaactacagtccaaggtcccaaagggctggggagcagagggtagaaatagaggcttgagcaggggtggagtaaacttggctgcttctgctgaccagcccatgcaggctctggaggtcctcctgctgctacggattgtctctgagagactgaaggaccactcgaaggcagctggctcctcctgccacatcacccagctcctcctgaccctcggctgtcccagctatgcccaggtgagtgcccaaccagcctagtctggggactgcagggggcccgtagctttagaggcccacctctgagaagacaggatatcaaaggggcagcttctcggccttttaccaccacaactggctggagaattgtggagtgtggagcagttggaggcagctgtaagaaggggagtcatctttgtccttcctgcaaaaccagttgttcattaagtttacagactgctgcaggaacctaccgccagtcttgtatttcctaactggttctgttgccctagttgatgcttcattgctcatgtaaagctatcacagtgtctcctggttggtctccttgcctccagtttctcccttttctacttcgtcttcttaacgaccactggtaggcacaggtgtgatgtaatctctttcctgcttaaccctgttcccttttgccccaataatacttgccagcgcttacggctgcagtgtttacccctggataactttgccacaaaatatctcactcttactatttttgcatcactctagtatattgactttggaaacagaagacatcattctgtttatagcattctgtttttagtggtgtcatttccatttccatttccatttccacttccacgtcaccctcccgagtaactgggactacaggtacatgccaccacacctggctaatttttaaatgttttgtagagacagagtctcactatgttgcccaggctggtcttgaactcctgggctcaagtgatctcccacctcagcctcccaaagtactgataatacaggcatgagccaccgtgcccagctactgcttactctgtatatagctttaatctaaaagtggttaaccaggctgagcgcagtggctcacacgtgtaatcccagcattttgggaggctgaggtgggcagatcacctgaggtcaggagttggagaccagcctgaccaacatggagaaaccccgtctctactaaaaatacaaaattagccaggtatggtggcgcatgcccgtaatcccagctacctgggaggctgagacaggagagcacttgatcccgggaggcggaggttgcggtgagctgagatcacaccattgcactccagcctgggcaacaagagcgaaactccgtcctaaaaaaaaaaaagtggttaaccaagtgttaaatggacattttagagagtgaatcaataactcctatgcagattataatatctgaaataatgtaatatttattggacatgttgaacattttgcttgtaaatactttactccactttttttttttttttttttttgagacggagtctcactctgttgcccaggctggagtgcagtggcgcgatctccattcactgcaacctctgcctctcgggttcaagtgattctcatgcctcagcctcccgagtagctgggattacaggcgcgtgccaccacacctggctaatttttgtatttttagtagagatgggggtgtcaccatgttggccaggctggtcttgaactcctgacctcaggtgatccgcccaccttggcctcccaaagtgctgggattacaggtgtgagccacatggccacccttatttactccagttttgtttgaagagcctggctgcctttcctcatgtgccctctgattgcttccttagttacacctggaagaggcagcatcgagcctgaagcatctcgatcagactactgacacatacctgctcctttccctgacctgtgatctgcttcgaagtcaactctactggactcaccagaaggtatttctcactttcttaaactccgaaggccctgggtattagaaagaatttaggattttcttgatatttgcctggcttttgagatttccctggagctaggcagtatgttcctgaccctgagaggcaggcatatttcctagccttgccctcgccagcgatttgctcaccagtcctcctctggtagagatacagtccttttccttcttcaggggcaagggggaaagtctgtcctgtgacgaaaagctgggacaatggtgatcctgggaaggcatgggagctctggactagaaatccaggggatggcaaagacttgagttttctcccaaactagttgtgtgacttgggcacgtcttctaccttctcatgctctagtttcttctctacgtttttatcattcctaaattggcggacaagtcactggtgagggcaaagctaggaactgttactgcttctcagggtcaggaacattctgcctaggtccagggagatctcgaaagccaggcaaatattcagaaaattctaaaatctttctaatacccagggccttcagggatggggccacgtaatctccagggcctctcaagctctggagtgcctgactgccttactgcctcctctggctccttctctccttcaggtgaccaagggtgtctctctgctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggtgaaagaatagggtggatggccccccttggatgacatgtatggtctgtctgctgtcagctcttctcaaacctcatcccctctgctggctaactatgtggcccagcctacctagaacctgcacagagtaggcctgggatagcagatgggtttcagtttgcctgctgactctaaacaattggtgactgcctggaatactaggctgaaaggatttttttttcttttcttttttttctaagacggagtttcgctgttgtcacccaggctggagtgcaatggtgcaatctcagctcactgcaacctctgcctcctgggttcaaacgattctcctgcctcaacctcctgagtagctgggattactggcatgcgccactacgcccgactaatttttgtattattagtagaggtggggtttcaccatgttggccaggctggtctcaaactcctgacctcgggtgatccgtctgcctcagcctcccaaaatgctgggattacaggcttgggccactgcgcccagccagctgaaaggattctgagaccccaggggatctcagagggaaggagttatgagattgattagctctgcctgccttaatgcagaaggaagcatgggaagcaggctttgctgccttagtagctaaaagtggtgaagttctggctgcatcttctccctttttcaccccacccaccacaggctggcagacacctgagatagctctcatagactcccataagctcctccgaagcatcatcctcctgctgatgggcagtgacattctctcaactcagaaagcagctgtggagacatcgtttttggactatggtgagtctggggaggacagcagggccctcttggaatggacaggctatgtgagagggctgcggttttttctccagaggatccacactgtggctgagtgatggtggtcttgtctcttttgctacaggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtaagtacagggccagaggatatggcaatgatggcaccaaagtgccatgcacccttgaacatggattccaaactgttccacagattacatgctatgtttagatacattcgtggaaaaaggcattccacagctaaataagtgggaaatgctgagttaatcaaggttagatgtttttatttcctgtaggactctcgtgtccttcagtatgcggatgtgccttgcaaatctccaaaagggagatctagtgtacagtgtttccctaagaatgttttcccacaggattcttttattgaggaatgcagtttgggaaatcctgtcccaaggcacaaggagagttgggattagagagaagtgtagagggttttccccagggagcctttaagtcagcttaagggagtgaatgccttttggaggcagggaaggactcaggtagcttggcctgggaaagaggcaaagagaaagactctccaggaaaacaaaggattcctctgattggttctcctctcctctctcaacaaggtgtgccctgttcctggtgctgaagggcgagctggagctggcccgcaatgacattgatctctgtcagtcggacctgcagcaggttctgttcttgcttgagtcttgcacaggtgagcagccatgtccccatgaccataggcggtgctgaaatgacacacactacagcacatctttctatgtaaaggtttcgttgcctttttttatttttgagacagagtctcactttattacccaggctggagtgcagtggcgtgatcttggctcactgcaacccctgcctcctgcctcctaggttcaggtgattctcctgcttcagcctcccaagtagctgggactacaggcatgcgccaccacacccggataattttttttatttgtagtagagatgaggtttcactatgttggccaggctggtctcgaactcctgacctcaggtgatccacccgcctcggcctcctaaagtgctgggattacaggcatgagccaccgctcccggcctttgttccctttttaatcagatactgacttctggtcccagggcaacattcccttgactttagtccaaccattggtctccctctttcagagagcctgtcccagacttaccctagttctagttttcagtgcttcctaatacattttggctatttaaatttgatttagataatatttagggccgggctcggtggctcatgcctgtaatcctagcactttgggaggctgaggcaggcggatcatggggtcaggagttcaagaccagcctggccaacaaagtgaaaccccatctctactaataatacaaaaattagccaggcatggtggcgggcacctgtaatcccagctactcagaaggctgaggcaggagaatagcttgaacctgggaggcggaggttgcagtgaggaagattgcaccattgcactccagcccgggtgacagtgcgagactctgactcaaaaaaaaaaaaaaaaagaagaaagaaagaaagaaagataatatttagaattcagtcctcagtcacactagccacacttcatgtgctcaatagccacatggctagtggctaccgtattgagtagcacaaacatatcctcaggagggctgaagctaataataaaacattgcattgatggcacattttgtctccccaatcacatatacttctagtacttcatttgccccacactagacctcataaagctgagtgggagcatagattattttcatttgttaaatgagaaagttgagaagtctatgtttggggccagcatcacagggtaggaggcaggattcaggtgtgggcctgctggggccagcctgcttttctcagccatgtggcccctgagctgcaggtgtgggggctttgtggcctgcatttgatccattgttggttggaaagaaaacaaaaattttacctccaaggcgggcggatcacaaggtcaggagatcgagaccattctggctaacacggtgaaaccccgtctccactaaaaaatacaaaaaattagccgggcgtggtggtgggcgcctgtagtcccagctactcgggaggctgaggcaggagaatggcatgaacccgggaggcggagcttgcagtgagctgagattgtgccactgcactccagcctgggcgacagagagagactccatctcaaaaaaaaaagaaaaaaagaaaaagattttacctaaaaaataataagccatactaatatttgatatgttatacagtaatacatatatatacacacatatatatacacgtacgtatataaaacacatatattagagaattgggccccaaggtcgctcaggaagtgcttgatgccatttctccccgttttgtaattcttgttctgccttctccccagagtttggtggggtgactcagcacctggactctgtgaagaaggtccacctgcagaaggggaagcagcaggcccaggtcccctgtcctccacagctcccagaggaggagctcttcctaagaggccctgctctagagctggtggccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatcttggctcaagcatacacactgttggcactggagggcctgaaccagccatcaaacgagagcctgcagaaggttctacagtcagggctgaagtttgtagcagcacggataccccacctagagccctggcgagccagcctgctcttgatttgggccctcacaaaactaggtggcctcagctgctgtactacccaactttttgcaagctcctggggctggcagccaccattaataaaaagtgtccctggctcagagccctctaagactcagggccaaaaacgttctggacgagggcgccaaaagttagcctctgctcccctgcgcctcaataatacctctcagaaaggtctggaaggtagaggactgccctgcacacctaaacccccagaccggatcaggcaagctggccctcatgtccccttcacggtgtttgaggaagtctgccctacagagagcaagcctgaagtaccccaggcccccagggtacaacagagagtccagacgcgcctcaaggtgaggtgggactgttgctaggtggtggtgatggtgttggatggggttagtcctggaggagagtgttttatagagcaggtgtccctgtggaatagctccccagggcctagtggaactttaatctcctgctatctgcagtaccccaatatcttgcttttttgttttttgttgtttttttgagaaggagtctcgctctgtcgcccaggctggagtgcagtggcgcaatctcagctcactgcaagctccgcctcttgggttcacgccattctcctgcctcagcttcccgagtagctgggactacaagcgcctgccaccatgcccagctaattttttgtattttcagtagagacggggtttcactgtgttaaccaggatggtcttgatctcctgacttcgtgatccacccgcctcggcctcccaaagtgctggggattaccggcgtgagccaccatgctcagcctctttttttttttgagacggactctcactctgtcgcccaggctggagtacaatggtgcgatctcggcttactgcaacctccacctcccgggttcaagcaattttgcctcagcctcccgagtagctgggattacaggcgggtgccaccacacccagcttatttatgtatttttagtaaagacggggttttaccatgatggccaggctggtctcaaactcctgacctcaggtgatccgcctgcctcagcctcccaaagtgctgggattacagacgtgagccactgtgccaggccaacatctttcacagcaagacctatttccaagtctccctttgtttcagacagagacattttccttaactctaatgtttcttttaccttttcatcccaccttctgttccctcattttctccctccttccacacccaagagtcgctgcccctgatctagagtgttggctgtcatgtgagaagttagttctgaaatcttccagggtcctgtgtgatggtgcctgatggtgcctccactacgccacctgctgtcacaaggtgtcttgtcactgaagacctcttagcccttcaccctttcactctgatctcaggtgaacttcagtgatgacagtgacttggaagaccctgtctcagctgaggcctggctggcagaggagcctaagagacggggcactgcttcccggggccgggggcgagcaaggaagggcctgagcctaaagacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggagaaaaatgagctttgagatcctcaggggctctgacggggaagactcagcctcaggtaggacagcaagggtgaggtggaaggtgcatgttttgggggtttgttctggggcaaagcacaagcagtaagtgctgccaaggaagtacaggaagaatgttcttttgctgactctaagggagtggattacagaaggaagaacaaagagaatggcagggggagggagcactgtgaaaaaggcctgctctctccccaggtgggaagactccagctccgggccctgaggcagcttctggagaatgggagctgctgaggctggattccagcaagaagaagctgcccagcccatgcccagacaaggagagtgacaaggaccttggtcctcggctccggctcccctcagcccccgtagccactggtgaatatgcgacccctgatgttggtcacttggagagggctgagcctctagggcttttgacccctctgtctttccaggctgggttcggatctggatccagtagcctctgaacctgtgtttgaaccccagcactctgtctatgagctgtgtgcaggtcacttaacctctccaagcttctattccttctgtaaaaatggggtttagggagcatggtggaataagttgatgcctgttagttgcatggcaccccacttggcacattgcccttcataaatggtagttgctgtttgccatgtgggagatgagatagggactgttccttcttggaaagttcctatcaactatgaaataaggaattcagctgtaccaagtgtcctgacgttcttctaggtctttctaccctggactccatctgtgactccctgagtgttgctttccggggcattagtcactgtcctcctagtgggctctatgcccacctctgccgcttcctggccttgtgcctgggccaccgggatccttatgccactgctttccttgtcaccgagtctgtctccatcacctgtcgccaccagctgctcacccacctccacagacagctcaggtgggtgctgaccatccccaagactcctgctggggcagactagagagaaggtccagactttgaaggaatgggacctcacccctccccgtgttgcttgcagcaaggcccagaagcaccgaggatcacttgaaatagcagaccagctgcaggggctgagccttcaggagatgcctggagatgtccccctggcccgcatccagcgcctcttttccttcagggctttggaatctggccacttcccccagcctgaaaaggagagtttccaggagcgcctggctctgatccccagtggtatgcgggcagccttctggccggctcctctgtcctcttctgcatcttcttacttgggagctgggtgaaggagttttaggcattggttagtttacatagatttatgacccttatgtcataccttttcacctgttagcatcttacatcaggaaggtttgttgttttttttaaacctcaactttgaattaccagcaaattcagtgtctttcctcagaggtgagttcagatgactggggtcttctgtgctaacatgaaacatattcacatgatttgagtgcctcactttgttagttgctgtgagggacacaaagtacaagtcatggtctctgtgcacagggagctattagagcaagggagagcaccttgacctctagtgaccagggaaggcttcttgatgctggcttgagtgatggataggaattgagtgcccaagacagggaagggaattcctttaacagctgaatgagtctggctgtatcctgtgtgtcaggggtgactgtgtgtgtgttggccctggccaccctccagcccggaaccgtgggcaacaccctcctgctgacccggctggaaaaggacagtcccccagtcagtgtgcagattcccactggccagaacaaggtaggattcctgggccatggagcaaagttgggctggattgggcttcgggtcaagctgctcacattctgtgttgagggagggagagatggtgatcacgtggacaagcagagctctcacagccccatctcccaaagcttcatctgcgttcagtcctgaatgagtttgatgccatccagaaggcacagaaagagaacagcagctgtactgacaagcgagaatggtggacagggcggctggcactggaccacaggatggaggtgtgtgcttctggggtggggtcaggcctgctctaggaatgacccggggggtcccagtgacttctctaccagacggcctgggtcagtgctaaagccacttcaaatcccttctggaagtgtagacctaaatttaaaaatatgtcacctggggagaacttcagagcccagaacttgaagaatatatgggaatggatatttaaagatacgcagaaaaaaaacgacttaaacccaactatcagcttcccagcagaaagatacgtaagacagacatgcacattggaaaacgcattttctcatctccaaaatgtcagtgcctgtgagaaagaagcttggtttcctctctgactgaagggtctgccctctgcattcaggttctcatcgcttccctagagaagtctgtgctgggctgctggaaggggctgctgctgccgtccagtgaggagcccggccctgcccaggaggcctcccgcctacaggagctgctacaggactgtggctggaaatatcctgaccgcactctgctgaaagtgagtgaggaaagcagggaagggggccaggcccagtggcttgcacctgtaatcccagcactttgggaggccaaggcagatggattgcttgagctcaggagctcgagaccagcctggccaacatggtgaaaccctgtctctacgaaaatacaaaaattagctgggcatggtggcaggcacctgtaattccagcttctcgggaggctgtagcaggagaattgcttgaacctgggaggcggaggttgcagtgagctgagatcgccgcactccagcctgggtgacagagtgagactccatctcaaaaaaaaaaaaaaggataggccccttggcttacgcctataatcccagcactttgggaggccgaggcaggtgggtcacaaggtcaagaggtgaagaccatcctggccaacagggtgaaaccccatctctactaaaaatacaaaaattagctgggcttggtggcacatgcctgtagtccgagctactcaggaggctgaggcaggagaatcgcttgaacctgggaggtggaggttgcagtgagctgagattgcgccactgcactccagcctgggcgacagagcaagactctgtcaaaaaaaaaagaaaacagggaaagggaagaaactggacttaatcctttcccagcagctatcatgaatgaagatggtgctcaccaccactgtttccctgcagatcatgctcagtggtgccggtgccctcacccctcaggacattcaggccctggcctacgggctgtgcccaacccagccagagcgagcccaggagctcctgaatgaggcagtaggacgtctacagggcctgacagtaccaagcaatagccaccttgtcttggtcctagacaaggtaaggagctggggcagaggggcagtgtctagtggggagtgaataccaactcatccccatgccccttctgacttctgcatatacctggctggggacagtaacctcttagtgctttttgcccaggacttgcagaagctgccgtgggaaagcatgcccagcctccaagcactgcctgtcacccggctgccctccttccgcttcctactcagctactccatcatcaaagaggtggggttcagggcgtagtgtctggggatgactggcgactggggaagacgtcaacaaagaagggcagagaaacctgagaagataggagagggtcctaggaatggctcagacatggaaaggggctgagattgttagagcttgggcctcttggtgagacaagcatcctaatcgccagtgtctcctcctcagtatggggcctcgccagtgctgagtcaaggggtggatccacgaagtaccttctatgtcctgaaccctcacaataacctgtcaagcacagaggagcaatttcgagccaatttcagcaggtcaggggcgcgaagacaagaagacgtgtggggaagggtagacaacatacaggggcaacaagccttttctccagaaacagctgttgcagcccaccttctatctaatgatccctctgctgtctttgccacctgacccctgccatgcatttccctattctcacacctgccttttccctgcagtgaagctggctggagaggagtggttggggaggtgccaagacctgaacaggtgcaggaagccctgacaaagcatgatttgtatatgtgagtgcttaaggcagggatgtggggagaggggcagtcctgaggatggtatcaccatgggttgctttgggacttgagagcctctgaagacacaggcagaggccaggtattactagctcaagactcatctcacctccttctgccttagctatgcagggcatggggctggtgcccgcttccttgatgggcaggctgtcctgcggctgagctgtcgggcagtggccctgctgtttggctgtagcagtgcggccctggctgtgcgtggaaacctggagggggctggcatcgtgctcaagtacatcatggctggttggtgagtctccaagggcaagacccatcctagggcattaggactcctgccctcaccccaggttctttcccaggtctgaatcttgcctctcttgtgccccattttcctcctatcctagttagttccctggcatgcctggaccattaacccttagctcccttctgttcttctcttgtaaccaagggccaaaggagtttctcattggttcaatcctctccactcacccacccccaccaccaatggtgttttcctatgtattctgttttagagcccttactttgtatttcctccttttcttttcccagccccttgtttctgggtaatctctgggatgtgactgaccgcgacattgaccgctacacggaagctctgctgcaaggctggcttggagcaggcccaggggccccccttctctactatgtaaaccaggcccgccaagctccccgactcaagtatcttattggggctgcacctatagcctatggcttgcctgtctctctgcggtaaccccatggagctgtcttattgatgctagaagcctcataactgttctacctccaaggttagatttaatccttaggataactcttttaaagtgattttccccagtgttttatatgaaacatttccttttgatttaacctcagtataataaagatacatcatttaaaccctgttttgcgtagtttatctgagaacatttaaagacacggcatgactgcccccttcctactatgtggtactgtaagctgacaggaacaggttacagcagatcaagtttgagtgcttggggaagaaaggcaaagacacaggacaaagcctgctgggcctggctgggcctcagcagacaaatctggaggagaaaggggcatcaaaatgctaagtagagacaggcccaaggaagggtagtgatagaccctttgagagtgttttggccaggtaccatccgtccgtcctgtcttcctgccgcaggtatctttggagtggcactagtgttttgttttttgtttttgtttttttttgagacagagtcttgctctgttgcccatgctggagtgcagtggcgcaatctcggctcactgcaacctctgcctgctgggttcaagcgattctcctgcctcagcctcctgagtagctggaactacaggcacatgccgccacgtcccactaatttttgcatttttagtagagacagggtttcaccatattggccaggctggtctcgaactcctgaccttgtgatccaccctcctcagcctcccaaagtgctgggattacaggcgtgagccaccgcgcccagccatggcactagttttaatgcctcagttgccctgcctgcctcctaagtagatgttaaaggctactgctgtctgcccatgtacacctgttacacttaccaatgtgtaactttagcagtagagtctgtggatctgtggagttctagtgtggtttttctctccaattgttaagctcaagggaagcaagtatcttacactctcacgtatccctcacatacagcacatggtaaaacctttttttttttgagacagagtctagctctgttgctagtgtgcacaatcacagcctactgcagcctcaactctccagctcaagcgatcctcccacctcagcctcccatgtagctgggactacaggcgtgtgccaccagcccggctaatttttgtattttttgtggagacggggtgtcgccgtgttgcccaagctggtctcaaactcctgggctcaagcaatctgtccttctcggcctcccaaagtgctgggattgcaggcgtgagccaccatgcccggccaaaatattttattgattaatttgtgctgtacttggttgacaatggcgcttccttgctgttctcccaccacctcactggcaacgggtgataaaccctttttcagatcctactacgtgtcagcctacttccggctgggggaagatggttatagcgagaggggaagaattggttcagtgatgagaacatggttggttcctgccttcgacaagctttcaatctaatgcctgtttttttccaaggacaattcagaacggtctgacaagggatttttttttttttcctgcctttcggcctcagaggccatctgggaaaaagagtttagaatttccctgccatttccatgccgtgctgggaggaacatttgaaatcgggcctggcggggtaccagcaggcagcaatagcaagcggggtggagaggagcagggccaggcccccgagccgtcgccatggcaatccagcctgctttccagtagcttataccacccacgtggagtagcatacactactttgtaatatcgtggttgtgtcgtgagaactttaagattttgcagttccttgtaggcaggagtcctgtttgctgctactttacaatactaggcttaagacattttatgaaatgaactcacacaacagtctctgagaggctcaagcccctccttcccttccgggacggaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagaaccagctggaccaggtggggacgggccccagaggcacctctttcctgctctacatcccccttgcccacgcgtacttctcgcgcccggttccaagttggcagcctacctttcccaggcgaaacctctatccgatcccaggacctgccccctccccggccgcgctcctttctccccttagtcctctcattgacccgctatcccggtcctctgtaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtttttcttacctgaaacgagaaaatccattacatatcgtataccgcttcatgaaccctttgcatgttgcctgcctagaattgaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacagggaaagaattactcgtcccactgacgagttctgtatcctttccacaggaacggctacctgctgccttctccctttctccttcactcccccaaaaagcggggagggggattgttttgattacttcagattaccctctcctcacaatgattttgaggataccctttttttttttctttcttttttgagacggaatttcgctctgtcgcccaggctggagcgcaatggtgagatcttggcttactgcaacctccgcctcccgagttcaagagattcttctgcctcagtctcccgagtagctgggactttaggtacgcgccaccacgaccggctaatttttgtattaatagtagagttgggggtttcaccatattggccaggctagtctcgaactcctgacctcgtgatccgcctgcctcggcctcccaaagtgctaggattacattacaggcgtgagccactgcccccggccaagaatactcttattacacactttgtagctcttttatctgacttcacaccaacatccagctaatgtcttgtgaacaccaaggagtatgtatagttgagatgtaatatttccctttgctgtttgagaacattaatatggagataaagctggtggtttacactttgctaatatcttagaagatacaggcaatagacaaaaataggaggatatagaaacagggagcttggctctgttaatcttcaacttcagcttaattgtggctcatttctaaactgtcactaagaaacctggattgtgttcacttgttcagtgttttatttgaatgagcaagttatggcagtagggcatctttaatctgtagtctcagaactgacaggctaaaaggaacacaggaatagtagtgtgtagtagggaatggtttaaaaaaaaaaattagccaggcacagtggttcacgcctgtaatcccagcactttgggaggccaaggctggcagatcacctgaggtcaggagttagagatcggtctggccaacatggtgaaaccctgtctttactaaatatacaaaaattagccaggcgtggtggcacatgcttgtaatcccagctactccggcgactgagacaggagaattgctttaacccgagaggcagaggttgcagtgagccgatagcgggcaattgcactccaacctgggcgatagagcgagactctgtctcagaaagcaaaaaacaaacaaaacattgactttgtcaggaattagctacttcatgattgagggcattaagggaaatgaggctggctttttacttgtagtactctacaacagtaggaaaacatgtctagtctttctggaggggctaatgggaagaattgcaagaactgcttagagagtgagagatgggatgaggcaggacaagagggtgttccagcatacatcattttctccttaaagaaccaacttctctgtcttctttccatttggagttataggtattgttctaaggcctccagattattcagtccttatgccttgtagctttttggaaaaagagggtctttggaggccaagcaggctggctggcggaatcatggctcatgctgggctggctagtttttcccttaattcttgcttctcagatgtatgtccctgggaagctgcatgatgtggaacacgtgctcatcgatgtgggaactgggtactatgtagagaaggtgagtgagagcatgtggatgcccctctaaacagggaagggaaattcaggggaagctctagagcgcagcatggccagagggagtctccttttagccccttattcacctctgatcttgtagacagctgaggatgccaaggacttcttcaagaggaagatagattttctaaccaagcagatggagaaaatccaaccagctcttcaggagaagcacgccatgaaacagggtaagtttttcctggggcacctcttgaccctatctccataataaggaacatggattgcagtgtgaaccacgggggtgtcccctttgctggagtaaaactatgtcttagtttctctttggcatctttagaatctgtgtattgcataatcactatctgtagattcctgggttgagcgtttgagaaatttagaggaaggaaatcatgtttgtgctttggtggagctcctatttaatgacgatggaatgggggaatgagatgaacacacaggaaggaatcatgatccaaacgaactaaataccagcaattataaccccgactgcacatgagaatcactcaggaagtttaaaaagaaagcttgggcccattccagattgactaaatcaacttggaagtcaaaggaggggaagttgtaccaaggtctgtttttttttaaaaaagctcccctctgttataatcaggattcagaaccagtgttccaaaggtaaaaatctttccccatcatagttttctgattatgtcagactcatttaataccatattgtgttcgtttttatatctttggttagcaggttttttttttttccgagaagagtctcattctcaccacacccagctgtgttagcatattgaccgatgcattgtagaccctaaatttgtgttagtgaccccacagtggatcactgagttaaagttttattaacaatgccaggcgcagtggctgacgcctgtaatcccagcactttgggaggccaaggcaggtggatcacctgaggttaggagttcaagaccagcctggccaccatggtgaaaccccatctctactaaaaatacaaagttagcccgggcatggtggtgcatgcctgtaatcccagctgttcgggaggatgaggcaggagaatcgcttgaacccgggagacggaggttgctgtgagccaagatcgtgccactgcactccagcctcggtgacaagagcaggattctgtctcaaaaaaaaaaaaaaaaggttattaacaaactgtagttagtcggtcgcctgtccttaaacttgcctgtcacttctccttaactctaggttctcctttttgcttctaacctttgactcttatttttttccacagccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaatgttggtcttttcttggattaagcaagggactggtgatgagatggggggtgtggtcgagagtgtgggccccgtctcagagcctgatgcgcaggggtgatgcgatgcgcctcttggaggctccatcgcagggccctttgaccagctggaagaaatcctaggctgggagtctgctgctgctcactctgcagagctggttgccaagggaacggttggcaagcggaagtggggctgcgctggcgcttcctcttccgggtcggcgctcctgcctccctgcagggagctgcttatgggacaccaattcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggtacggtccgcgaaaagtgaccctgggactgcgtgcatgcatgcctccggggtggatggcattccgccaacagggtcactccgatagcgcccggcagcccaagcacccttcctacccttcctgcctccctgaagtccagcattaatcccctacccggcgacacccggcagccccttcacccctgtgtacctcgcaggatgcagagattgtgcggacccgggatcccgaaaaactcgcttcctgtgacatcgtggtggacgtggggggcgagtacgaccctcggagacaccgatatgaccatcaccagaggtaggttctcagataccatttatttaacttccttgacctcagctttcctctgtgctccaattcagccatccactgccgtagtccgcgtcagcgaaaagaactgcttcatcactgaaatcaaactcccactaggactacatcatccttccggccctgcctgttcttcacccatctccctggcctgggacctcctttggttcccagggagtccctcaggccccttatctcatctccttccttagccaaggctttttttccatcagcaacttcatcaccccaactaaataaacccatctgtgattaatccattctggtgcccttgctgctgcacctaactgctgggcccacatgattgtggcagttggtgacagttcagatgtgtgaagttttctacttcatttacacccttccaaagggaaatccttcttgctcaagggtagcccattccaatccttttcttctccctcaagcctctaccgcatcaaactgagtgtccctgcctcttttcaaaagaagttgagcatttcctcagtctcccacctcaaacatcctcagctccctcctaccaactaagggaaatttcttcccttctattggaggttaatcctctgtcctgtttccagtctattactttcttctctgggattcttttttcttttctttttttttttttttgagacggagtctcccactgtcgcccaagctggagtgtagtggcacgatctcggctcactgcaacctctgtctcccaggttcaagcgattctcctgtctcagcctcccgagtagctgggactacaggcacccaccaccacacccggctaatttttgtatttttagtagagacgggtttcaccatattggccagagtggtctcgaactcctggccttgtgatctgccccgccttggcctcccaaagtgctgggattacaggtgtgagccactgttggcctatcctctgggatttcatgtcacagttccactagtgtctctgcctctccttccctacagcctaaaacccttctcaagtatcttccatcttgaaaagaaacacaggtgtaaaaacaaaaccctccctcaattataccacaccacgagaagtaattatcttggagagagggattatgatgttttaagtctctctccttttttctttttttagcatacatattataaatgatgtcaggaagaaaccctcccaatatttacagcctaagctctcacccttgcttctcagccacccttcaaaaaacagctgaccgtggcttcacctgttcctttccagttcattcccctcaagcccactctcccagtgtcttctctggaactgctcggcagaagggcaccagttacctcagcaccaaaccagggagctggtaaagggtctcaactgatctctttagcacttggcattattgaccacttccttttatcaaattgtttttaagatggagtctcgtctgtcacccaggctggagtgcagtgatgtgatctcgactcactgcaacctccgtctgctgggttcaagtgattctcctgcctcagcctcccaagtagctgagactacaggcgcccagctaatttttgtatttttaggagagacagtgtttcactatgttggccagtctggtcttgaactcctaacctcaggtgatccacccgcctcagtctcccaaagtgctaggattgcaggtgtgagccaccatgcccagcctcattttttttatttttactttttttgagatggagtttcgctattgttgcccaggctggagtgcagtggcactcagctcacttcaacctccacctcccagattcaagtaattctcctgcctcagcttcccaagaagctgggactacaggcgtgtgccaccatgtccggctaatttttccattcttagtagaaacagagtttcagcatgttggccaggctggtctcaaactactgacctcaagtgatcacgccttggcctcccaaagtgttgggattagaggtgtgagccactgagcccagcctgtatttactcaatatttaataataaaagtcagttaacaaatggagctccctaggtaattctgagatggactggtatttagaaatcatggctgtagtttctgcttccctaacatctgttatatcttttctctattttctgccccactgctgttcaaattcttgccttctttattcacctgaaccattgcaggtaatctccttgcatctgttctccatgctggctggtgcaatgctgtaacatgcacctgcctgcttaaaatcccccaatgacttcgattacccacagataaagtccgatggtctggccctgcctgcccttccagctttttcttttgccattcacttctcacacctgagctgcctttgctgaagttccatcaagacacttgtctctcagccatcattcatgttgttctctctgcttggaatgctttttctctttcaccccttgtctatctggtggacacccactaattcatctttcagaactgacctgaaggctctcctctgaaccctttcctcatcccttccttcctttcccttgtctcgtctagtgagagtactcagggggttgtgtttgtcggcctccggcagatgaatctgaaagcaaggacagtgtcttggttttttatccttaatgtctaataaaacataaaatgtggcagataggaagcattgagttaaccattgaatgaatgcatggagactctagccaaggtccctcacctcagccccacctccctatgctcctcaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaaggtggggacctgaggacagagatgccccccacatgcatttccagcaggccgcctgggagcagtgctcacacagcactcagcactgggcctcgggtcagggttcctggcctatagcaggcccaacactcatcctctccctcagtcaggctcatctcacaagggaatggtgatacctcccctgtctacatcctggggtggttgtgagaagtggatgctgtaatatatggggaagggctttgaaaaccataaagcagcatggccccgtctttttattgacacacacaaacagcaattgctcagcacctttgggtaaacagaggggaggctgcttatgtgtggaagcagatggctcagaggttctggctgccctgaaggttgaggggagtgtatgttaggcaccactgtagttcactagtggcacataaattgggaagctcagctgagaagagttttattatgaaactgtctttggattccaccagtgtcccctgcaagcagcttcctgctcttagggaaagaatatggctagtggccctggcatgcaagtcaggtcgcacagtactgaggacacttacttgtttacaagtcaaagcccaggttcagtcagctgtatttcttgcaggtaggctgttgaattcagttctcagtttttttgttgttttttgttttgagatggagtcttgctctgtcgcccaggctggagtgcagtggcgcaatcttggctcactgcaagctccgcctcccgggttcacgccattctcctgcctcagcctcccgagtagctgggactacaggcgcccatcaccatgcccggctaattttttgtatttttagtagaggtggggtttcaccgtgttagccaggatggtcttgatctcctgacctcgtgatctgcccacctcagcctcccaaagtgctgggattacaggtctgagccactgcacccggcccatcagttctcagttttagcttgcccattttctgccctctgtaactatagagtttttggaatatcaagattttagactgcctgggtcagttttcccttccactgctgaagggtttctaaacaactgactaaatttttgttgttgtttttttttgtttttttgagacggggtcttgctctgtcatccaggctggagtgcagtggcacaatctcagctcactgctacctccgcctcctgggttcaagcgattctcctgcctcagcctcccaagtaggtgagattacaggcgcctgccaccacgcctggctaattttttatttttagtagaaacggggtttcaccgtgttagccaggctggtctcaaactcctgacctcaagtaacgcacccaccttggcctcccaaagtgctgggattacaggcgtgagccactaatcccagcaacaattgactaaatttaacccgtatttttttttgagagactgttgcccaggttggagtccagtggtgccatcatggcttgctgctgctttgaactcctgggctcaagcagtcttcccacctcagccccccaagtagctgagactacaggtgcatgccaccatgcctggctaattatatatcttaatttttttgtagagagggtcttgctatgctgcccaggctggactcaaaaactcctgggctcaagtgatcctcccacctcagcctaaacccatgtttttttttttttttttttttttttgagacggagtctcgctctgtcgcccaggctggagtgcagtggcgggatctcggctcactgcaagctgcgcctcccaggttcacgccattgtcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaaacccatgttttaactgagcatcaggttgggatccaaaccaagaagagctgggcataggagttactttctcagtgctctgagagtagcacttttctacataccacaggtgtactgttatggaggcctattttgtagggtaattttgcataaagtttctgccccgagactcttgaggcattatcctaccatttattcagacccaggagacaactgctgatgtcatgaggcacattatgggcttccctggaaccctaacccagcaaccagcttttggtgtctagtctcacactcattttctcccacttgacttgtgttctcaaccagagccgctcctgcacctcattaaccgtgtcactgaatacctactcaccccacctggagatttaccagccttcagccacagggacccactcccacagagagcctctagcacctagagaccttccttgttcaaaagttagcagtcccctccctacacgtgttggctttggtttgggctttgtgcagcagaatgagcatggattagaaatcaggtgatctgaattccagtcacagcacaacgagctgtctgagcttcagcgagctgctgaacttgccaattctcccttttctcatccagttaatgttgagagatcctcacagggctgaaagagtgtgtatgaacatactttgaatcatgtaagatttcacataagtagcaggtagcctcaagaaggtttcccctgctgctgccttagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggtaaggtggcctgggaggagacccggagacctgtaagaaccttgggtggggggaaaatgggagcatttgctcctcctaagccctagcaaattccaagtttgggccagcatcatggttctaattctcatcattcccaggcagggttcaagcgtgcaatggatctggttcaagaggagtttctgcagagattagatttctaccaacacagctggctgccagcccgggccttggtggaagaggcccttgcccagcgattccaggtataggccttggaggaggcattatggcttgaggattactgactgccaatcaacaggaactcctgcttcttctaccctaaaccctggagtgcagtggcagacaacctcaacctcttaggctcaagcagtcctcccacctcagcctcctgagtagctgggactacaggcacacaccacctcacccagctaatttttgtattttttgtagagacagggtcttactttgttgcctaggctagtctcaaattcctgggctcaactgatcctcccacctcagcctcccaaaatgttgtgactacaaacatgatcaccatgcccagcctaccttaaaccttctagctatgctctccctctttcaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggtgaggccctagggaaccactctgcagaccttcaggcttgtctcagccttgttaagagaaggctgccaactctgacccctgctgtactccctctttctgcccaggctgcccctgccagagccatggcggggtcttcgggacgaggccctggaccaggtcagtgggatccctggctgcatcttcgtccatgcaagcggcttcactggcggtcaccacacccgagagggtgccttgagcatggcccgtgccaccttggcccagcgctcatacctcccacaaatctcctagtctaataaaaccttccatctcatactgacccagtccttgacttattcttgccctacaccattccagaaacttgtgaaaagtgaaacaactatttatgtgtaagaccctgtgctagatatattttcttcacagtaacttctcagccttgcttcccaaatcatttgaaaccatagtttctaggattaaataacgtgaccaaattcacaagtggctaaaaagtgacagaacagggccttaacccaaagtccatgcttttttcccctactgtaccccactgcaactccctggaaaagacagactggtaactgagtggaaaacaaaaggaaaacttatttattcttagaggtgggaatgtggggagtggggcagaacaggtggtggccctgggagagggtcccaaggggcagaggttggggatgtctcagtaaagaggggcaggtcatgaatagagcctccacccccagcagggggttcctgggcccgcccaagcactgggctaaaacgtggaaactgggcattgacaaagtacagcgggatgtgggcaattcggcctgtggaccagccctgcagagaagggaaagaaaaggatcagagtctgggcccaaagaagggccacctggcagagccatacagcagccaaggccctcagcttctccatccaactcctggaagccccagcagcctggcgcactcaccacactgagcagggcccctttgttgaaggaaggatggaaagtgatgagctggggctgggctcctggctccccctggataatgccactagaagaaaaggtgagcaggcaaccggaggcaagaagggagctgaatgtagtgggatgtgggtttgtttgtgcaggaaggctggtgagaagtccagacctaagggcccacatggcacttaccagggaaggagctcaaacacagggctgtttcgagtgcgaaaaaggaggatgactggtttaccatcctgtacccttggctttcctgtaagaaatggatccagggataggggaggaactctgaaggcagagtcccaggacatgggcagaggagaactccaggccagggcacggcctcattagattaactgggaagatggctgtgggctgagcccttcatccttgcctctcacctttcataagcacagccagacgttccccactggggtcccagaccatggagtgagcctctcccccaagcctgtgggtaaggacaggttaggagagtttcagtgtggtccctcccacctgcttttcactgccactccctcaaccactcagctcacctctcctcaccatctggtgtctgtattgttgtctcagacagatctgccacaatcgttgctgactttgcacctccaacgcacccctttccctcacctgtggacaaataagagcagagaggttcttgcaagaaacaggcctctcactggtcccctgccagctcaccaaaggcatcaacacctcgaaatctcctaagcttctatatttccctttatccctcagagctgcatcttaccaaaggttgctgcctccctctgaccaccccaaatactgaagtgttgccctaactcaccacaacgttctggaaaagacagggagtaaatcagtggctctcccaatacagtgaacagcagtcggctgccatctgggctccagcagccagtctggggtcagggagcaaaaggcaggagaaggtatgtctatagtagaatgcaggagggaaagtagaggtggccaggtttgggagcatcaggggcccattggaatcatctcctccccagtgtctgtgaatcagagtcccctcttacctgacagcgccctgatagagtaggccacctctcacaagtccacatctgggcctcccagactctgagccagagaaaagcaaattacagctcaggacctctaagttctaaaagttggacctacctcccttgacagagcttccaggagctaagtgcctttctctaggtccttgccctccctccatccttgtcccactcaccgaaagacagctgaaggagtggtagccaggattttgctgccgtctggggaccagagcaggttggtcaccccacctcctcggaaccagggaagggggacacaggtctctgttgagacatcccatacctaggagagtggggcaggagataagggaaaactcaagcaccccatcatctcacagtgggctggcctctctaatgtacaaagagccagaaacgagaggaagcgggagagggactgtgaaacatgaggcacgggttcatgctgacaattacagacagcggaattttaaacctcacgagtctgatggcaaagctcctctctgggtaagtttaagactgaatggaccaaggtccctcctccttcccccaagatgtttccacaaccgagtgaggaacacttttgccaggactgaaatgtgcatgaggggcagggacccactcacccggatagcagcatccacgggtgaagctgagagcagccgccccccactgggggcccaggccaagctggtaacaggtgtatgcccagggtgagacagcacttgggcacagccagaagagggtctggaggggaacacagaggatgtggagtcagaagatgacaagaagccatccccaaaattctatttctttgcctcctgctaaaacctcctatcctgatggcccactctgggctcaaatccaggttgtgaaaaaggaataaggattgtgaaagttaaaagaaaaaaacagcgaaggggaaaaacgaccaagtcaccacgagcaggtcaacagagaagaggtaatctgcaaggtctcaggccagggtgaaagagtgctttcacgagataggccatgaggcaaaacctaaccagtaacctagaaggtactgcccctggggcgatatcaggccctaccccagaacacagctctctgcccacaggccatccagcctggccatccatctatccaggattaataatctatgacattacttcaaggttccaaccttttctctccagttatctaacactcctcagaacacatcctgtgctcccaaacagccctcctgccttgccttatcaaagtacctcccaactctgcagctcccgcgtttgctccttatcataaagatgctgcaggctgggcgcagtggctcacgcctgtaatcccagcactttgggaggccgaggtgggcggatcacgaggtcaagagatcgagaccattctggccaacatggtgaaaccccgtctctactaaaagtacaaaaaaattagctgggcgtggtggtgttcgcctgtagtcccagctacttgggaggctgaggcaggagaattgcttgaacccgggaggcggaggttgcagtgagccgagattgcaccactgcactccagcctggcgacagagcgagactccgtctcaaaaaaaaaaaaaaaaaagatgcagcatgtggctcggcctccatcaccagcagggaactacctgagggcacctgccatgtgtctgcagctgtgtatttccagagccatgtgcctggcctgacagacgaaggctactacctgaattaatgccacctctctttccacctaactataaccaccttcagctccagtgaagtcttagtcatggatgtacaatttaattctcttgaactttatgataaatcacagctgcctttgcaggtgggttcagattcatctcattcttttcagtggctccattgtataccactcaatagatgaactataatttattgagtcatgcctctacaaatggacatttgacttgtttgtaattttttattatacataatgctgtaaaaaatatttcctgggccaggcatggtggttcacactccaggatggagtgcagtgacacagtcatagcacactgcagcctcaaagtcctgaggctcctgcctcagcctctaaagtagctaggactacaggcgtacaccccacgcccagctagtttttttatttttattttttgtatagacagcatctatgttgaccaagctagtctcaaactcctaggctcaagcgatccatctgcctcagcctccgaaagtgctggaattacacgcatgagccatcacgcctggccttgttttttgttcatttatttaaaaaaatttttttaaatcgagttccgctcttgtcacccaggctagagtacaatggcattatctcagctcactgaaacgtccacctcctgggttcaagtgaattctcctgcctcagcctcctgagtagctgggattataggcgcacgccaccacacccagctaatttttgtatttttagtagaaacaaaaaaaaccaacaaccttccaggcgtggtgtacgcacctatagtcccagctacttggcaaggggctcacttgagcccaggtgttcaaggctgtagtgtgcaatgattgagtctgtgaatagccactgtattccagcctgggcaacataatgaaaccccatctctaaaaaaaccaaaaaacaggccagttgcagcggctcatgcctgtaatctcagcacttcgggaggccgaggcaggcggatcacctgaggtcaagagtttgagaccagcctggccaatatggtgaaacccctgtctctactaaaaataaaaaattagccggtgtggtggcacgcacctgtagtcccagctacttgggaggctgaggcaggagaatcgcttgaacccaggaggcagaggttgttgcagtgagctgagatggcgccactgcactccagcctgggcgacagagtgagattccatccccccccaaaaaaaatctgtgatcacgtgtttttttcttatagtacctattgtcaaggtttaggtatcagggttacattagctttataaaaataaatcaggaagatcctgcaacaaaaaaaagggaggacaggccgggcatggtggctcacgcctgtaatcccagcactctgggatgctgaggcgggcggatcacgaagtcaagaggagaatcacttgaacccgggaggcagaggttgcagtgagccgagattgcaccactgcactccatccagcctgggcaacaaaagtggaactccatctcaaaaaaaaaaaatctcattattttcttctacaatccactttggtaacttatattttgctagaaaatcaaacatttccacagggcacggtggctcacttctataatcccagcactttgggaagccaaggcgggcggatcacaaggtcaggagttcaagaccagcctggccaatatggtgaaaccctatctctactaaaaatacaaaaattagctagtgcgtgcctgtagtcccagctacttgggaggctgaggcagaagaatcacttgaacccgggaggctgaggttgcagtgagtcgagatcgtgccactgcactccagcctgggcaacaggagtgaaactccttctcaaaaaaaaaaaagaaatcaaacatttccttcagattttcaaatctgttggcctaaacaagtccacaatattcttttataattcttctattttctcccgtatctatatctttccacttctgaaaatagtatactttggttttctttttctccttaattaggctaaccaagaggttttcttctttattcatatatatacgtatatacacgtatacatacacgtatatatatatatacgtgtatatatatgtgtatatatataaaacatatatgtgtgtgtgtgtgtatatatatatatattttttttttttgagacagagtcttgctttgttgcccaggctggagtacagtggcgtgatctcagttcactgcaacctccgcctcccaggttcaagtgactctcctgcctcagcctgccaagtagctgagactacaggcgagcaccaccacgcccagctgattttttgtatttttagtaaagatggggtttcaccgtgttagccaggatggtctctatctcctgacctcatgatccacccgcctcagcctcccaaagtgctgggattacaggcgtgagccaccgcgcctggccttttttttttttttttttttgagacagggtctcactctgttgcccagaccagagtacagctgtagtggcatgatgtcaactcactgcaacctccgcttcccgggttcaagtgattcttgtgtctcagcctcccaagtagctgggatcacaggcacgcaccaccacgtccagctaatttttttgtatttttagtagagatggggtttcgccatgttggccaggctggtttcgaactcctggcctcaagaaatccacccaccttggtctcccaaagtgctgagattacaggcatgagccactgcgcctggcctaatttttgtatttttagcagagacgggttttaccatgttggccaggctggtctcaaactcctgacctcaggtgatcctcacgccttggcctcccaaaatgctgggattacaggtgtgagccactgttcccagcctttattcataatttttttttttttttgagacagagtctcgctctgttgcccaggctggagtacagtggcatgatcttggctcactgcaacctccgcctcccagattcaagcgattctcctgcctcagcttcccgagtagctgggactacaggtgtgtaccaccatgcccagctaattttcatatttttagtagagacaaggttttgctatgttggccaggctggtctcgaactcctgacctcaggtgatccaaccgcctccacatcccaaagtgttggaattacaggcatgagccaccgcacccagcttagtcataatttaaagaaccagtttctggttttatttttagttagttttcacaggtattctttttctaattttattagtttctgatcttattagtactaattttctttacacttcctttaagtgtaaaggaagtgtatagtcctctgaaagagtctttccaccccgtaacccacagacacattgtccccacaatccaaaaagcccctagttctctttctccagattagagtattctcagcaacccaccttgatcttacttctgcttttcccatagccctgggaagtgctgtgaggacaaagaacttctcctttcagacgtcctcaccacccaccatgcctagcattgcacaactctcaggccaaggtaaggcaggctactaggacttaccgggtagacaaggaggtagggtccagggtccagataagaatgcagctctggcaggccacagccaagacagaggcactaaggggcttccaggccagagacgccacatttcgctgcagccggtgcttcagggaggggactatggtgctagggtgaaggggcaggaaactgagtcaaggcaggaacactaaggctccagggaccagagtgcagttaaggagggaaagccacagagaagaaggatgatccatccaggggccaggggcaccataggacaggaggggataaaggttaggtctagaagaagcacgcatccagttatggagcttccctgaccccagttctggaaggagccccatgaatcaggttcaagaactacaggactccccggaaccaaggctggcaagggaaggtgatattgacaagtcagagcccacctggtgtccccacacacacctgctggcattatacacacggactgagtcatctagcagggccactgcaaacttgttggtgtgggggtgccatgcaaagacacgcaagcagcagctggacctaaggaaggggttaacatgaagagttcctgcacctatccctaccctagcccagaagctcacattcatttccagtaaggacatggttttttcctactttttcttgtattcttttttgggggaacaggaggaatgagaatatggtgagcaatcagaaaaggagtaggagtctttgccttctccccaaagggagttttgaggttcaggacttcctttccacaaagctccagggcttgtgcactcaccaatttgtgacttgggcaaattcagcgatcagatcttcgctcctgagctgtaagaacaagatagacacaggacacactggggcaaaaggagtccatctcctcaatattccaacaggggagctggaccactcctaccctctgaagtcatcacacccaaccctgacctgcaaggataggaatgagggcagagtaggatggggacacagcaaatgcagagggctggggaggaagccaaacttacagacagatgggggaacagggacccatggagggaagaggcccatcgacagagtgccagggcccagccggatgccgtcttcacccactcaaacactgtagggttgaggaagcagctctgattaaaccattcacaggcctcttaccaggtaccttctaggtgaaagacaaggaaggacaggcactccccaggtccttctgcccagtaagtgctctcaacaccacactctggacacccactctggacacccactctgggttatttgggtaggtagaggagaggacaggaaaaatagggctaaaagaggctgagccaacaggtgtcgggggtgagttcaagaatatggagaggagataaccacaaaactagggaaggctggagggaaaaatacttaccctcttcttctgagtttgcaatttcatttagcaccccaaaaaggcccacatcacgcctgataagggaggaaaatgtgggtcagcttactctgatcccctctgtccctctctaccagtttcattcattcaatatacatgtattaaaaatatgggcactcacatttaatgagtgccaactatgtaccaggcactctacgggctgtcctttcatttacatatctcacaaatctgaacgagattctacccatttacggatgagacaaccaaggctcagaggacttttggggctttgtgagcaggttaaggagttgggacttgctctaagacaatgaatggaaagccatggaagggttctaaggagaagaataaacagatcacacagcagcattttagaaagagcagtctggctgcagattagagagtgataagaatagaaaaggccaggctggctgtggtggctcacgcctataatcccagcactttgggaggctgaggtgggtggatcacgaggtcaggaaactgagaccatcctggccaacatggtaaaaccccgtctctactaaaaatgcagaaattagccaggtgtggtggtgcgtacctgtagtcccagctactcaggaggctgaggcagggcaggagaatcacttgaacccaggaagcggaggctgcagtaagccgagattgtgccactgcactccagcctgggcgacagagtgagactctgcctcaaaaaagaagaaaaaaaaaaaagaatagaaaaggccaggcgcggtggctcacacctgtaatcacagcactttgggaggccaaggtgggcggatcacgaggtcaggagatcaagaccatcctggccaacatggtgaaacatgttgaaaaatatgaaaattagccaggtgtggtggtccatgcctataatcccagctactccataggctgaggcaggagaatcgcctgaacccgggaggtggcgattgcagtgagccaacatcgtgccaccacactccagcctgggcaacagagcaagactccatctcagacaaaaaaaaaaaaaaaaaaaaagaagagaaaaaatagaaaaagtccaggtgcagtggctcaaccctagcactttgggaggccaaggcaggtggatcgcctgagctcaagagcttgagaccagcctaggcaacatagggaaatgctgtctctacaaaaaaaaatacaaaacttaggcaggtgtggtggcacatgcctgtagtcccagctacttgggaggctgaggaaggagcatcacttgagccctgggggctgacaatgcagtgagccgtgttccatgtttgcgccactgcactccacactgggcaacagagcaagatgctgtctcaaaaaataataataataatagagaaaaataaatcagttaagaatctacttcagggccgggtgcggtggctcacacctgtaatcccagcacgctgggaggccaaggcaggtggatcacgaggtcaggagttcgagaccagcctggtcaagatggtgaaacctcatctctattaaaaatacaaaaattggccaggtgcggtggctcacacctgtaatcccagcactttgggaggctgaggcgggcggatcacaaggtcaagagatcaagaccatcctggctaacacggtgaaaccccatctctactaaaaatacaaaaaattagccaggtgtggtggtgggcgcctgtagtcccagctactcgggaggctgaggcacgagaatggagtgaactcgggaggcgaagcttgcagtgagccgagatcgtgccactgcactccagcctgggcaacagagcgagactccgtctcaaaaaaaaaaaaccaaaaaaataaaacaaaacaaaaattaaccaggcgtggtggtgtgcacctgtagtcccagctactcagaggctgaggcagaagaattgcttgaacccaggaggcggaggttgcagcgagctgagatcacgccactgcactccagcctgggtgacaaagtgagactctgtctcaaaaaaaaaaaaagaatctacttcaggaacctaggaaaaaggtgaaagtggcctgaactggtggggatgaagaaaaagagacagatttgagagatttaggaattagcataaacaagatgtgaagactaatcagacattagtaaaggaaagagcaatacaacagaaacacctaggtaataattacatcagctaatatgcttacaatgtgccagctctggactaggtgcctcacattaactaatcaagccattatgacaatcctacaagataggtattgttatcactgcatttatttttattttattgagacagggtcttgctctgtgacccaggctggagtgcaatatcaccatcacggctcgctgcagcctcaatctcctgagctcaggtattcttgcctcggcctcccgaggagctgagactacgggtgcacaccatcatgcccagctaatttttaaattttttgtagagatggggtttcagtgtgtgtgtgtgtgtgtgtgcgtgtgtgtgtgtgtgtgtgtgtgtgtgttaagacggagtctcactctgtcacccaggctggagtgcagtggtgtgaactcggctcactgcaacctctacctcctgggtgcaagcaattcttgcacctcagcctcctgagtaattaggattacacacggagtttcaccacattggccaggctggtctcgaactcctgacctcaagtgatacacccgccttggcctcccaaagtgctgggattacaggcatgagcttccgcgcccagactatcactgcatttttagatgagagaacaaaggtgtgaagaggctaattaatatgaacaaggtaatctaagtagaaagtagcagtcaggattcaaccatctatctaccccagaacctatactcaaaccactttttcctgaatgagtaatatgatcattccttaaagtgaaccatccagagaagcagatttggagagagaaataaagagactggatttgagcatgctgaatatatgaagtctgcgaaatattcaagcaggataatttggcaaacacgtgaacaccaggtctgatgcatcaactggaaatctagccccaagaacaccaacatttaagggacatcaggaagaggagccaccaaaaaccctgagaagcagcagccacagaagtaggagacaaggagcctgggaatgaatggcttttcaacaaactgatattcaacttcacacacacaggcatgcccattaaactgtactgaagtaccaaagatcaaagcttgacagcacatgtgttggaaaacaggcactcccatacactgctggtgggaccatatacatgtaccattttgacagagggctatttggaacagctcacaaaattacagatgaacataccctctgagccagcaacttaatttctaggaatttatcctacaaatggtaatggtattaataaaaatattaagtaaccctttttttttttttgagacaaggtctcactcagtgccactgcactggcacaatcttggctcactacaacctccacctcccaggctcaagtgatcctcctatacataagcctcccaagtagctgggaataaaggtgcatgccaccatacccagctaatttttgtacttttcttgtagagaaaagaacatggtttcgccatgttccccaggctagtctcaaactactaagctcaagcaatctgctggcctcagcctaccaaagcgctgggattataggcgtgagtcactgtgcctggcataaataacccttaaaggaattaatatgtgccattaataggtccaggtgcagtagctgtaatctcagcactttgggaggccaaggcaggcctgaggtcaggaggccagaccaccctggccaacatggtgaaatctcatctctactaaaatacaaaaagttagctgggcgtggtggcacatgcctatagtaccagctactcgggaggctgaggcaggggaactgcttgaaccagagaggcggaggctgcagtgagccgagatcgcacctctgcactccagcctggcaacacagcaagactccgtctcaaaaaaaaaaaaaaaaaaaaaaagaaaaagaaaatgagccgggcgcggtggctcacgcctgtaatcccagcactttgggaggccaaggcgggcacatcatctgaggtcggaagttcaagaccagcctgaccaacatggagaaaccctgtctctactaaaaatacaaaattagctgggcgtggtggcacatgcctgtaatcctagctactcgggagactgaggcagaagaatcgcttgaacctgggaggtggaagttgcagtgagctgagcacgccactgcactccagcctgggcaacaagagtgaaactccatctcaaaaaaaaaaaagaaaatgaaaccaggtagtgtagctccactcctacaagtgcaaagtggatgacctatgtaggagattattcagtgcaaccttatatctgatcttgctgagcttcaggtaaaagctcagaagtggtaatgccatgaggtgggggcagggagcaggttcacctaatcaagccagaaagcaaggcaagttactagagatgaaatggaagtactttttccatagtgttcctgggaagggcaaggaagggaacctgacatttattgagcatttgagttctataataaggactaaaaatttcatatgatttaggatatacagctctcgtggagacagcctgaataaaagtcttttgaagaacaccccaaggtaaaggggtgttgactcattttccaggatctgcagactgtgacccaggaaaccctttgccatgcctcaccaaatgttgatgcatctcttccacacttgctcccggtgatggatgaaggcagttcttgtgccatggtccagccttccaggggtctttaggggatcctttgtcagttgtaggacaggaagattgatccactatagcacaaaagtgaggagtgtgacggtgattcagtctcttcccaaatctttaattccgtgccatctccaacccaccgctgggctaagtataagagattccagaggtctgtttcccatttccacaaagctaacacttgtgagaatgggaaacaagtcttagctcccgtatctgtgcaactagaataatatttcatagggttgctgtgattatgaaaccatatgacatttttagaaaacacctgactcagcctctttcttacatagcaaacgctcaataaatgtcagtttcccttccttgtccttcccaggaacaccatggaaaaaagttccatgttgtatccttctgatcctccccagatactgtccccaacttttagatagttctcccgcatcctcacactccctagattctccctcattctctccattccctctaggcctcctccacagctccttaaccgttcccccgttatactccaatcccagtcctaaaacagattccagcccttctagcctcctgccggggccaagctgtttccactccgccagactctgtgaccctgcccctgtcacactgcctcctttccccagtagtccccgactccgcccccatgcctgtaggtcccctccctcctcgccctggccacctggccccggaagtcggggggcgggctctcatagctactgcccgtcaccagctcgttattgtgctcatatagggtgacttgaccccgaggcggtggaggagggaacaaccccagagagcacatcttgccggttcgcaggacgtctgcagtcggcaaactcctggccggaacggcacagaccgcactcccgcaactcggttcccgggctagattcgtatgcggacgggtaccgcaagggacaaacggcgaggcggaactcaacggaagtgaagaaaagactaacgggaaagaaggacgagtacgcggtcccgggacagacctccaaagcttcttcctgcgccccctggcggccggagggggagcagcgcggacacgtcccccggccaaccgttggttaccaggctggagtggggtttttttctgttgttttccatgagactactgtttttcccagctccgaattcccgaacaccttctcccactcactatcttagcgcttagaaagcccgaaataagccacattcagggaagtaccaaattaatcctcccaggcctgtggatcacccagaggaaaatacaggctatgtcacaggcagctggctggaaagctgagggaaaagcctcagagaggaggaacagtgctgcacccacacggttaggcgtcctggaaagggaggtggggacggttggaaaactaacatttcctgccaggcgcggtggctcacgcctgtaatcccagcactttgggaggtcgaggtgggtggatcatctgaaaggagttcgcagactagcctggccaacatgctgaaaaccccatctatactaaaaatacaaaaattagtcgggcgtggtggcgggcacctgtaatcccagctaatcgggaggctgaggcaggagaatctcttgaactccggagggggaggttgcagtgagccaagatcgcaccattgcactccagcctgggtaacaagagggaaacttcgtctcaaaaaggaaaactttattttattttatttttttgagagacagggtctcgctctattgcccaggatgaaggcagtggtgctatctcagctcactgcaacctctgcctccccggttcaagcgattatcctgcctcaacctctggagtagctgggattacaggcatgcttcaccacgcccagctaagtttgtatttttagtagagacgaggttttaccatgttggccaggctggtctcaaactcctgacctcaagtgatctgcctgctttggcctcccaaattgctgggattacaggcctgagccaccttgccgggctgcaaaactatttcctgagcacttgttacgataagtgcttttataatctttacaaccccataaggtgggtgctgttctgtcaccatgaggaaagtgagtcacagagagattggacctagatacacccaaaccagttattctcacttaagaataaaagtaaggctgggtgtggtagctcacacctgtaatcccagcactttgggaggccgaggctgatctcttgagcccaggagttcaagaccagcttgggcaaaatagcaagaccctgtatctacaaaaaattcaaaagttagccagcgtggtggtggcaagcgtctttagtccagctactcagaaggctgagataggagaatccagactacaatgatccaagatagcaccactgcactccagcctgggtcaaagagcgagaccctgtcaagcaagccagagagaaagagccgggcgcggtggctcacgcctgtaatcccagcactttgggaagctgaggtgggctgatcccctgaggtcgggatttcgagaccagcctgaccaacatggagaaaccccatctctactaaaaaatacaaaaccagccaggcattgtggtgcatgcctgtaatcccagctactcgggaggctgaggcaggagaatcccttgaacctggaaggcggaggttgcagtgagcagagatcgcgccactgcactccatccaacctgggcaacaagagcgaaactccgtctcaaaaaaaaaaaaaaacaaaaaacaaaacaaaacaaaaaaaaatgggagggaagggagagggagaaagaaaggaaagaaagaaagagaatgggggcccctcttacagactttggaaaaaacattgaattctttgagtctcacttttctcatttgcagtgtcctaattatttcatatggttgttttccatacaaaataataaaatgaagctatttaataaattttaaagtgctaaacaaatgtcagaggttaatagctataactgtgccatcaactaggtgaccttggtcagagttcattaacaaatgttaagtgatttgaagatgtagaaggctgtccccactcccaagagctaccagtctcattgaataatctagggggcatttagttctagtattctggattccgtgtctgcccttctttttcacctgaaaaattccccccaagagagttattaccaggtcagaaaacaaagggctccagagtctcctgaaaatgcacttcacctgagaaggcaagtggatctcctctaatctagtacttctcaactgttaagggacataggaatcacctgagcatctcctaaggtggcgctcagaggctatagttccaaagaatccccagctgatactgcacagaccacattttaagtagcaaggctctaacctagcggtccccaactttttggcaccaggtttagtggaagacagtttttccagggggagcgggggagggaatggtttggggatgaaactgttacacctgagatcatcaggcattagttggattctcataaaaagcgggcaacctaggtccttcacgtgcgcagttcacaacagagttcgcgctactatgagaatctaatgccgctgatctgacaggaggcggagctcagcttgctcagctcgtctccggctgtgcggttcctttacaggccaccgacacgacgggccgtggcgcgacccctgctctaaccttttcccatagccccatttaatttcctatgtgagttcaccgtcacctgggaagtcacagaaagcttgaagaacataaggtatacactggggatggtttggggaacctggctgggaaagcctccctgagaaggggaagtgggcaggtttgagggagaggaagtcggtgactgacagattagtggagagcactgaggacccacgatagtttccgtttgtaccttagtcgtaacaccatccaaacccagatacccctaggaaaaatcactccggcctgcaacttgcatccttcgatgaaacctcgattttcaccatcaggttataatgatcggttaggtgcctgcttcttaccctgtaaggtgaactggagagaaggaacagtgctgttccgcccgctgcccccgccctggcctggcacaagtactgtcccctcctccatactgcttatttaacgtttgtggaacgcttttcaccatttgcgggttctagaaaggcccaagtccaggcccggcgcgctcacccagtaacttcaccagggggcgcggctggccaggcaacgcagcgaccgtgacccacgccctatgggctccgagcgcttagcgggcggtctccgccggcccctccctacgacctgggcgggaaccgagagagcgcgcaggccgcttctaaaaggggccccctactttgggagtcgtcaccggagcctgggtgcccggagctccgcccgctaccccttcccgggcccgctggagcccggcgtcccgacccggggccggtaaccaggcgcacatggcccgcccggccctgtttgtcctggcagcgcgccgccgctatttgaagcggtttttatctcccagaaaccagcaaaaccccaagcggagtctagggaagatgaaaggggccgaagggttggggaggggaggaccgcgaggctgcggcgggcgggagctggcaccggacaggcggagaccgggaggcgagagggccagactctggggggtccggaggagcccgcccggcggggttgaggcgggatcccggggttccactccaggccgccgcctcgctcagaccagctccaaggcgccccccgcctttcctctgccccagccccctctcccgggtctcttccgtcacagcccccagcccactaaagaagtcttcggaactcggatttcttcaaagcgcctttgaagtcgcgcgcccagccggagggcaggagatttcgcacctgggcgggggcgggagtggcgtcagggtggggagggggctcgtaacccgagcccccccaggatcgccggccccctcccacccgtagcagcccctcttgcgacccgtgcggtggacagtccgacgcggggcgcagctgggagtcgggcccaggccggggggagcggcctgtgagccccctcagcccagcggggtaaccttggggggcgggggccgcacaaagccctattgtggctcggggatgctgccacagagtggtttttgttcttcggctaactccgtggcgggcacgactgattgcagacccagggcagggggcgggttacgtgccaggcccagtctgcccgccgggagccgcaccaccgcccgactggggccgcgcaggagtccgcactgcaaccgcggtgcccgcgctcgggtcgcgtcactgccctgaccagggtcagttggtgcagtccagaaagggccagggtagaaaccagtgagtcttcccaactctgcagaaagcactgcacgcccaaaaactgaacaccgctggaggatttgaccgagaaacaattttgttttgtgttttgttttgagacggagtctcgctctgcagcccacgctggagtgcagtggcgcgatctcagctcactgcaacctccacctcccaggttccacgattcttctgcctcagcctcccaagcagctgggattacaggcacctgccatcacgcccggctgatttttgtattttttagtacagacagggtttcatcatgttagcgaggatggtctcgaactcctgacctcaggtgatccgcccttctgggcttcccgaagtgctgggattacatgtgtgagccaccacgcccggccgataaactattttaccgcgagcataggtgagcaaacgtgcacaatagaatattcgcccatgagtagtccccaatttgctaaggaaaaaaaaccattggccctcgcttcacccttcctcttctccttttctcaccaggacaaaatttcaaatccaacttttatttattaaattaaaaaaaaaagactccacaaagggcatgatcccttccattccacaatgttctctccccaagctccagcggctttaaccctttaacttggggccttgagacagcaggggacagaaaaggaggatccaacgttacaggaaaggcacgaagcggctttaaaagtcactggaggtggagatgggagcatccaaagtcccagggtgggggtgcgtggatgcaccaccagatcagcttgggggcctctgtcctcctagctctttaagttctttctcagggcttctaggcaccagatctagcatagtgccttgcacagagtaggcactcaatacatacttatttgaatctgatcctagagaaagccttccccacccattcttcaggaggtgcacccccaaaccaatgtcctcctgttagatgggcttccccaaagagcacatctaagatggcagctgcaagctctccataaccatggcaacaggggattaacctgatggggtcatggtgtctaaggggtggggcagtggaggaacctgctctgcagtcaagggagatggggtacattccagtccttctcccctccataggacttgaggtttcacagcttctggctggggctggggatattagggatccccctaatcaagagataccccatcaactgtttagcagagatgtagctaacccaatttgtagagacttcattacaagagaaaccctatcaactgagattctgatgatagacattctattaacaagatcttctccactaacattttgtctatacagagatgcatttgactagaatttccttagcagaaatggatccacttccctccccagctcactctacctgacccgtcatcataacttacataaatagaattattactattcattactcctggtacataggggttaaatatacaggcctgggggcagcctccctgaccctggggtcaccccatctttgggatcagatccccactggtctgcccccctcttggcaccctctggccaggtcactaaccccaatacccctgatgaagaggccaccagggggcaataaattatcattatcattgtgtttgtaaaaaggaaaaaagagttctggagaatggaaagcaatggtgtaagaagttgggaagactgaagcctggaggctgagggacagcaggaaataagcttgagaagcagaaaggggtacatgtcaaggagtgagatggagaaatagtgttgggagcccaaatagaaagtgtgttggtgtggcagggccagagtctaggaagccggagtgcaggtatcaggcacaaggggagggcctgagatgagagtttgtggaaagccagtctcatggtgaagagagaaggtgagctgaggaggcatgcaaggagatacccaagcccagaatggccaggagggagacagagggagagagccccgaaggatggcatgcatggggtaaagagagtgattggcaagcagtggtctagagagccaagagagactgtcagggcagccctggggtgggagaccttccacccggctcagatctccagcaagttgctctgctcagggctgcctccaggggctttctctggggttgctggcgaggcagaaggtcggggcgtctgactggcctcctcttcccccgtgctgcggccctcccccagctccttggggccactgggagggggacccgggcctggttctccatgggtgcgctggtgtttgctcaggtggtcgcttcgggtaaagcgcttggagcagagcaggcaggtgaacttcttctcccgggtgtgagtgcgcacatgacgctccagctcatccgaacgagtgaacctcttgccgcagaagagccagttgcagacgaagggcctctcgcctgtgtgccagcgcaagtgggccttcaggtgcgaagccttgccatacaccttgccgcagccagggatgtggcagctgtggatgggcttcttccgcagcccagccgctgctgctcccagccgctctagctcctggcaattagggcagtcgcaggaggagcgccctgccccactgcccccatatccaccactacccccagtgcttgcaccccgtgggggtttggctccaccactcccttctagctgccc

SEQ ID NO: 141 - DNA, 6118 bp, Homo sapiens
aaagatgcccaaatgaataatcaggtgaacacactgatttctgcaactgatgggaactgagggtgagactttgttcaaagctctattaaaggatctaagttgtgtgcaataatcccctcctaaaacttaggacaacagtattttctatttttttttctctatgcgtgtttaaaggagggctccgggaagcagacagggagaaggaggtggccaaagcatttgccagcagagggaggggaaggctgctgttgtggcctggcagtgccctggccaggggctcacctggcagctccttggccttgcccttgtccaccagctccaggccggcctcggtggctgcgcttgtggcttccatctgctgcaatatggcctccacgatgggcaccatcatggccgtggttgccgtgttactgatccacatggacaggagggctgtgacgcccatgaagcccagcatcagcctgcagaggaggggcagggaggaaagccagagaatccccaccccacccccgtactccctgggaagcaactggggactgggtccacccctgcagggatgcacaggtgttgaggccaattcaagatcagatattggaatagggatgacggttttagagcctcccctccctccctccttcccttctttgcttcctccattcctctctccctcctgcctctcccacacccatgactgatgtctactctgcttgcttctggggttaccaagaggcctcagatccagtcgtggttctaaggagcacccctgccccaccatctagcaggggaagcccaggcatccagatggtgccaactcaatatgagcttgccctagggtgtgctggaatacccctatgtgcaggcagccccagcttcccacttctggctaggaaattcccacccacccccaaactctgttgcacctctcagaagttcagaagggctaagcagagtaggggtagggtgagctggggagggagcttgggaaagtgtgactattctcccggctgccactccaaccctgccatctcccctccgccccgcacatacactttgacccctccatgctgcagtggagctatcacacaaacagtattcagaagaaacactccctttgcttgtaacccctgctcccttctctgctgtctatcaggaagactcctcatggtccttcagagcctgctcaaacaacatccctcctctgggaccacgctctcagtgtgtgcaccaggtggggctggcctgacccttctcaatccttccccctactctaatcatcgctgtgctgggttcaaagcacctgtttccatgtctgctctctccttgggctgtgagcagggcagggcctgactctgctctgtggctctacatgccccagctgtccaaggctagggacagaaggagctcagctactctcagtctgtgggcctcgctgcagccaggctcctcctcagggctcctaattcacctgggggtaggagcaggggcaggggtaggagcctgaagaagggacctaggagctgttctgcaccagggcccaagctgctgtccacacaggcagacattatggacccaaaaaaaaacaaagcccgggacccaggctaggaggagggggagagtttgcatgaatggagttgtctgagaagaaccaaggcttctacatgatatctcaaggcaccaagggtgcctcacatacaggtgactcccaggacaggcagtgccttggacaaccggagaccatactcagaggagcaaggtggcaggaaggatacagaagcatgtgtgaacttgggtttggaagtggaagctctccagcatgctgcagaatgaaacccactggagtggcctcccacccaagctggccactcaagggagccaagcagaagaattctgagggccctgaggtccactttcctggggtctctcatttctagaaaatatgatggcttttgatttgatgctaaagcaattactggaaggaatcaatgccaggatgtgtaacagatcagagagccacaaagtcccctgctcaggggaatctgaggcaccaagggagccccgggcatgggttgcctgcagggcaggctagcgtctgtgtgtgctcagggtctagcacagcccctgacacaggggcgcctcaggaggaatttaccgtaaactgaccagcagctgactcctgatggctgggccaaggacgtgccatcattgaggggacacattgtctcaaaaggaagatatgccctgagtttctgattagagaggacacaggccttatcagagaagctgggtccaatccccgtgtgtccatgagcaaatcactttatccctctctgcctccaatccctcatccacagaatgtgggcagtaagaatactcagctctcagagttgtggtaagaattaaatgaggcaattcataagctcctggtatcatgcctggggccttgtagacactcaatatacccattatgatcatgattgattatggttatgattatgattatattgactccatggcttagctggaaatggctagctagattggcaggagagatcctggaaatggagagagaagctggggtactgagtgatatcggggaagataagaagcttctttgcagtgggaatagatgctccagcttggagagaggacctttctgcttccccatgagctgggtagttgagccacttctggcctgcttcccttatcctatcagacacagcttgatccagcctctatccaatttgttcccggtggaaccctgcagctagctgcctcccccagaaagccttccaagcctgcaaggactcttgctgacccacctcctctggattcgaggacccttacttactgctgctcaccatgtgccaccaccacgcatgcatctggtctctcccactaaagctataacgcaccccacccagccaagtccaggtaagcccatggccagccctcaccagtggatggcctggtctgtgccatcctccacccccttccagccctggggctcatgcagagccacgtggcaagagagagaaggcgtaattaccgtgcaggcttggcccccacccagaggagcgtgcgcagggcgatcctcttgtgcaggttccagcgctccacagccacggccacgatgaggccgcccaggaacagcatgttggtgtccttcatgtactggacacacacctggagcgtggcacgaaggcctcatcaggactgtcccttgccacacactagagccacccagtccccagatgctgacttcagggacagcttggagtggggatgcaggctcgagtggtgtctccctgccagggagaatccacaaatgagggttttccggtcacccccaggcctgtgcgactcacagtggggactagagaaagagagaaggggagaaccagaaagtcaccaggatcccttgggtctgctcacctgcctggagtccagaatctggaagagtgggaaaagcaagacaggcatgagagaggtgacagccagagggatgacttctgtgcaccagtaaatggccatgaggatgatgacgtaggcacacctgacaaactgaagagacagtcctgaggcctcagcgtgttgccgcctccctctccccacccccagaacactccggacggcggctggcatggattgtcaagacacagtgctgatctcagagggattcccctcaaagtcatcttgttccccagccctggtcagcacagctttcccgggtcaggccagggatctattcgcaaaggactcctgccccattcccacccctcctccctgcctccctccttcccagctgtgtggttctaggcacgttctttcatcttctcaaaccttggattagctgcctctcaaaagaaaagatcaagaataggacaaggaagaaaaggagaaagaaggagaaggaggagaaggaggaggaggggatagaagaaagagaggaagggggatggagaaggaagaaaagaaaggaggaagaggagaaggagaagaagaataaaatacctggtttttttggttttattattattttatttttgagatggagtgtcgctcttgccgcctaggaggccattgttctaagagaagtgactcagcaatggaaagccaaatagtgcatgttctcccttataagtgggagctaagctatgggtatccagaggtatatagcgtggtcgaatggatactggagacttagaagcagacagggtgggataggagggagggattaaaatctcagacttcaccactatccaattcattcatgtaaccgaaaactacgtgtacccctaaagctattgaaataaaagtaataataattatgtgataaaactagccacctccctaggttgttttatgtttcatcagtattttttgtgtgtgtgtgtgtgacagagtttcgatcctgttgcccaggctggagtgcaatggcacaatctcagctcactgcaacctccacctcccgggttcaagcgattctcctgcctcaacctccggagttgggattgcaggcacctgccaccacgccctgctaatttttgtatttttagtagagacggggttttgccacattggccaggctgatctcgaactcctgacctcatgatccgcccacctcagcaccctaaagtgctgggattacaggcgtgagccaccgcgcccaacctcagagttccttcttagatgtctccctgcgcctcttctatagtctggtttgtgcccttcctctgagtaccctccccagccattagcatatggagttgtcactgtttcctcaactgtccttctaccaccacaaccagtgcgtgactcgaaagcacaaacagtacagtgagtcctcacttaacatcattgattggtttttggaaattgcaatgcgtaagcgaaacaacataagccaatattcccataggcaaattgctagaaacaacagttaaatttctacagcatatttctggtcacaaaaacatcacggagatcttaaataaagaccaaaacacttccaatattaaacactgaagggaatgtgagctatacatatacttaagaaacattgaaaacaagttagataattatttacccagttacagcaggtcagggtcttgggtgaccagatcctgtcccggcagctcagggtacaaggtggaaaccagccctggacaagatgccatcccattgcagaatgcacactgacacgcacgcccacgctcactcagacagggaccatacagacactccaattcacctaacgtgcacgggtttgggatgtggaaggaaaccatactagccaaagaaaagccatgtggacatgagggtaatgtgcacgctccacacagacagtggccccagccagtaatcattttcttttctttctctctcgctcttttatttctttttttttttttttgagacagggtctggctctgttgcccaggtgggagtgaagtggcacggtcacagctcactgtaacctccatctcctgggctcaagggatccttccttttttttccctccctcatcaacattataatgaaatgatattgaatgaatcaacattattcaagaacctgctgtatttgtagatcaccgtcctcagcatccagaacaggcccaacacttaggatatctttgcaaattcttgcttatttatttatttatttatttatttacttacttacttatttttgagacagagccttgctctgtccccaggctggagtgcagtggtgcaatcttggctcactgcagcctctacctcccaggttcaagcgattctcctgcctcagtctcctgagtagctgggactacagacaagcgccaccacgcccggctaatttttgtatttttagtagagaggggatttcaccatgttggccaggatggtcttgatctcctggcctcgtgatccacctgtctcggcctcccaaagtgctgggattacaggcatgagccactgtgcccggccatctttgcaaatgtttattaaaggaatcaatagcattcatctgagtttaactctgacaatgctgctgaagaacagatgcacctgtacacaatccctgcttctcatcacccagaagagcgtatgtattatttgcacaaaacagtgca

SEQ ID NO: 142 - DNA, 11314 bp, Homo sapiens
aggaaaacagtgctacctgtcatctataatattatcctagttgcctataattttaccactatcattgtttggggaaatccttctggtctcttgtctgtccagatgcacataagtccttatggtcttttatctatataaatatacacaatttttgtatgaaaatggaatcattctgtacataccattttgctgctcttttcactcagtgatgcctggaacatttttttttttttttaagacggtctctagctgttgcctgggctggagtgcagtggcacgatctcggctcactgcaacctctgccttgcacgttcaagcaattctcctgtctcagcctcccaagtagctgggattacaggcgcccgccaccacgcctggctaattttttgtatttttagtagaaatggggtttcactgtgttggccaggctggtctcgaactcctgacctcgtgatccacccgcctcggcctcccaaagtgctgggattacaggtgtgagccaccccacccagctgcatggaacattttatagataatgaacatcttcagtattatttttaaggactatatactagttcatttcatagatcagatgtcatttatctttgatacttagactatttctaatcttctgcaattagctgaataaaaagaaacattagctacttgtacagctttctaattagtgagggcttttgtgtaatttgcatgtgcagccgctgtgtgatatgttcattgcttgctttcagtcgtagttctgcctcttcagctctatttgccctgaagtctttgttgcaaatgactcttcgcttgcttgtctactgtgccccaggctgtcttctcagttgttacaatgaggcagattgaatgaggggaaatgtgaatggattttcctgctggcctgaagtaaagtattttgttttcttttttttttttttgacatggagtttcactctcgttgcccaggtgagagtccagtggcgcgtgcccaggtgagagtccagtggcgcgatctcggctcactgcaacctccacctcctgggctcagtagctgggattacaggcatgagccaccacgcccagctaattttgtaattttagtagagacagggtttcaccatgttagtcaggctggtctcgaacttctgacctcaggtgagccacccgcctcggcctcccaaagtgctgggattacaaatgtaggccaccacgcccggcctaagtaaagtatttcataacacaattgggtctgaaaccaaggggctactggttgatactgcagccacatcagagaacaagccgttgatattctgggttgctccttttgcattgagttgtattgtctaatattgtaaccactggacacatgtaaccatttacatttaaatataaatacattaaaaataaaattcagttcctcagttacactggccacatttcaagtgcccagtagccacatgtggcttgtgactaccgtaatggaccgtgcagaggacatttccgtcattgcagaaagttctattggacagcaccagcatagagcatcctgtctccagttaagacacctacatgcagcctggtgtggtagctcacacctgtaatcccagcactttgggagacctagctgggaggatcacttgaggccaggagttcaagaccagcctgggctgaacatagcaagaccctgtctctacaaaaaattaaaaaattagctgggtgtggcagcatgtgcctataatcccagctacttgggaggctgaggtgggagatcacctgagtcccagaggttgagcctgcagtgaatcatgatcacaccactgcattctaacctgggtgggtgacagagtaagactttgtctttaaaaaaaacaaaaaaaaaaagaaagaaagaaaaggaaaaaaaaaagacgtttatattcattgctttgcccacaatacccaggtgcagtgagcaatcaataatacttattttatgttcatgattcagttaaattgttttataaacccactttttttggtgttgttagtatatgcatcagggctttcctttctcattctgtaagctggctgttttgctcatttaaagaggaagttcttgagaatgaaagagatgaattaactcatccttggtaaatggataatatgtggggacagggcctttgccccaagtctttggatcccaagtgccctcctggtttcaccacctcttgctgctctcctccccacaggaccaccatcaggatcaccaccaccactgggcattttattccctgtcaagtggtgaaggcgttcttacccagaaataacttctccttctgtatctaatttgcaacgaatgctcagaattgtaaaaatgaaagtaatttattcacgaggtaaagcgagttttctgttgaaattatttatgctttctgtttctatttctagcttgagcaatttcggaccctgcttttcacttccgaaggggagaaagagaaaagaatggtggacaacttccgcccccttcagccactgatgaatcgcactgttcgttcatccttccggcatgattatgtgctgaatgtacaagcgaaacccaagccggccaccagccaagcaaccccctaaaacattcatatctaggcagtattttgcttttgctttaatatatactagcttactataaattgttaactagactattctaagtgcctgcatttgataatatttacagatgtgcatttcttagcatgagagtgcttcatcagtctttgaggaaggctattcggtaccagcaagagacacaagtttctcttacagatacctgttggtaattgtaatgccttttttttttctttaagagactaggtcttgctctgctgcccaggctagagtgcagtggccaaatgatagctcactgcagccttgaactcctaggctcaagcagtcctcctgccttagcctctagagtagctggggctacaggtgctggccgcctggcccagcttgtaatatctttttatgtctgacatttttgagctatctttttatgtttatccattagtggttctatagcactatacatagggattataatcaaaatttttaacatgtggtaaggcacagacactgaccagaactcaggccttgcagaaacagcctatgggcccagactggtacttcctggctgaatattggccatggttttagatgtattttattttataacatgaatgtgtattctttcataagggcttatcagtcagtatatttgccccagtgtttagttgttacaaggacatgatatgcttacttactatcagtttatgatgtagaaaatatattttgtaattataagaaaacaagacttttcctatacccagaaatccctttgcatttccgaagatcagatattttgcttaaaggtctgatcatataggaaatatatgcagaacattttaaagaaaatgcctggctgggcacagtggctcacacctgtaatcccagcactttgggaggctgaggcgggtagctcacttgaggtcaggagtttgagaccagcctggccaacatgatgaaaccctgtcactactacaaataaaaaattagccaggcatggtggtgagcacctgtaatgccagctactcgggaagctgaggctggagaatcgcttgaacccaggaggtggtggttgtagtgaaccaagatcacaccactgcactccagcctgggcaacagagtgagactctgtgtctaataaaaaaaaaaaaagaaaagaaaagaaaaaatgcttaaagtgcctagaacttagaattctttcattgcacatttccagaaatatttttcttttcttttttttttttttttttgagatggagtctcgctctgtcccccaggctggagtgcagtggcactatcttggctcactgcaacctccacctcccgggtttaagcgattctcctgcctcagcctcctgagtaactgggactacaggcacatgccaccacgcccagctaatttttgtatttttagtagagatggggtttcactatgttggccaggctggtcttgaactcctgacctcaggtgatccacccgccttggcctcccaaagtgctgggattacaggcgtgagccaccgtgcccggccttccagaaatatttttcaaaggactagtaatctaatagcctatagtttatattattattttgtattatttgcacgctgttacatagtatataatgataatgttttctacagtgaaagagctatcccgtcttccctttacaactgtctgaactttatttactcattagtcaaggttctttgcaaggcaggtgattaacttaaatatctcagtttatacagtggtttaaaagacttttgttatggtaatagggagagaaacttgtcagataggctaaaatctagataattctacatattctgaggaattcatgctcctgtggctcttgcttataaatatcttggaatgtttctgaatgcctctaagcctatgttcagactctgttgcgtcaatgactggtagtatttctttcattaatatgtttgtcatctggtctgcaagatagggttggatgaatatacttaacactactgaactgtacacttaaagatcgttaggaaggaaacgggactacatcaaacttaaaaatgtctgtgtgtcaaaggaagcaatcaacaaagtgaaaacgcaagctctagaatgagagaaaataattgcaaatcgtctatcttataaggagcccaaatccagaatatatgaggaacttctacaactcaacaacaaaaaaccaaataactcaatttttaaaaatgggcaaaggacttgcacagacatttctccaaagaagttatacaattggccaataagaacatgaaaatatgctcaacattgccaattattagggaaatgcaaatcaaaaccacaatgagatatcgtctcacgcccatcatgatggccactatcagaagaacaaaaaaataacaagtattggggaggatgcagagaagttgaaacccttgtgcactgttggtggtaatgtaaaacggtgcagtcattacggaaaacagtacacaggtttcccaaataactgaaaacagaattaccataagaattaccaccaaagcgggatctcaaagagatatttgtacacccatgttcatagcagcattattcacaatagccaagaggttctggaagcatcccaaatgtccatcaacagatgaatagataaaggaaatgtggtatatacagtcaatggaatattattcagcctttaaaaagaaggaaatcctgtcaaatgtacaatgtggatgaaccttgaaggcattatgccaagtgaaataagccagccaacaaaagaacaaatgctatatgattcctccatgtgaagtatgcaaagtagtcaaaatcatacaatagaaagtagaaaggtggttgccaagcaacggttgggggaaggggagagggtgaatttgtatttagtgggtacagagcttgtgttgcaagaattctagagatctgttgcaaaacaagtgtgattgtacttaacactactgaactgtatacgtataagtttgagaaatatctcttttaaaaagggggaaatgtgaaggcttttgcatgtatgccctaggaaatgcatagaattcttagaaaggtaaacatggtaaaaaaagaagtctttgttaactttctgcagttcacctgtttcaaagtatagttacctttaaaagggtaaacacacaagatatgcattttccaaagcatacaggctttcctcctagctgtcttgttttttatttttttttattttttttatttttttgagacagagtcgcgctgtcacccgggctggagtgcagtggcgcgatctcggctcactgcaagctccgcctcccgggttcacgccattctcctgcctcagcctcctgagtagctgggactacaggcgcccgccaccacacccggctattttttgtattttaagtagagacagggtttcaccgtgttaaccaggatggtctcgatctgacctcgtgatccacccgtcttggcctcccaaagtgctgggattacaggtgtgagccactgtgcctggccttcctagctgtcttgtgaaacgataagtcaaaaccctactgcagtgagttttccaaactgaagggagaagcaatgtacagaatgcctgacttgcccttacatcttatacctggtgttctggcatgattattaaccacactctttttcactttgaaccatgtcctggtttgcatggccagcttccctgcagaggtgatagaaactgacttgaggcagtttctttctccatgccttagttagatgaccctcaaaggggcacagcagatttccctggctactgatacaccttaacaagaagcttgtgttttttatgccctcaaaagtgttttacttatactttcctagacataaaggtggaaaatgggcctaaggtctgtcaaaggtcttggaaaagaagattgtattaaaattgctgtccgtcttcattaaataatactagatcgatacaatgctttctttacagtattagtggttggtgaaagacttccttcctattgttacagtatatgtatatatctgtaaaattaatgagatatcctttaacttgtagattagaaagcgactaaaaactcataggggatttactaaagaagcaacaatgggaagaagcagccgatcctcctcagtgcacctttttctgttgcacagtacagtgcacagtgtgctggcatcaccatatagggcaagctgtgaccgcctttctcctttcccagggctacatggtgccaagcaggttcagtgtacactggttaccaacctgtctgattccattgtgacagaacacactcacacccaatacattacatgaagcagatttattacttacagacaggaagcaagggacaaaagaggccctggctccattgtgagccagtcccccagggctcaagaaagctgcccagggcggggctgatggagtcttgattgtacgtgccccacttgcaccacagcctgccttgggttatataccataggagccacataactcattgggcaaagctttaaagtacatcctccttccaggggaaagaggaacacaacctcgctgtctcaaacagttccctaaatcaagatgttacattccctaggagggacaacaacaaggccaacctgtttcaggcagttcctccatatcaggatattgcattcccagtgcattctacagttattcttaagaactacaagcaaggaagaagggagaactgggtcagtccaaggccacctggagaactgtcttgtacatgggttagggtaaagttggctattctaaaactaagcatccgcccaaaagaagtcttggaagatgtctttccctgttaaattcagatgatggtaattatagtttggaagtggaattggcttttagagttacttcctgtaatgaaattaacaagcaattcaggcctatttctgaaaatgaattcagtggttaattgttaaaaataaatgtctaactcctataaaaggaaatttacattcatttctaactcactaaaaaatctatggccgggtgcggtggctcatgcctgtaatcccagcattttgggaggccgaggcgggcagattaccggaggtcaagagttcgagaacagcctggccaatatggtgaaaccccgtctctactaaaaaatacaaaaattagccaggtggttgtggcatgcacctgtaatcccagctacgcaggaggctgaggcagaagaatcgcttgagcccaggaggcggaggttgcagtgagccgagatttcttagaaggaattgttacttattgttctgaagtgaaagtctggtctgattcagaagaaatgttacaacaacttaaacactgatgctttcagaacgggcagcaattctcagcgtaaattctgatcacagggaccagcaaaattggtgagttgcatagctacaacattctgtgccatccagggcactctagtttggggatacaactgccaaacctccaactagagagtttagtttaagatttagtcaagaagcagaaaggtaaaggtgacaatgtgtagtaaaccatgatagatgttataaaaggtggaatacttgtactggaaatgcatacagcgcctcatcccctcttgaggggtcaggaagttttcacactaatgatgatggtgatgagatgatgtaacagctaaagttttggaggcattcactattgctaggcactgtatcagcatataacatggcttatcttactcagttttcacaataaaagggttatgagatgggaactattattactatcttgatttttacaaatgagaaaacaggagtagacattaaggaatttactcaagatcacagccaaccaatgcactgagctggacaaggtcaacttgggggtgaagggcatatgtgttgctccaagtgtgtcagtataagagagattagggtgaggttttatgcagagtttgggcttcagctgagtaattctaaggagggattaggggaaggaaggcagtttagtaattgagtatctcagaaactttaatttggaggagaacggaacaaaggtaggccaaggaagctattcaatcactcaaaagatagaggttattagtcattttacagctgtaatgcatccttgtgaggaacattttttgcttggccttgtccctggccttgtatgtgtacattacagtctgattattagttgggatgatttttagtttctcaatccctactctcattgccccagtttaattcctcaacacctctcacctagattattgtgatactctagttttatcttttaaatcctttatattgcaaagcagagtgatttacctaaaacacaaacacaaccacaataagcctctatttaaaaagctttcaacggttcactgttgtctctacagaatgtaaacagagcgtcttaacatggcacaccaggccctccttaacctagccctcccagcccatcacaacaactatattccttgatattctcgaattgcactttattttgttttgtttttttgagacggagccttgctctgttgcccaggctggagggcagtggtgccatctcggctcactgcggccgccacctcctgggttcaagcagttctcctgtttcagcctccagagtagctgggactacaggcatgtgccaccacacccggctaattttgtatttttagtagagacggggtttcaccatgttggccaggctgacgaactcctgacctcaggtgatccacccgcctaggcctcccaaagtgctgggattacaggcgtgagccgctgcacccagcctcgaactgcactttaaattggatagctgggcgggcgtggtggctcgcgcctgtattcccagctactcgggaggctgaggtggaaggattgcttgaccccaggaggtcgaagctgcagcgagtcgtgattgcgccactgcactccaacctgggtgaaagacaagaccctgtctctaatatataagaaatgaataaataaataaattcgattgccaaaattcttgctgttcccagcatattccactttcacctttcagcgcctttgcttatgctgatctgactgtaactgcattcccacccttctccttctgggtaaagggcatcttctttccaaactcaactcttagcatcagaaagctgtccctgatactgcagttgagtcgcatgtgatactgaaaaaaaaagaaaaaaggaaaaaaaagagagctctccctgaatcccttggtggactatgttaggtaaacttcatctttgcctgcatcatattatgtattggttcttctctgccccctcgattgtaaactcctcaggggcagaggtaacagctttgcagccctgggagttaggtttgcttaagggaccagaacaggtgtgactggcagggagcgaagtctggagctttgtctgaggcgctgataggtggatcggcggaaggacgcggaacctggacaggtcggaaataaagccgggcgagcagctctgtgcgcgatgtgacttcatgagtggatgctgagaaaagcggcagagtacgactttaaccgcctagccacaacacgtcctgctagggcgaggagggagacagtgatacagcactgggcaagtgctgaagcgacaattacttctagggcggggtaaaagccccagagtatttttgctggaaggaggtatttatttgagcagggttctggaagacgagccgccgaagggtacctccggctttccgtttcaagtcccacgctggtggaggttgctcggtacccgcgcctgcgcgtgcccgtctcgactcttaggcccgccctttcctgccagacctggaggggcggggcggtgccggcaagatggctgcgcccgagaagatgacgtttcccgagaaaccaaggtaagcgccgtacggggagatgagcaggcgagcgggccgatcgtgggcatggaggatgtggtggcaggaagaaaagagaagctgggccaagctaagtgagccaccgcggcagctccattccttcctggtgcgcgctctggtgccctccccggacttgcacgggcggctgtggctcaggcaagcgaggagaggatcaggttggcggatggagaagaactgtctgggagtgggaggatgaggcgatgatagatggctgttctgtaattaaaatacaggaagcaaggtttctctcctcagcacccgaactatttcctttcattgggcacagaggagcggggagctcgggcagcgctgcattgtagccgctgatcgtcgtgtatatgtcttaatcttccagccacaaaaagtacagggccgccctgaagaaggagaaacgaaagaaacgtcggcaggaacttgctcgactgagagactcaggtgatggactctttattctgttttctgtgttgtgaaattgctctgtccactccagccctaacttgaagccccagtgtcagaaggaagtcaaatattgtgtcggaggaaaaatagctgtgacttctgcccccaagtagttatttagaaacacatgtcagaaacaatgttaacatactaaaggcaggaagaggaagtcttggtgaatgatcgcccactgattctgtgtaacttataaagtatctaatattacagttgcaagcttcatgaattacagcagctagcacagtccttgcacacgtagtaagtattcggtgaatgtttttcttcgtaaaaccagcaggagttgaaggtattaatt

SEQ ID NO: 143 - DNA, 6640 bp, Homo sapiens
tgaaatggctttgttagttaatatgtaacatgtcgcctcaatattgagcatctctggcagccgctgggactgcgggcgcgttgttggtcacactgacccagacaagtagtcaaggcagctttcaccacagatcaagcaagagagttggcagtaggtggggcagggtggtctccgtctgtgtgcacatggtgctcagtgagtcacatctgctccagttgtgtaatctccgtggtcagtgaagcaatgctgtgcgcacagttctgtgttgtgcctctcccggggaaggggtgtatttggcctgtgccccaccctagccctccttcgtcttccctctttcaccacgtcttccggggctggcttgagtgtgggagtctttctgccagctccctgcctacagccgcccactcaccagcccttcatgtgtgcctctgagagtcttcttcctaaaccaccccgtgcccttcagtccccttgtgaagcctgggcagtgaacatccttaagcccttagcagcttccctgaatccactcctcgttatccttcaggagtcctcccatatggtcaagcagatgaattccttgtttcttattcatgtcatgccgcttctcacctctggcaaccccaactaacatgcccctccctcttttgtctttcaaggtttcattcaaaccaaacttccttcttgaagccttctgcaaccccatgcctctcagtgaaacgtccttccttactgtgcacatgagccctgtggcacgtgacaactgtgcctggataccccaatttctctttctaaggcagggaattttcttgtacttcctttagtcccagtacctagcagaattctaaaaaacagccattcagtgaatgtgtattgatatcaatgattctggcacagctgacggggccaaataaatgctaagtagtattaagagtgataatggtttttaagtaataacaatacctaccatttattcattgcaatgggttggtcacagtgctagacccgttacaaccatcatatgattgaatacagcgtaaccaacctgtgtcttggcattacttccattttgcaggtaagaagtgacataccttgaccaaggtcatgtggctagtaagtggcaaatgtggaagtgggccagtgttctgcttcttggcccacactcccaacctctcaacatgtgtcctctgccatagctgcatctcccagatcgcatgggattttttcattgttttgtttttgtgaccacgttgcttccttatccctgtgattgggttttgcccatgtctctcctatgagagcagccttggtaagaagcagggagaatggaagggatatcacatgccagaatggtcagaaaaatgaggttgctcagcaggtgtcataagaacggatgattcatgcactgtgccttagagtaaagatggagaaatgcaaagggagtggggagcagagagacgctgacagatgatgagtgagcacaaatgtttatccatgctaatggagtggggacgtgatagtcactctgttctaatgcttatgaggagcagtctgtgggctgcaaatgcaggagcacaaggaatcttcaccctagtggcaggggaacctaaaactccaggctgcaaacagtggctggagcatctctgtaacagtctggccttgcagatccaaaagacaggtcatagacaacaaagacatctgatatttcctgacactgccatcctctgggctctgggggagtccaagatcatttgcagcactgccctgggagtggtgacaggctggaggaaaattactggggtctgaaggagtgcaggcccagctttcctcttgcttctaaggccaacccaaacaaataattggtgctgctttcagaatatcctcacatgggaccaccaccacctccactaggctctctgtccccagccttctgccttaggcttttccacctcacactacactatctaaattctctaccgtagagccaaggagtgaggataagggaaagggaagccaggggttctaagggaaccaaagtagtaccaaattcccccgttggtctgtggtctaacagtacggaaatggatagccatctgcatggggtggaaatgtctcttctttgtaaatgttccactgcctgagatttcaccattctagctttactttgcttccattattccacagtttccaggggaagagaaaactttacctggctaacaccttgatcagaatcacttcatcacagatcatatacatccacagagatgactgaggaaacagagaagagcttagaaagccaactctgtcttcatcaccttttggtcttggtcctcctgccttgggggtataaccctctcttagtttgtgggagaaaaatatccatggtaagaagaaagatgtcaggtccaggacagcaaagaaaccgctcagtaatagaagcaactccgattgcatgagcaggcttctcgagtgctgtcctgtcagcctaccgtccacattcctggtgtcatcaactctctagggacaggagcacagaacacgtgggagccgtcactgcaggagctgtgttagtgacagcagcattcaccagaggcatttaaaggctgattgttttatccatagcattgtctgggctttgagagagaaatcctgcctgcaacaggagaagactgaaaaatagaaaaccattggcagtatcaaagggttgtcattagtggacaagtacactggcttgattcactagtgctgttattatggttgttattttaatttgtcaagagacaatgggttgttggagaacatgggcagtggcccttgcttccaaggaggaaaggcaaagggaagagagatgctagggggtcgtttctgtagaaagcagacgcccaggtgtgtattttccccaccactgctgagccccacagcatggcttgtgaattttacaagtgatactgtgacatcgaaagcattccattgcgtctttgtgagaatctagggtcctcttttatgcttagtctaagtatctacagataaacatgcatctatattatatatgtgtgtgtttctccatactctgtgcatatacttaagtctgtaatgtgcatatacgtgtatctgtctgaacagttggatatatatagatgtgttgcagctctccaacctttaccaaagaaacaaaaaaaaacctaaaaccacacacacacacacgtgtgcacatgcaaataaataaatagagaaggagaaggaagaaaagaaaacagccagaggaggttgctttttctgtttcagaggacctcagcagttcttcccaaaatagacttctgtccttgctgggtaacatctaaaggagacgacatcacagagggtccaggcaagggctgtggagtccgacagtggggttcaaatactcacatgtgctgttgtgcttggtgcggcaactcaacttctcaaagcctcagtttccccatctgaggaagagggacagtccttcctgggaagagcaccctgccctccccatgacaagtgctcagcaatagtctcagccttctttcacaaggaacacaattgctcatcctatagttacagctcaagtttacaacgcaagcatctctcaggtgacagggtctttttttttagacagagtctcgctctgttgccaggctggagtgcagtggcacaatctcggctcaccgcaacctctgcctccaggattcaagcgattcttgtgccttagcctcccaagtagctgggattacaggcacgcaccaccacactcagctaatttttgtatttttagtagagacaggattttaccatgttggccaagatggtctccatctcctgaccttgtgatctgcccgcctcggcctcccagagtgctgggattacaggcatgagccaccgtgcctggccaggtgacagggtcttaacatggaggctttcaggacagatttggtttatgtctgccctggcattcagaaggtgacaagtggagcccggaaggctttcggactaacttctgtaggcccgtgccctctatggccgcagaattggcttcttgttccatgttgctgctagtgctttttgtggccccagccaagtcggttcctatctttggaccacagtggacccatcgaggggctctctggagtcctcccagcccacccttctgtgcctggccactccaatcttgcaggacactgtgctggaaactgacttcaagagtaacactgttgtggctcccacctccggggacttcataggtttgagtatgtgtgtgggaatgtggtctgttttatttactcttgctaatgaggctgaacggagctagtgagggcattaaaacattttagtgttattagttttaaaattagcccgagctgttaaggagagtccctgctcactttgcttatgtgagaaaggggcttctgaatgccaaggttgaatgcccagtgtctttcatcctaaaaaagacaactttatgcgctatgcgttagaatgaacagggaaactttaaatataatgatatggggtgcctgggccccacctcctcctttgcttcactggccctccctggacatcagggggtgtggtttttgcttttttgttttttaagttttccaagtggttctcgtgcagccaaggttgaggcccaccgggctaaactaaaaacgttttccggtgtatgtgggaggcaggtaggagggagggctggcgtgctgcccagctgtgtaccatttcctgcttggtggatgctcagggagtgtttgccagagagctctcatcggatgcttggcatggctagttcagatgctatggacagaggggttcctgtgggaccagtgcttctcagtcctgaaatcatgatcagaatccccccatgatctttgagaaaatacagattcctaggcctcatccacattggccggaacagaacctctgagggtaggaatgaagaatctgttattcctgttattcttaggaatagtgaagcttcccagaagatgcttttgattcagaaaccaccgaaaggggaaaacttgatcctcaattcctaggagtgaagattttacattttccttttggtcatctgatggccctagggttcactagataggccacttactcaccatgtgacccggacaaggcattcagcctctctaagcctcaatgtcatcatttgtaaaatgagagccataatggtttctgcttcctaagagtgtttcgaggattaaatgaggtaatatgcgtgtttggcacattgtagatactcagtgtgttcactgccatcatcatcatcagcactatcattttgtaactcagatagaagctacacactgtaagagcaatttctaagatttaaagagaatgaagtaaaaaattctggctgtgaagtctgaggcaaatctagaggctagtgggggtaaattggttttaaacttgtatctgaaccagaagcttctctggagagagttggagtaagatcacacaggtaatcctcaagacctgtttgttaagagtacaaagccataattgggaaaacagtgaggtcccgattgtcatccagaatgaattaatttacatgcacttatggagtgcctcctgtttgctcagctttgtgcttggtggcatcacatataaaaaggaccaggccgggcacggcgggcggctcatgcctgtaatcccagcactttggaaggctgattgcaggtggatcacttgaatctaggagtttgagaccagcctgggcaacatggtgaaatcctgtctctactaaaaataaaaaaaaaaaattagctgggcgtggtggcatgcacctgttgttctagctacttgggaggctgaggtgggagaatgacctgagcctggaaagtggaggctgcaatgagctgtgatcgcaccactgcactccagcctggtgacagagtgagaccttctctaaaaaaataataataatacatgaaaaggactggattcctttctttcagggaattggccgtctggtctgggaagtacaattagctccctttgaagaacaggagcaggacgagaggatgtgtaattaagtgctaaattgtgtcactaggactctccagggctagatgattcaaggatggcaacacaatgagccatggaggtggctgggggagcctgttgggagagtagggagggatctggagcaggaaactacaagcaaatccaaagagatatccaaggagggtcctgggacaagagtgacggctgagatggggatgacgagcagctgccctacctggatggaaggtgagggtccctgttgtcctggagctgcacagccacttataactggggtcatctgggtctgtggccccctgacagctggtggtagtctgcaggcatacactccgtgtcctgtcgtgagccggtcctcagggcggcatctgcccaggaagccacaggcacacttagcacggcccaagagcactatctgcaggaggcgcttggccccagggctgagctgatggtggttgggtggggtgtaggcgacaggagagcaggtggcctccttcctctgtgccatcgcttagagggtatcggtagaaccctctgtcccagaagtcagctccgtatctgtgggtcttaaaaaccttctgatcctgtaaaatga

SEQ ID NO: 144 - DNA, 1175855 bp, Homo sapiens
  misc_feature (271227)..(321226): n is a, c, g, or t
atactgaaatactctgcaggtcaaaacagaaatgatcatttttctaaagaggctgtcaggagtctcacagtcaaatatgcataaaataggacaacctaacacaaataagttgggaggggtggctcacacctcagcctcctgagtagctgggattacacacacacacatgcatgcacacacacacacacacatacacacaaagagaacaaaatggttgtaaggagagggggacagcagaggaagtgctgaatgacacagtccggcttcggaggaaaggacttgggtggcacttcagaggagacaaatccagtgcaggtagttttgaagagggcagccgtttaactgaggtagggggtctctggggacagggcccctccatgccagtccacccaccttggaaccctgcagaggctgggccgaggcctctccctgcaccttgtatcagggactctggccaggtcacaccaaggtggcttatgacccattaacatcaagctgcctccctgggctggacagggcctggaaagaggtgacctgggcagatccgtgtcgatgtacttcccaggacatcaggattccagcctctgctaaagggatcttcacagttaataacaaagaaatattaaagatgagaacacttggtgcaggaaacaagagaggaaagggagtgcggtccctccttgcaaacaggatgccctggaccaccctccacggcctcaggcctggatgctcctgcagacccatagccaagattgtgaaggaaaagtaggctgtggaggcattttctgtccttgttatcatcattgtaaacatactcatcatcaccatcaccatcctcatcaccatcaccaccactatcaccaccataatcatcagcagcagcatcatcaccatcatcaccaccactatcatcattaccatcctcattaccatcactatcaccaccatcatcttcatcaccatcctcatcaccatcaccatcctcaacaccatcctcaacaccatcatcaccatcactatcatcatcaccatcaccatcctcaacaccatcatcaccatcactatcaccaccactatcatcctcatcaccatcctcatcaccatcaccagcctcaacaccatcatcaccaacactatcaccatcattatcatcatcaccatcctcatcaccctcaccatcctcatcaccatcatcactatcactatcaccaccatcatcatcaccactatccttatcaccatcatcatccccaggcgaccagagcagcaccatccttatcctcatcactatcaccatcaccatcaccatcatcaccatcctcatcctcatcaccatcatcccatcactatcatcaccatcctcatcacaatcactatcatcaccatcaccatcctcatcatcaccatcgtcctcatcaccatcaccgccatcagcatcctcatcactatcatcatcaccatcctcatccctgtcaccatcatcgtcttcatcatcatcaccgtcatcatcactatcatcacaccagctctgtgcaaggcccttagataaagggcagcctggggctgacctcacacaaggataggaagccccaggtgagcaatgggtcagtactgggtcgacaccagatatccctgggcagaggccctggcccaaggatggggaagggaagaggacaagggatggggagtaagaaatgagggcccctcgcctccctgggacagcccaaggtgcagcctttcctcattcctggaggtttcaggatatccctgtgctgcatcctcccattgtacggtgagggggtgactgccaacccactcctcagatgaggcactgactgaggcaagtgccttgctggccaccttgcaaggccaggagacagtgcacacaatctggactccaagatctctgcccacccccatcttcatcaccactatccttatcaccatcatcatccccaggcgaccagagcagaccctgagccccagggatgacacagcagggaggggcagccactctgggctccccagtcccccatggcacctcaacctcagcccaggaggctgccctcccagggatggctgaaagtgggccctggggtcttgcagccctgggctcagatgtagcctctgcaccccctcacagagtaggcagagaatctgccagccccctccaaatctgtccccacaccagtgatgtgaggacaatgagaggccagcacctacctccccccaggaccccaaagaaaccccacccaggcccccacccagcatcctgcctccccagaggcctgccaatgtgacctgggtcagcctcgtctcaggtgaggagtccagggaggcaaggtacagctcacagcgtcccagagccacacggacccctctgctccagcggtcttgcaaggccactctggcctggcctggcagtagccctgctttattgaggagatatggcaggcaggatcctggctgcatctgggctggaagagggggcagcagccaggctgtgctacaaacccacctggagccacttcctcgctgcttctgcccatctcagcctcagcagagaaagaaggcttgaggacaggcctggtgcagcctgactcatctcatgagagacccggcctgtgctcagagtcgagttgctgtggcttctcatgcaacactgatggtccccctcccctgctcacccaccatgtgttagacacggggatctgcatgaaagacacgtgttcctccccttccagagacccaccgaaatgagggtgatgcagagtgaggagtggggagcacagtggcaggctgctcccctggagaaacacccagagaaaggggttccaccactggtatccaggagcacccagggccgatgggcagaagaaaagctccatctcagcagagcagccaaccagcttccctcataaaagtgaccagaaaaccagtgaccaccaggcatccggaaaacatatcaatgcagaaaaagagggagaatgatgctagaggaagccgacagtgtgggaaaaagacaaaaattaggagaaacatctaatttgtgtcttcctaggcatagatggggatttaaaacaagaacaggctgctatgaacaaggaggcatcagacaaaaagaaagagtgcctggaaattaaaaatagaatcactaaaattaaaaaaaaaatcaatacaagtgttagaaaacaaggtcaaagaaatcttccagaaagaaaaacaaaggagaaagacaaatgaatgagatttgggagacaaatataggttgaacatccaaggggagttccagaagagaaaacaaaaaaactgagaaaagctagcaaagaaacaataccagaaaacttcccaaagctgagtacccagtcctccactgggcattcacagtgcactttcaggcccccaggggtcaagggaagtctgaagctccaggaggagaagctggtcacaaagaggcaacacgaagccatgagcagcagtgcacgccggtaatcccagcactttgggagactgaggtgggaggactgcttgaggccaggagtttgagaccagcctgggtaacacagtaagaccctgtctctacaaaaaattaaaaagttagccgggtgtggtgatgcatgcctgtaatcccagctacttgggaggttgaggtggaaggattgcttgagcccagaagtttgaggctgcagtgagccatgatcatgccactgcactccagcctgggtgacagagtgagactttctccaaaaaaacacacaacaaagaagatgcactatggtattggcctccttcatagcacactagatgccaggaaacaacaacactgcaacagcttcatagctctgaggggaaactaatttcaacatggaattctagaccgaaacaatccagcttgaacatacttgtaaatacaggaagacttccggaatgattcttcaccatatcttctttagagagtgagtcaggcttatgtttcagccaaaatgaggtgcaaacccagaaagaggaaaacgtggggcccaggaagcattaactgaaatttcaacaggtggtaaagggaagttatggggcagcaggacaagtgcttggggtgaatctttatccagggaaaaaaatgagaccccaatagaagccctgatgtggggaagagtaagcccatgagggtggtggatgggtaaaaaacatcaactgtaagccccaaggaaaacaaaaggccatgaaagagaaggaaggtcacccatcccacggcaggattgagaagaacatttatgggacctgggttgggaaacactggctgtgaatttaactgatggcagcgagacagccatgctggggagtgtgctggaggagacagagctggagtagaagctgaggaaatgtggcggcaaccactggcaaagccagggaacagaggcgacagtggctgcctcccaggaggacgcggggcaggggcagattgagcccattctccagaccagcctccgaggctgggtgcaggtgttaactctgcaatatgttgttgaccgaatgttattattttttaaaacaactgcatatgtggcactaaaatctcagaaaacagataaataaaaagaaaaaaaagaaagtgtatcttccagaaggtggagacaaatgtaggttagaagcaggtgtctccaaggtgcaggaggagagcgagggacagtgagagctcaagagcacctggacatacagccccagggcagctggcatctggccagggaggatccacatgctgctttttggtcccctgctcggccaagggtggctgaggatacatctgggtctcccaggacactatgggctcttggccccagagactctgcaatccagacacccgaaggggcagcttctggcctaaaagcccaactctgtgcttgggccttccctgcaggccaggcagctgcttccctgaaccagcctcagagttcctgcctgcccacccagcccagccctcacactgtgatgaagccccacccctggattccccttacccctgcccgctcctgtcccctccttgtcacagatctgagccccccactccaggctggggcccctcaggagccgggggtaggggtgtgcggtcaacacccagcaggggtcgcctagcactggggtgggtgtgcagcccccagcctcctttctgaccgtgcacacgggcttctctcagctgctatgagagcccccaatgcgtctccacaaccaaaccgaggcacgcacgcagcggcgacgtgaataagtaattgctcttttattaacaagtgataaattattcctatatgattgtgtgtgataactcttccttatttgaaatcaatttgggatggaaactgttgtcggcttctcatccacgagggtgggaggcccaggtgccgctgcctcttggaaaacgaggtcagtgtatttcagctacttcctgaggctgatgcgccgccccactgcgcagggccagtggaagggggtcagctgccctccgggaggcggggcagtccggccttatttcctcagcatctctgtctgggacccacgccactgagcccagggcacagaggggtccctcaagtccaaggccacactgggcgtcaccacagggtcatcaggggtcagggggccatgcacaggccatactgcattcatccccccatgtaagccccaaagactgggcagcctgacctttcatcccacagaggacactccagcacccagctggtctcctggcctgcccgggccaccccacggtggcttctcaaacctgcaaaggcataagccattctcctaaaattgtcctgatgattttacaacagccctggccccatccccttttcttcctcccccagcctcacagaggagggttcagggactcagcctgttcagggcagcccctgggccaggcctcagcacctcttctgttaatgcatatttaaaaccttgcaacccaccgggcagccagccagccggtgcctccctcccaggccaggcctgcaggaagccatgccccgtcccgctcactcctccactggctgcttctccgaccccgatcatggctgcagcaggcctggaggcccggtcacccccaggcccagtcacatggccctactcaggcaccacctgtgcttcttggctgggtttctcatctgagaaatgggaaggctgggtctgggtgaggcacttctgtgggcccactcccacggtctccttgacacccctccaccttctgcccactgccagggtgcccattccactccacacctcgctggcccacttagcaggcttctgtgtagcttgtttctgtcggttgaggcaccctgggctttgggctccacaggggctggtgacccgcatacaggaggtgctccataaatgttagtcatgtgaatgcactaaatgctcaccactaagggcaagtggcaggctttgtgcagctatagagacagcattccccaggatgtccagccctgggagagagccttggcccacagcccatgaggcaacggatgttcctgggttgggggcatggctccagcaccccagtgccaagggcacggtctctaagtagcaacatggatagctttacttctgttacagctccatgtctgcgtctcccccagattcacgtgtcgaagccctaacccccagtgtgatggtatttggaggcggggcctttgggaggtgattacggttagataaggtcacaaggctggggccctcaccatggcattagtggcctggaagagaaagagacctcagagagtacatgccctcctctctctccacccttccatcccctaccacgtgagggcacggtaaggaggtggctacctgcaagccaggaagggaacttccaccagaaccagcccatgctggcaccctgatctcagacttccagcctccagaactgtcaggaaatgtgcttccgttgtttaggacaccttgtctatcgtattttgtcatggcagcttgatcagactaatacaacttctttcttaaaactttggtgtatttttccagattttctacaatgaacatgacctcataaaatcaagagtgtttttcgtttgttctgtttggtcttatgctgacactgggccaggtggaagggtgggtgagtccgtcttgcaggtggcaggagccccctccatgagcccccacaccccagggtccctgcccaacgtgatcggccctgcagggcagtcctggaaccagttcagggcttggggccctggctctgcctagggaggtctcaggcaggccccccaacgtctcagaactgcttccctcagttggaaatggagataataaggcccacctcatggcacccacaaagaatggggcagcctgcacctggcctctccctggaggaccttctcacatcacccccggagggaccaccatccccaccccacagaggagaaagcccagctccaaggccaagttgcagccaggaagtgctctgctggcatcctacctggccctgacgccaggcctgaagccagcaccacccggggctctgttgctccaaggccattgcccctgctggcgtttgctcaaggagctccccctccagaatgccctgccctattcccagacacacttcctctggggggctcttctcccccagccccacccctgccacccctaaggaggctggccccttcccaatcccttcctcgtctgcaccactgccttgcccaaggtgtccatcctcagacccaatggggccaccatgggagcccggctgggtaatggcccataagctcctgcccatggagtactcaggcagggaggggcacaagcttggctgagcatgagtgacaggctgggtgggtctcaacctcaccctgggcctggggtagccccttgcaagtgaggatgttgaacacggtggacccccaggcagaaagtgagccacggggggctatgcaggactgcagccctcccctcccctcaattcactggtgagtagcctgctactcccctggctcccagggcagggccctcatcacctcgagacccagaagcagtgatggagaccgtcctgcaacatcaagctccctgtgatctgggggccaggggatcctgagtaccctgcctcctggagtgctctgcctgcagggggcagtagcagcaccttcaggtggggtggttggggtggcttcccggaggaagtgataactcagctaggagtggggcgtgggggtggtcctgacatgtaccaaggctgggggtcaagtgtgcactgtctctcagccaggagggtggaggcgctggaccaaggctgggggtcaagtgtgcaccgtctctcagccaggagggtagaggcactggaccactggggcctcaggtgtccaggtcacttgtccctggagtccctggctatgacagaggccctggtgggcagctcggggttggggacaggccaaggcataggggagggcacaaagggaggttggtgccccacccatcacccatcatccgcctcaggccaccccaggggaccggcctccgctccggcagcgggtgaagaatggactccattagggccgccatctgtctcagccatgacgggtcctcgcggtgacatccgggaggtatgtagatggaatatctttatggggagagtttttcttttgccagttttcaaataggaagccagacacttgtcacacctgtccctgtgtcagcctctgcctgacataaattggggccgaggcagggagatgaaagacagcctggaggcagccgggtgcgcagggcccatgtgtcaggccgagggagcaccagagctgcaggcagcctcctgctggggccaaggagagctcgccccgcagtccacctccgcagcctctgcccctccctccactcccctctggacccacaagttcttcacctgccctcccccaacccagagccctccaagcatctcacccgggcagtggcctgtcctgcagccactgggcttctgttaggggacactggagcctcctcagcccccaggccagcagctccagctcctcttccagacctggggccagtgtggctttcatgagcggtcaatgtgggaggctcagagtcctcaacctcacccccgctgccactcctagggaccttgtgggcttcagcatgtttccctggaatctgggggacttgggggtagagcatgtcaagaacctcaaggtccctgccgcccagcatgggactatcttagaactgatgccaggaagaatttgctaagagaatgaagggagaagcaagtgacccctgtgggcctcccctgcatcggggactggaccagggcccactgggagtgcatcttggtgcctgaaactgcaccaaggatgaggaggggaggaccctccccaggggacacttggggttcacctggcaggccacactcaagtccacagtcccccatggccccagcgggtggggcaggggacgcacccagctgagggaactgtggcagtcctgctgttgtctcacgtggccctagggggctcatctgtagcccccacgggagccccaagaagccaatccctgctgggctcatgggctaccacctcatacagccccatccctcgggaggccctgaggagaccctggggctgggcagggcgtgaccggccagctccatgcttcctgacaagggggcctggatgtccagggagagccaggagggaagcggagactcaagtggagagtgtgtgggagggaacgttgctgggctccacaaaggagggggcaccagggctgactcccaggttcctggtggcatgcgtggaggcaggtggggccaggagcaccagcgcagcacatcctgcgtgaccttgggccagctcctcagccctccctcgacagccgtgctggtagctggccaggcccgggtgagtgagttccccaggtaggtggaaggggcttctggggtaggggccacgcccgggggcaggtggcccaccctcccaatacccagtcccaccccgccctaccacaactgaggactctgcccaaggaccagtcagggacgaggcatcctctccaactgcactgcaaggccagcacaagtgaagggcgggacagaagcctccacacaacaaaggcagaggaccccatacttctctctgagtcagtgcagaggtcctgcggcagagctcctgctggaacccaaactgcgccgtaggctcctcactgagaactagggacttctccacatgcacccagcctcccctccggactccacagctgctagccctgcccggaccctgtgcaccccactcccaccccgtcatagcctctcagccccactgtcatttgggctcccctggcatgaactaacgtgtctctcaggatgtcctacgaggaccctcacggcagaaggaccgatggggaggagtggccccagagagcagttccttctctgtacccaccagggttcagcagaggctcctgctccaggcagtacagtggggcccacatgcccatcctcactggccacatgggctggtcagagtccagcctggatccccccagggcaggacaggacaggtaagaagggctgaaaacctgggaggcctccaggaggtgagggacctgccaccccttcccacaaggccctaaggccccaatcactagtctcgatttccacagctagtttagtccaggccaggaaagggcgtgcaaggggcctggcctggaagaaggggtccctggagccaggtgcaccaggagcctccagcttgcccaaatcaagctgccactatggccgggtcctgtgggcagtgctcactcaccaccgctccagcttcacgatagccacgtgcggacagggaggctcagagggtaggtggctccccgggggaaacagagcaacccttgtgcagccggctgggccaactgatctgcacctaacagccagtcttgaaggccaccaaccctggggtctcccggagctgacccagggacagaagggcaccaggcactgcccacaaaggtgcaactgatcctcctcaccggcgcctgggccctccctccctgccagtgtggctgtcccacccttcatggctttctgcatcctcaagctaggcctgggctcttcaagtggagaggggtaggcagacacaggtgccaggcactgggaactagggacgggggcttccctggtgaggatggaaaagaaggttcctacatgagaccctctagcccaggccctgagaacgaaggggccaaagcttcacctaggggcagccatgggggagtttaggcaggcagtgcctggctggaaacatgtcttagggaagcacttgaatcccggggtggggaacaagatggtaggcagggagccggggccggctgtggccacaggccggggacagaggccaggtctgaggatggccctcagtgaggagtaaaggggatggaccgggagacagggtgcaggtttgacactgattttgcctttggggatgggtcgagggaagaggctgagactctgggcttggacgttgggtacggaggatgtgacactagcagacaggctggatctggaggcccaaggtgtgtagtgtggggagctgtgtgtgcaggagagatgcagggcactagggagcctgaacccctgctccagtgcacaggccgggcacacggcagggaggaggcagtcaccattccctcacttgccgggacctgggaggcagggcagagtgggtgatgggccaggctggggccttggaatgacatctggcatgtggcagcggaggggggacatgtaactggggactgtggactcccagctggaatccacctccaccttccacatccacgcactgcattttggtctttactgagcacctgctgtgtgcaggggctgctctagcccctgggaccaccaagggccagccctccacaaccccagacctgcactcagcccccacccacttcctccagagccccacaccccacacactgaggactctaggcattttcccactcttgaagacactgagctgggaacaccacctctggctaccagccgtggactgcagagaggcctacggtgaccaggaagggtggagctgcccaaggtcacacagcaagccagcactgcacaagcttacccatggctgcccagccttggggaatgggggacttctggcatgtccccgagctgggccctggcagaaggcaaataaaggcaacatctcaacaaggttgtgatagccggggatccaggcaagcaagggacaatccaggaaggctcccaggaggaggtgaggggcctggagcccaccctggcctgagcccctccttggcactccagcctgcctagccctgcccccttccttgacgggcccctcacccagcctcagccttggcctgacatttcccgtgacatttgctgcaaagaaatagagtcataaatccaaaggttaaatttgcacatcgcctcaaattgctgggagaagcagtggtccctccacccactgggcgccccgtgggtgcggggtttgtgtggcagggtctacccatcccagggcccttgctggaggcccacaggtctcctcctctggtcctccggggcacttcaaccactgtttcccaaaacaggttcctgggcacaccaggccctgaggtacatcgcataggggtgcctctcagagaaggtgctgcccacccctctccaaaacagggcccaagacgccctgcgggaaaggagcaccatcagcaccatttattccagcaggtcccacatttgaccacaaagcccttatgtgatacccccaacattccaaagaatttcaactccatggaccgtgacccgtgacagccagctaagaatgccagggtgctgactggagagccaagaggcacccgggggcccagggcaggctgctctgagtgaggctgggtcagcacccgacacctcactcccagatcagcccagctccatgtgccagggccctgaatggggctttccacctgccaggcctgtgtagacctacatggggaccctggcctgtgcccactcagcccctcctaaggccactctcgaggtgtgccaactgccctgcctttcttctccacctcctggtctggctgctgtgggttgcctccatcggacaggacacagctgcggaacagtgtcagcatcaccccatgccccgctgccctgctgccccgcagaagaggccccgcaggccatagcaggcaagaccagaggctgtatgaaagaggcaggggagaggtggccccaaggcacccactgcacaaatggctgcccagactctactcactcaccatcacctacccggccagcccacggttgtcaaagcctcagtgggctaggaggggcaggatctggccctgctgccgagtcccctgaaatcagcccaagcatcgggggagaggcacgtgaccagaccccagacctggtgggtgccagctgaggacatggtggggtgggtgtgcagagctgcatctcccagtgtccagctccacggctgcaggcagtgcaggaggccggtgcaggtttggataaataaatgatggtgcattctcaggaagggattccacacacaccagaaaacccatgatgcacaagaatagttcccgatgtgcaaaatgtttaaaatacagcgataaaagaagaaacggcagcacagaacacctggtgtgggggagcccagctgggccccagggacagtgcagggagatttgtggggtggggcagcatgcccgccgctccgatcgggcttccctgggccactctgtgacctcctatcctttaaagcatttaatcctagagatgcccgatgccaaggatcacaccccttgatttgcctggctcagaagagaatctgacaggctaggaacgaacgagtgaatgaatgaacaaatgagaaagtgaatggatggttggggcaaatgcagcatctgggatctggctttgaggagggtgcctgtgaccttggcctgggtgcagccagaccgcagagcagggacactgaggggtgcagagagggacccgagagggcatctgcacagctgcagaggcagcaggcggccaagccagctcccgcagaccctgaggcccaggccctgggtggctgcagagggtcaggcagaccagcctgggggtcagaggtcaggctcaccagaatgggggcgggacggcatgaacctcattgatcagatagtagccaagtgtcaggagccctcactaaccctgtgccagggccgggcggggcgcctggctcacacacgcatttgttcatttccaggtcatcctgaaactccccgtgtgcttcctgctcttgacccctttcccaggtgcacagaccaaggctcccggtgagaggttccgggccacaggcccaggacagcaggagggctcctctgcctcccgcccgtcctgtcctcaccagctggaccctcctggtgttgcaccggctgcacagggccgtccgtgccacaaagcatgaattcaaggctggggcagggacgaggagagggcaatgctacaaggctgcactgttcctgggcagagggagggggagagcacggtcccacacaccctggccctcacagcctgcctgtcactcacagcaacagcaaacaaaccctggcccctccacaggctgtgggccagttcccagcctcccaggacagcaggaccttcccccaccttccagggccccagcccctgtaggggtgtcctccatggaccctccacaagccctctggctttcagagacgtgctgggccaggccctccctcagcctctcccctgcttctcactccatgcaaacctacgtttctgccagtcccagcagaaggaccctggcacggggaaactgaggctcaggggttccacagacccccaggtgaggaacagggggagggcagggagggagtgaaggtactatgggagggtctcccaagctgggcagcatccctgccctgtcccctctccactcacctgtggcccgagttgcctgactaggggcttttattgtcccttctgcacatggatggggtgaggggccagctggcagtgcaaaggtcccaggaggactctgctgagtgggggtgtggggaggtgttgtgggcattctgaggcagaagcaccagagtcagaactccacagggaaagccgggccaattccgcccagcctcagcctggaagtgccccgataatccctgaccactggcccatggtgcaggtgaggaagactgaggcagagaggcgacctgtcacacccaaggtcacaccgccagcaggtggctgagccaggacccaaatccaggtcacggttctgccacggcaggccctgcacgtgcccctctgccaggtggcgtctaggtgctgatggccacccattcccacccccggcatgggagctcacttcctcctcacctcagtagagaagaacagggaacagtaccccctttatagatgggaagactgaggcttagaaaaagagactggccagccccactgcttcagctgcccctctgctagtatgtttcaccctcacacaacctacaaggataacctgctggtccccactctatagatgagcctctggtggtggccaggggagcaggaggtgtggcctgccaatccaagccccagcccagggcccttgccacagtgctagtgggccacccttgcccatcatgcagcatggcatccatctgctcagcaccctacacaacaccggaggtaggggagcccaccacagaacccctcaccaagaaggtcctcaccatggagaaactgaggcactggaggcggggcctctgcagtcacgctgggtcacgtgctccagtcagccaagctgcagcggccaccaagggtgcccagggtctggcctgttggtcacagtgttgacctcatggcctgaaatgggtcttccctgcccagacaggttccagcccaccatcatctatctgcctcagccctggtgggtagggagtggctgggagaccctgcccctcacaccctgggctttgcggtattcaacgagcccccaacacacattccagggcctctgctccagattaggccacagcctgtctaggcacacaaggggcacccacaccctggaggcaaagagacatgcctatgtgcccgcaggcacacatgatcacgcgcacagacacacgtgcagatgcataccaagttacacacacgcacacaagcccgaggcggggacccccaggacacggaggcaggcaggcagaggtggggcccaggatgtcttgcccctgtctgtgggcctggcctccccactcaacagacgagcatgtgggtgcgggagtggttattgcgaaaggggccccagcatgtgccacccgtggagaccacagcaggcatgccgcgtgcatgcatgtgtggccgtgggtgtgcaggcgggggcgaggacacagatatgcaccctcagagtccgtgtgtgcacccagtgtttgtgcatgtgcacactggggcggcgttggcttgcatgtgcaccagaggtgtgcaagtgtgcagtccgtgtagacaagtgcacgtgcaaggaaacgtgtgtgcagcctgcggcaccatggacatcagcagggcagcctgggtgggcacctggggagcaccctccaggcggggcatgcccaactcacatggagcccaccctcccttgcccgcaccgcgggacctcacagccggtggggcgggggagtcccacgagggctgctagggaggggttgctgattgccccaccgcccctgattcccccagccaagcctctcaatgtccctcgggctgcagatggtgggcgttgctgcctcctctcaccgcccgccctggaggcagcgctgggacaaccctgtcccccacgccctctactgccgccaacgcccccattcatcccactgtggactgacctcggagaaacgggaggttctgagcccagaccgtgaggctggggtggaggcggcccgacacccccacccaccctcggtacccacgtttctgcaaaaacccgctcgttaaccccttggtggccggggcgctccgaggccgggccccgcccttccagcccacggcccccgccctcgacttggcccagcatcggggaccctcggaccgccaccctcggccctgccgaagccgtcaactttcccgggaagcggcaacttttcctgccgcctccggctccgccctcccggggccggggcgccagcggccccagcctggcgcggcactgcggtggctttccctgccgcccggctacgcttccctcgcctcggcagcccgggacgggccctgcggctccggggagggggcgagccgcccccctccgcgccccgccgccggccgggctcgggtgcagcgcggacactcacctccagcggacgccctcttcatcgtaggggttgggcggggcgcgtcggggactgaaagtcgtttcggggcgggcgcccgtctccccgcggccgggtccgcatccaggcgccgccgctacggcccggccccggcccggccgcgggacgaggctcggcgcgctccgctccgcccggctctggctgggctcgggccgcgggtgcgcagggcgcgcagggcgcacagggcgagggcggcggcggcgcgggggttggggcgtgggcggcgcggcgggccggggcgcgcaggccgggccgcaggaggcgctcagcccgcccggtgcaccggcgccgcgcggtcccagacaaaggcggcgcattcctgaagaggcggcggcccctgcaggcggcggaggggatggcggcccgggccggagccggccggggacgcgggcccgagggtgtggcggcctaggctggcccggtccccaagcgggcaagggctttgtcccgaggcctaggaatggcctctgcctgacccactcccttcctggcctcacgaaacccatgaatcccccgccccctgcacagaagccccttgctgcagcacgatcgcccccatttttcagtaagaaacaggctcagggcttaagagagttctgggggccctcctgggcctttgtggccctctctgcaccatcctagagaagggacctaggcctgatgttacccgtaaccctgcaggggtcccccacctcttcccttctgcggaatgggggctccaaacccagaagacgctctccgaggtcacctgcttagtatccccccactctaccaagccagccccccacgggcggtgtgaggcatggggccagagaatccagtgacgcccctgcacacaccacacaggggtgcaggtgtcccttctcaatcttctgctcggggcacctaccgggcctcaccgatgagctcctaagtgcatcccggggtcttcagacaactgccaggctgcccctgcacctggagaagtgctgggagtcagctcagccgggctgggtcctccccaggcccaccctgcatgagaggaccatgcagatgagggtcttgcaggcccacctggtgtcagtctgtaggaccctgactcaaggacggagtgggccagcctgatgccttgatggcccccctcagagcccaggtccactgatatgaagcagagagacctggtgactgggcacccctgtgccctctgcctgcccctggccatggaggtggccctgagggagatgagcagggcgcagggccggtgacctgcctgccttgtgcagaggaagtgaggacctcccagagccctggtgctcccatctgatcccagtggcaggcagcttcgcagggtggagccatgctgggtgggccctctgcctggtgtggaggctgcactgcccacatgcctctggctgccgctctgtggccctcatcactttggcctgctttatccctatcacccttgtcccagcctaggcttatgagggcattgtggagtgcatgccattcccagccacacagaaggtgaggtggggcccagacacccccagccactctgtcccctggcctcctgaaggggtgggctgtgcacacactgccacctccccagagggtgctggctgccgagtgccaccagctcagcccctgaggtggctcaacaggtcctcccagagccacaccaagacgtcatcacccattgcacagatagggaacctcaggcgaagctcacagagccagtgggaggctgaggcctgacccccagacaagcattcttctccagggtccctgcacacagcagcccccaggctaggaactgagctctctccacagggatgtatcagaccctagatgagtcacgtggcactgaccatcagtctgaggacagcgctggggtggaccaggctccagtctcgggctgctctgtgcttgcagaaaggccttgagaggacacttgcttgcttactccgcaggcgtctcttcaattaccagtgacccagagcagcccactatagctgaagattgtgaccccacaccctatctcataggtttaaagcccctcccacccctcctgccgcagccgaagtgaccattctggggcatgggatgggcatggggtgaaatggggagcaggggtggccctggaggcttctggcaccagcaccctctccagccaccaacctggctgttcccggttgctctgcgctgggacctgggcctccacctccccacaggtctctgcatgggagcagggctgaggcctgcagagggagcgctgggggatgggctggtttcctgtgtccgccacctcggtcagcacgttggccagcaccctccccactggaagctgggcccactcctgggtgctagctgggatggttaggcgtcggccagcgctgatagggagttatgggggtgcagaggcagagttgagcagggctaggcagccggtgggtctgctaccagcaaggcacagcccacttctcaggctgcgcatgtgggagggtttggtaagccacatttttcagggtgtagccgggtgaggggtagcatggggagtggtgtactctttgggcaggcgaccacggagccatcaccccccagggcccaacgggcaagaaggggagcagctgacggctggtgaggggctagcagggagggcttgacaagggctggagcccctggtcaaggggcacaaccagttctatcgggtcaccttgtgggaggagccagggaccctgtgggcagagcctggccgtctgctgcccggagtctacaccagtcagttcctaggaagccccatcaggggtgctgggaggacaggccatctgtgcccagctgatgcaagctcccaggctttctggacacgtggccctggggatcaggagtgagctggagactgcagacagctgtgccctcagggccacacagacctgtcacaccctgcctggactgggtcagcagggccacacgggcatctgcccgaatcgttccccacctcacacccaccatgtggggcacattctttgccagcttccccagcccaccacccctctacagtgaggccaggggctgtctcacctcccacccacacccacacccaaaatgtggggctcagcctccacgaccagcatgccggtcatgagggccctgcccagctgtgtgacctcagcccagtcccttggcctcgctgagcttgcacagcatgtggacgaggcagacgctaatgcctcaggtcctggtcagctggtcaccatccctcctttgttcacctcgcctgtcccctgagaggatcatgcagggttttcactcaaaactccaggactgcccatagaagccagcttgagatgaggggaactttcgcggtggcctgtcttgggctgacagggacacggttcagcctccttggaaggtcactgcttcccagggcttgggaagactcatctcctgcctggagagataggcgtgccatggctttccttggcatgcctgtgcggtactcacggacatccaggccctcagtgtctcctggggagggatggggcagcaaggaaactgggtctttgctccacacattctgggccactccaggccaatgcaaggagagaccaagaaggaagctagaaggtcatgtggcaagcacatgcctgctgcccaagtgtgtcaatgtgactgaccttccctgcactctgagtgggcggctggggatgtggtcccagtgccagggagctggggggtgttggcctgccatctgctctcaccatggagggcggctgcatgcccaaggcctaagaggactctgtgccaggcctgctgagtgagtcatcccattcaatcctacagtgtagacactactaccactacccattttccagaccagagaaggaggtctggggagcttaggtggacccacatcttggcagcccctttctgccctctctttgtccacagcctccgcctcctccagaagcctctcaccatcccccatccccggggctgcagagggtgtcctggccttcccctatcagctctgcacccctgaggactcccatccctaggagtccctctgcccaactttggtgcatgttaagccataattaatctgcttcctcatctcttattcatcaaagccacagcagcagcaaagggggctggcacaaggaagggaccgacaaccaaaccctggcagtggccccaagaatcccactgggcctgcccatctccaaatgcctctgacccttcactagcgagggcctcctcccacagaatggcatcctggattgtgccacactaggcaggccccctgacggaccatgcgcacctcccaccacctggaggctgctggggaccgtcaatgggacgtatgcattgcacagtgatggcccttacctctgcgtcccccagccctggactggatcccttgtggcccatctccaggatgggagcctgaacggagatgaaaggacactcggccaagtgggacatgccaggctggcacctggaccctggtccgccactcttcctggtgcctagaggaaggggtgagtccccagggctcctggaccttgagatgagcctcgggccacttgtgtttgccagcagatgggctcagggtcttctctcagtgggcacaaccgagttggtggcctctctctggggaggccggctggtgggggctggggagtaggcggcttctggtccctgaaggcccaaatctggtgcaggggcagagctccggaaggcgggggtccctgggctgtgcccaaggcatccgctgtggcttcacgcccctcccccgcccctgcagggagtgtggatccttctagagccacccacctggcagtgacagctaaattgggagccgctgttcacaccaggagcccagcgggcagtcaaaaccgggtcgggggggaggggcacccgctgaaaacacccacaagctcccagtggggcagggaaggcagggaaggcatggtgatagctgtcagcaggagtgggtggggagtggaaggcagggtagaccgccaaacccatcttggggccatagtgagatggcccctgggatgcttcggctggccagtgcccagccttgctcttgtaggagctccctgggcccctgggttccccactctgggccaccacaatccatgcagcatgcaggtttgttccgtttcccagatggagaggctgagggcttaccacagggttccgtcaaggacgcaaaagggccagcctgactctgagctcagtagccccaccctccacagcctcccttgccgccttcatctgctcacttcctcagtcactcaacaaacactctgggaggcagactgtaacaccctgcatacctctgctggacccccattccacatatccccactggttacaggtggggaaactgagtgcctgggaggcgggccttggcctgagtcccccagtcagtgattccaggataaagggcatagccatgccatttggtcacttgaagcccacaggggtgactgggaagagcccacctagcaccccacattctgctagggtgactcagaccaagtccttggggctctgccccccagccagtggctctgcctctgagagccatgggacagggagctgtgcagggtggggccagcagagcctgtgcccctgcctgagctagtcgtgatggggcctgccctgaccccttcccaggctcatgggtgcggagcagggcggggccttacagtgagatgggggcctctgtgggcagtcctggaggccaggccctggggctgggactcactggcacagggcctaagtttcctcctgtgtccgcaggccttattgcctgcaagggaggtggaggggcacaggggcggtgcccagcgtgaggagggggctctgaggaggctgcagcagccggcaggcctctgagactgggatatttttagccaggattcctgctgacggtccaggctggccggggtttgctgccagccttagaggcgcttctcctagtctgtgtccggacatctggggtctgctggccccacccaccctctgctcaatgcccccgccccactggcccatccagccaggcgaggggctcccaggaggccggccatggtgggagcagagcctggggccctcggggtgtggctgagaagaggccacatgggctgctgggggctgcctgtgtcctgggtctccagctcccagctgccactcttagccgacccgcttaaggggcaggtttctggaggctccggttcatgcccaggctcgagttctgaactgagcattctcagtccgctgcctgctgcctgctggaacggatggctcagcagagcggccacagcttggctccctcctgggcactcctgcctgcccttgccgcttaggtgctctggtcatcaggcctctctggctggctctaccaaggtgcatgtgtgcagggcctgggcttgcagggccttgtggctcagccaggaccacctcccttcccatgggcaagtgaggacatccagaaagagggtcctctgcctcggccactcccttgggacacccctccaccccaaggcctctcgtggaaacagagtccagcactcagcgtcatgcctatgcactccaccggcaggactggctgagtcccgaggagccaggccctggggcacaggccaatcggatggaacccagatgaaagcccagtgctgggacccacggcccattctctggcctggctgaagcctgatggcttgttccttgaatgaatcaggaggcccatccagagcaattgtgaagttcacatgaaagaatgaacgtacggagagagatgggccatgtcgcatcctgaaacgccttatattctaagaccatgataattaacacagaccctggacagtcacacgatgggaaagagtccagaaagaggctcaaatgcaaatatgagaagaggcaggtcaaatccaagaggagagatggaatattcaacaaataatcccacatatacaatcaacacttggccttaagacaacggaattgacatatggaggaaacatttggattcctacctcactccttgacgctaaaacaagttccaagtggaactaagatttaaaaagtaaaaatgaaaccataaaactcctagaagaaagcatggatggcaaaaaaccaatcttgagtcactctaagaattatacaaaacccagaagccatgaagtaaaagatgggtatattcaacctcgtgaaaataaaaggcagatgcatggagagaaaaaaaccaccataaaatgataaccaacaaagggtaaaaacatcggcaactcagttcacaaagggccgtttttggttctcaatacaaatcagtaagaaaaagagcaacagcccaagagaaaaatgggcaaaggcatgaaaggaacctcccatcaccccctgctgaccttcactcagagtgagaaacatgcggatctaagctgcagtgagatgctgcccctcacccacagggatggcagccgcatcaggctgggggttccctaggggggctgcttaggggctcccacaggtctggctgttggagggcagggagaggcctgcgggtctggtggggccggggtgaggcactcacagatatgtctagtgggggtgaggagggggaccgcctgcaggtacagctgggggtgtcaggtcgctggggatggggtggaaggagaggatacccattcaaaacaggaaatatatatattttaaagtaaaacaggctaagtgcagtgactcacacctgtgatcccagcagagcggggagaatcccttgaggctagaagttcgggactagcctggggaacatagtgagtcccagtctctataaaaattaaaaaataaaattatctggctgttacgatgcacgcctgtagtctccgctacttgggagctgaggcgggaggatcacgttagcccaggagttcgaggctgcagtgagccatgattgtgccactgcacttcagcctgggcaacagagcaagaccctctagaaaaataattaaaaaaaaataaaaataaatataaaataaaataaaaaccagctgacatccatcctctccttgccaccactgacatggccgtgggccgagttctcatggccatcccaccgcgagtccccaagcgctcctgatgcctgctcacccttcttgtctttgttagcgccccgttagcagaggcctgcttaacttgtctctggtcttgcttctcaggagccgtgtcacattcaacagtggcagcacagaggccctgctcagccccagtccctcaccctaggcctccactgccagatgtggtcctggtggtcctgcggactcaagctgtccccccctgcccaaccttcacaggccaccagcaagtcccaggcctcccacaggcatggctctgggcagtatctttaccttcccagcctcagtttccctgatggtgaaacagggtgagatctacttcctagcagagaatccgggggaatggaggccgtgggaggaagaggacttgaggaaaggagcattcctgaggggtcccagagcgggctggggctgacaggactgagtttgcagggcctggggacattccctggggaggtgctaagatgccggtcagctagagcagcggggagtgatccaggatggctgcccggatgaggggctgggtcgctggtccctgagtgccaaggtggtctgtccatgtctgcaggaacacacccaccctgctgcctccaggaggggtgctggacaggcctgagctccaggatcataggaggcaagagccactctcaccaaagaacagcaagtgtgcctcccctgccagcaatctgtccggtccagcccctgcccagctatctggggaaaaggccaccttttcagtggaggctgagctcagggcaggaagaggttgagaggggagaaatggagtgagaactggaaggtgagaggtgtgagtgagaggtaggggtgtgaattgggggtgagatgtggtaggtgagagcggcaggtgagaggtagggatgagaggtgggggtgagaagtggaggtgggcagtcatggtgatagcttgtggggtgagaagtggagggtgagaattggggtgggagttggggtgtcacctcccaaaccctctcaccctcagattaagaagcccctcctatgggccctggaggaacaggcctttgacccaccccaaccccactggtgtcttgggcagggagatctcgaggtgggggcctcagctccccgtaggaccgtctagccctggaccacctgaccacagctacagtgggacaaggcccctgttgcctgtctgctgggggccgagcgtggtatggaggagccagcagcccccgccttcatcacagaggaggaatccgaggcccaggagggtgtctctggcacccaacacgtgagaccctttgaaaatcccccgagtgtgtggggggctgggatgaacatctgggggcggcagcagcaggtggcccacctggccaaacacactcctgtgtccccttgtttttggcaatttcaatgaccaaaatcagatcctggtatggagaaaaagacatcggtaaggacgaaggaaatgtgaacactgcatggacgatggctgataatagtgtgccgctattggctcagcaactctaacctaccaatgccagatgctcacaacggtgaaactggtgtgtggtagatgcgatctctctgtactgtcttctcaatttttcagcaaagataaaactgttctaaagttgaaaagtttattaaaaaaaaaaaaagaaaaaagacgggcttattagcaaaaatctgagatagaaccaagcagtagggcccagcccaccccccgctcagggcgcaccagcagtacccctctctcagggacatggccaggcctgggccactccgaagagctcttcctggtgctggggggcctggtgggtttattccacctgtcagtctcactgcaaagtgtggcagtggagtctgagttaggctgactcttaccctgccaaggacacccctgcactcaggacccagccccggcccccttgccctgtgggctggaggcgaccctgtgtgcagatggcagatggaggggcatggtgctgttgctctcaggtcaggggcagcagcctcagccctgaccagccctctcctgcgtggttgtggttgggtctcctggtctctggcctcctttccattccaacctgtagaaaacagtgtggtgggggatgctcggcctgcagatcagacaggccggggtcaaagccccgaactaccacctgaactagtcctggccgagtggcgctgatgctctaggccgagggcccccttgacagaacagccatcatctagctccgccgcagggtaggggaggtggcagtgtgggccgcagccctcggctgaagcgggggccaagcggggctctgcctggtgcagggggtttcctctatggggcaggggctcccaaattagccctggtgacatctggagctcacctctgggggctctgggggctgagagagcaggcggggcccagttctatcaatcatctgccttgttcctgggggatcgcggtcagtcccagcctccccacaagtcctggggcggggcaggcctgctggaaacccaagatgcagagaagagcgccaagcacctgagacagggctctgagcacggaaggcaaggacgcctccctcagcctcagctggggagccagtggccctgcatgcactttctcccgtctggggagcctgagccctgacccagtcccgaggcccatgtgtgcacaaaagccccctgctttctcacccaggacactggcgatcagtgggtaggcgagccggagcccagctgctgcgctcccttccctgccaggaccgggccagctgcatcctcatgcctgggtttcagggcttctcgggggatgtgatggcactgcctgaggatgtgggatccttccactgaaaagggccacacggctgtccccagcacccttccagaagggacaacccactcctgggaggtcttaatgtagacatcgaggtcccccgagcttcctccatggcctggccacttcacaaccatatttctttatgttccacgcgccttgcctgctccacggccaggaccagggccaccatctttgcagccggtgaagggacagctgccgtgggctgggctgctgaggcaggacaggggtccgggccagggaggggtggatggaggccaaggatgggccccttggagacagccttggggtgcagccggctctgccacctctccctggcttccttccctccaacctgtgactcctgggaagtccctgatgggccagccacttggggccgggaagtaactgtggtgtgtggtggtcaccctcaccagagttcatggggtggagcaagggggaagaatctcccccaaaatcaggtgtcttgttcccaggcccagcacagagacctggcccccagacatctctggacatttgttaagagtggacaactgcttccattacacaggagaggaaaccgaggctctaaggggtcccagacttgcctggctgccacagtgagcaggcaacaaataccaagtggctgccgcaatggggtaggtgggaggcagtggctgaaccagaaagtgctgctgtcgattctgctggttgcatgagtcttaggagatcatcaaagggcagattgtggggagataaaaagtatgagtggggaacaggattggggggagcagaagagcctcaaagaccctgcgacattctcaacgtctcgatggtgactcagagatagctccaacccgcatggcgggcagagtgcggaggggacggctttgtggctggattagtcatcccggtgcagctcaccccaaatcccggcttccagccctgggccgtccatgctgggatggaggaagggcagcctctccgcagggccacgtcctggagcctgataacctggccagcacactgtgcaaatggtgcatgagacagggagttggctctgtgttccccacggtggccaagggaccagctgtgcctcagtttcccttattctatcaaactttgaagaaggtcccgtaaaagcgcatctgtttccagggtaggggccagagtcagccacccacaccagagtgagaattggtgggtgccctagccctggcaggatctggcattttgctggacggagagaggaggcagcacccactggggctcgggcaaccatcccggctacccccgccccggcccgccaggagaggagggaagccttgaagtgccaggcctttgaatcgcccatctccatggcaacgcgtgggcacaaagggccgggccggcgagcaggcggcggctgcgcaagctggaaggaggaagggaatcttttatttatggggagggagagtcggggagccaggctgcgcccacgctcagggccaggccgcagtcttgaggctgggccccctgccccatagccagggcctctgagcagcacctgcccacacacccctgaccctccgtgcctggctgggtggacggagcatgggcaaatggagggcagaatggagtgagtgtccagcatgcacccaacctggagatcggcccagagggtccctgggagcctgccatcctccataccccagtctctgtgatgcgggcacccgggcagataccatgctgagagccagctgggcctgcagtgaggaaacgtagcccaaagcagactgcagagctggaactcaggtggggctgctgccataggctctgaagacagcgcaggagaccgggaggggtcaccagtgccaaggccctgaggcaagccagagctgggagcatctgaggatgggcattagcgtggggctccagggtacagccggtccactgcaggcagcctggcctccccagagacccagccacggctcctcaccttggacagggggccctgggccttgggcatcaaatgacctgcttgccgcggtggaggctgccataccaggacgccggcccacggcctccagcggcccgtccccaccttcccaagcccctcccctcatggctcacaccctgttccctgagcccccaaacatgggaaatggcacctgttgtgccccagcgggggaattctgaccccagaccctggggccagtgcagaaaccaccactgtatcagattttatttcatctaaaaaatatctgagccagattgaaagcagcggggaaagggtcccatggctgcttcccccagccccaccctccacaggccctgggccctcccagcccccatttcctttccttgagaaagtctaaagtggggcaatattttgtgaaattggaggcaccacgttggaaattccaaacccgtgtgtacgatgagctgcacgcgcgttttgaacctgccctggttttgagctgagggaagcggagggtgcaggagttgcccactccagaggccctgggtgtgcatgaggagccctgaggctgggccgagagccgcttgtgggaggcactgtgccccctgcccccgagatcagggcctgggtgcccaggacactacagaccttttggggatcctgggggttgggaagcctagagctggaacccacaggccagagtctgagctttcatcccccacccccgaagacgctcccccagccactgcctgcgcatcgggggagacaagctccccccacgcccaccttgcctccagcagggctgttcctcccctcatctgctggcatcagttttttctttaactgagccccatgctggggaagggagagctccaggggaccaggcagcagagaggggaggagagaagccatcaaacaggccgggggctgggaggccatgcactcagcatagagccccacatggcagcagggggctggatggccggcttagagcccattctctcctggacactgttctggaatggcccctggcccctccgttccaaagatgggaccctccggtccccggggacccgggatgatgtcccccaaaccacctctcttcccagacttcatcaatggcaatgaatggtgcatcctggctggggccgccgcccctcactgtgagacttcagcccagacgagcgcccagcccctcctggggtctcagatagtcagaaagaaaggctcacggctgccatgcacttccacaggactttgtggttcctcctgcacccccggtgatgctttcatccctctccagcaccattccagaggccagaaaaccatgatgtttggggtcaaacagctgggagaggcagttggaactcaggccaggcctgtctgactggacagtgcagagactgggaccatgctcccctacaagtgctgtcagtgcaccctcgatgccccccagagcttgccatgccccgacagtcccttcatggccaaagtgttccctggcacaggataccctggggtgccatgtctgcaagagctcacacccttctctccccagctgctgctaactgctgccagaggtgggagtgtggagggctcggggcctcttcaccctccctgcaccaactcagctccagaacattcccagcagtgagaagagggtggccactgtgctgcagccccaagggatgggcaaggccatgccagctggagtcatccatgtccccttggacatggtggcctcattcagagggcagcatggaggaaggtgcaatgagggtggctaccagagacagtggagatgaggcagtcaggaagcccagggacaggactggaggggacacacggccagcctgggacagggcatgaggcctttgttctgcgtgctgtggcatacggtgttggctctggccctggcccatcttttgttagtggtaggagggtgctcctttaatcagccaactctttgtttcaaattgcccctgtccttgaaaacactgcttcagggaagcgtgagacaaagccagttcagtggggtgcctacctggccagcagccctcatccgcaggggctgctcctggggcacgtgccagaatcagacagtcccaccgtcatgcaggtgctggggccttcagtcagcaggaccaggcagcccatgtcctggggacccttggggaggtgtgggcatttgctgagttgggctgtcatttgctagacaggcgcttggcgaaggggcccttttgtgcatggatgccctgggcaggtgtcagtcctgagtcctggagaggaaggcaagctttggagttgatgctgggtcctaggagggagcgtgtggtttcgccagcttctcaaaagtcacctgagaccctgccaagggacctccagacattcggtgcaggctcctggaggctggacagagggcaccaaagggcgacgggccccgaggacagaggtgtgcagccaggtggggccatggccaggctgggacctgctggagctcttgtgtgtgagcctggaggagctgccaggctgggggagatcggggctggggctgggggcggggctgggcgtcagcagggtctgcagctcccatcttcccagcttatagacctgaatatccaggttgagaataaaccattctcccagggcaccatagcctccaggaagcacctcctccttccaccatccgcctttcaggaggggcctccctggggggctgtctctgggactgcagaggctgcttggtgtatctggggctctgacatgagtgagattgttccggggcctgtgctgcccagcctcttccccaacagcttcctctggaggcaaggggcttggcaggagctgcagggagccaattatccctgaggcaagctggctgcagataattgggaagacaggcttttcaccagcagccaagctctggggcgcactcgccacaccaggacttgggacttgaggatccagaggtctgccaaaccccacgcctgattgggagccccatgtgctgccatctaccaggggaggtggcattttcttggcaactgaggggggaagccaggtgctgaggtgtggcccacgggacgcctcgcctggggacctcccagcccttctcctctgcctcctaggggcctcctctccttacacatgaaaacctccaatgtctagcccagggctccagattaggggtcagtgccgcccccagcccaacttcctctgggaagtgtggggttctccccggggcactcaggcctctttcttacagggcttcccaaggggaggcatccagaggaaggcaaaggctgtgatcaggtagaacccgctggacgcccccaccatctccctccatcaacatcaaaagacaagctgaccacccccaatgcaaggtggacattagggttaaaccctgagtgaccagcactcagctcccagcctggccgggatgcagtggggtggggtgtggtgggctcatggggctggtgagagcccggtggggtgggtttcaggtgctgcttgtccagggctcagctctgttccttggggctccctcagcccaagggcccacctcccctctgggcagccccgatcggcgtgttctgcctcggccagctgtcagccacctgcagctcctccctcattgcaccaccctggagcatcacggtgcccagggcaggccgtggagacctggctagcccatggtctgctcagtcctcaccagctgttgtgacagaaacaagtctgtgctgatgagctgagccgaccaggctgcagccctcacttcaggagagggtcaggcccagccaggcctggtgagcaggtgtggggaaggatgggtgctcatgtgcgggaagtttctcaagagtggtggaaggaggatagacaacgagggcccagtggatagggcggggaggcaggaagaggggacagagaggggaccagtgaaggagagtggagggtactgcccccctgggggaaggatggggtggggctggtgttagctgggttgggtgtgtgggtctggcagggagccgggcatgggagtgggtcccgaggaatgctaggttggagccaggaccatgggcctcaccagtcatagaagcctcacctcagggcagagggggctgacagactgggctgacgggaaggggggcttcctgtcaccagagaacataaagggaccactagtggcctgggccatgaggctctgtggccctcaaggtgctgagctcaaggtgggcccagcccatggctgcctttgtggggaccccacaaggagatgctggcctctgaggatgctcagacctggttcagcatggccaggccctggcctagcccaaggtcagcactggccactaccctgggggctgagtctccgtctcgccctgtgacatggtgcccacactatgagccagtgtcaaccctttgcccatacaccgggagccttgtgtgtccatactcatggctgagggcctgtttgggggtctctgtgttgggggaggtgggtccagggtgcgtggcccctgggattgttcatcatgagtgccacctggaaggtgctggagcctcacccgtcctccagagtgttttggggagatcctgtgctggcatcttggctgggccaggatggtgtctaggagggacccttgggagggaagcaggggcatcagggggcctggtgctggggtgggtggcaggagaggcctggagggcggcggcccaagccagtggctgggcaggtgtcaggagggagaggggtgaggcctggcctccctgccacagcttagccagggcctggggtgtcttggggtgggacaaggcccagggcagaggcagggctgcttgcatgcagggtggccacatcccggcctggtgagtgccggccactcagttctgtggccctctgctgccctctgccggccgcctctgtccctgcaggcccagccatctacctgcaggtctggacagaccctcagagcctaggctgggaggtctcaggagtcaagacagggttgaatcccatttgagggcatctgaaggagtgagagcctatgtcaatcccctgcccagccttgcctcggccagtggctcccaggggactctggtgggcagtggctaaagatgacagaggggctcagagaggctgagctgctctgtaaggttgcacagtgagcaggggccgagtggccttgggagaggcaacagcaggagggtcctcgtcatggccacagcccagggacaggaaacccctgctgggttcccccaccaagtagctcccattcccagcccttagggtgtctcaggagaggttccgggggaggtcccacctgcctcctgccttctcccccaaccacaccctaaatgggtcccagctccccagcccctcccacaagggctcacccgccagagctcggggagaggccctgcagggcggctgttcctccgtgtgctgcagtcctctggacactgaaagccaatcccatccatcttaatggcatttaatatgcacagtgaaagtcagcagccacagccacgggcgtgtgctcagggcaaggtttacacgcggatgccaccaggcttagcccatgagtggcctcctgggtcccaggagacctgtggggtgggggtgcagctgggtgggccatggtagcagagacctggggaggggatgtgggaggtaggaactgggctaggcagggactcaggggaggctgaggcctggaacagggagactgagacctcaaggaggctgggacattgggagtcaagacttggggaagctggaacatgggcaggccgagacgcaggggtttaagaatgagggtctggtgcagacctgagttggagcccagccgctgctggccccacgtagctggagagtgtgctgaccccatggtggctagagaatgtgctgttggtagggaaggcaagtgctgggaagggaaaagtgtggtccatttaaatgatacggaagcaggggagggaagtgctgggtagaggagggcatggtcccagactagggctccaaccccacggacctaggtgagaacaggcacttcctacccaaatgttgcatttctcacgaccaccctagcctgccacgcccccatcctgtgcttataaaatcccccgagaccttagcaggcagacacaggcagctggacgtggagaggaacacatcagcggagacacacacgggcggctggatgtcgagatgaacgcactgataggcaccggcatgctggcaggccactgactggcagaaccacacggagtttggctggggcagttggaggacagcccgggtgcacagcggccccactccaggggaaaaccttcccactccacccccttctagcttcccctatctgctgggagccacctcccctcaataaaaccttgcactcattctccaagtccacgtgtgatctgactcttctggtacacaaaggcaagaaccccaggatccagaaagccctctgactaacacaagccaccctacagacgacaaactaaaaaagcccccgtgacacacgcccactggggcttcagctgtaaaccttcacccctagacactgctgtggggtcggagctccacagcctgcccgtctgtaagctcccctagaggtttgggcagcagagcactgaagaagcgagccactccccttctcacacaccctgctagggcaacaagggaactttttccgtttcactggcccaaggtggctggacagtgtgctggccccacggtagctggagagtgtgtcgcgctccctggctttcctcctgatgtataaaatgagttagcgggtcctgggggctgttcccacagtgacgtggtggaggctgaccctgacacccacccctgctgaatgctcagtgaatggtggttgctgtcaggaagcatcattgctgtcctccatcagtgtctgtggggctaggtgactcttggaggatgcttccagcaacgttgcactgccaagacagaggccgtccacctgcctctgggcttcctggtgtgaacagatggatggatgcgtgggcctgctgcgtgcagggagctgaggctgggtcttcacctatgggcaggaggctacacagggctctgggagagacagcactgtggctgggacagagcccatgtgatgagatgccctcggtgcccctggcctccctcctcgctcctgcccctctggaacatcacccagagccccccttgctcttttgggggatgtctgggtgtctgcggttgctgtcactcttgatcccacccacccacccctgcaggttgctggcaggacaagtgcaggagtcatctcatggctttccctgggatctctgtacccgctgagagccgggagctgcacacagcctgtccaccatcctgggaactcaccctgttgctgccgcttgtcctgggtcatcctggggctcactccttgccattcagacccctgtgaggagagcactggctgtgagttgctctgtggctagtgatggcaaggcagggcctggagtagatccatcacgaatagttcttttttttttttttttttttgagatggagtctcgctctgtcaccaggctggagtgtgcgatctcggctcactgcaacctccgactccctggttcaagcaattctcctgcctcagcctcctgagtagctgggattaaaggcacatgtccctatgcccagctaatttttgtatttttagtagagatggggtttcaccatgttggccaggacggtttcgatctcctgacctcgtgatccacctgcctcagcctcccaaagtgctgggattacaggtgtgagccacggtgcccagctgagaattcttaatgaaatgggaacatgcctcccacgaaatgcacaggggcctgcagtgatagagtggcctcaggtatgtgcacaggtgtgaacacgccttccacagagggcagtggacgtgcacatgcctcacacacactgtggcgcagggcaagtgtcccacatgtgttcatgcttgcgcacatgtcagtgggctggatgtgtgtgtgcacacctgtgtcatgcctgcagagaagacagtggagagaaatatgcccaaatctcccctctgggtccctgccctgggtgctgggatgtcagaacaggtcgatgtccttttatccttccccatatccaccacgctgtctaccaaagcacgctttagttttataatcagaaatgaaatgcaccgtttcaagaaagccatgggccagcccctctgtgccctggtgttggcgggggcagaggggtggggtgtgtagggggagattagcctcatgcagccgtggggccagggaggccaaggtcagcttgctcagcacctggaggtacagcgagtaccaacaacacagcctagcttgaccgcggaaggaaaatcaatgctgggcgcaaggactgacggcagactcactgggaacactgtccaccgacgtcagagctgctcacagggcaccgggagcttgccagcgagcttggctgcctgtgtttggaacaaccctggtgggcgagcacgggcccctcacctgactccactcagtgcccttcccagaggggagacaaaggctgtgaacagctctggaggccctccctgccagtgccccccaggcctggctaaagaaatctcaaataccccgaagggcctggctccagcggcccctgctatgggtcagcctcagggggatgctcatcttcaattgaccctgactgttccacattacaagataaactgtggggttaactcaaggcggtattactttgtaaagactgctctttatacaagagcggtggatgcaaaaacaaaaacattgccatgtaagacgggagtcctccgagtcctgtcttcctccattccgtgtccttgcaccccatccatgtgtggcctgcatggacagacagcttcacacactcagactcttccctccccacgcatcagagatgtgtgtccctgttactgacatgcagggaggggctcatcatcttgggcacaccccatggtgctctgagcccatcatcacctatggtggacgttgaaggagttcccaggttttccttttcaggagccatggctcgggccagtgcctaggaggtcagaggttgggggcccagggagaggtcactgcccaaccgtgccaccttggactcagagtgccggcccagggaaccaggcaggcccggctctgaccgtgccgctgggcgaccgctggctgagacctggggctgaaacacatcccacatcagccaaggaaacaggctctgcatgaggcctgaagcccctgaagggctctgggacaggaggagagcccaagccttcagctgtgatgtgcacagcaccgtctgtcctccacccaagggaactcaccttggtgaccctgctggaaggcacaggttgctgacattctgacccctgacattcggacctccagcagagcctgcagtttgagacctctggttcaggagctgggactgatggggcccttggggattcccgtgctgctggaggaagatgggggcatgggggtgtccacagcaaagaagtgagaagtagaggccgccagccccccgccccgacccttccctggctagagtggggcaggcttgggggtgagtctggggtgctgatttcaccctcctgggccaaagtctccccgtgactttatggactgtctccctgtgctccctgagaccctggttctccctcaccagcctgggtccttcttgtctcagctcagctgtcacctcctccgggaagcccccaagcccttgagtgggtgcccagcaggcatggtcagtgctgaggctacaagccctgccggcacccggcagggaacacaaggccaggtcaggctctggggacagtagacaagcttatccctgcacactggggactgcccacctgggggagagagctaggtcaggctggggagacgtcaggggatggccgggcacccctccctgaggagagctccacctgagcaagagtgtcaccaggcccactccagacacatgcactgcctcagacgggctggagagagggtgtggccgggccatgggatgaaccattctgggcggttgtcctggcatcaccagacatgtggctctattaagcatctcgactccacaggagcccatgtggcatgtcctctgacctcctgttcacttctgaaaggggcggccctctgagattctgcctggaacctgtcagccctcctgacaaggtctctggttcccggccatcacaggcacccagccaccctacagagaggctctgggaggctcagccttgcctggggccccaagactgatgccagctggggcatctcacagggagcacccctacctgtaaaccgcccagctcaagccctgcctcgacctctccaagtcagcagccgaccttccccagggcccctcccagcctgcagggggtctgaggctctgaggcttttctgcagcctctcagtcccccaccctgctacctgctcaggcagagagatcatggctctgggttattgtgtgcttagtgggtgctggagctcgtgctaaacaacttgggtgccccctgaatcttgacaataatctgagggggcattattattactattctcacttccccgaggaagaagtcccaaaccccgtctggcacaaagccagcgccccgagtctccctctgcagtccatgtgctcccacgtggggcatgcctgggacatcacaacatctggggtcaatgcggctgctgttgtcactgtggcattcagctttcccaaggctcacatctgctccatccagcaaaggggtcttgcaccccaagcctgcctccctcttcacacacacaatcccacttcgtcaaccacaaagatgcatgggtttacccagcctcaaccccatcggcccctccccttccagttgccggagggctcgggccccttcagctgggctcccacattcctgacccctggcctgcaggccctcaagactatgccagcccgggctcacctggtgccagacacctgcatctccctggggtgggggttgggggcagtaggctccgtggacctagcacacgtatgattcttggaaaatgtaaatgtctctgaggacagcgatcccagcttcaaatattgctgtgggctctcgggcaagtccctcctcctctctgagcttcagtttcccccgcataaaatggagcagtgatcgtagctcctgcatgggaaggttgtgaacaccatgcttgtcagcagaatataccctaattttgcaaggaaacaatatggcaggggtgggggggatctaaatacctttccttatacacgcattgaaaatgattatataaagtggtgaagtgtgattgcattcacataaacagtggcatgttctgggatctagcagacaatcttaacttcaggaaatgcaatcatattttactagctttgagaaaagtgaataaaatgtcatagctaaatagaactcaagtaggatctgtgaacggcagcatggagtggataaggggataacgtaccgatgagggaatttatatacccagcagcccaggtttggtgcaggctgataacggaaagacaaactccaaattaaatgaatgtgaatgaattcctttgcctgcggacagaccaaaaatatcggtaaaagtggctacagggcaagcagaaaaatgcaacaaattagaatgaacgcagggaaccatgtttctggcagagaaacaaatatttcagagtacaggtaagaggcacatggcaaaaaaaacaacaacctgactttgccagagctccaatgtcatgctcacggctgaggagaaacaattatctcgctgggaatgagtgcaagtgagagaacggaaggagtcctgagcacggttgactgcatgtgcccaggggcccggacaggcagcacagcggcctctctaccctcgaaggtctgtttcttgtctgcttcctccttgagagtggcaggccctggtaactggcccaacctcgggggcgcccagcagctgggtccccaccacatgcccaagtctggccctctcagatctgcctgtctcctgagctggagaacggagcccacccctccatccccgacactcatctcccatccagttgatctccctgaggacccccccaccgacaactcccacctggatcccctggccctggtggggcatcattctttcaaaataatccatgactgtgttcagtggctcacgcctgaatcccagcactttgaaaggccaaggtgggaggattgcttgagcccaggagtttcagatcagcctggggtaacacagccagaccctgtctccacaaaaaactattttttaaaaattagctgggtgcagtccagcctatagtcccagctacttgggaggctgaggcagggggatcacaagcccaggagttcaaggctacagtgagctgtgatcacatcactgcactccagcctgggcaacagagaccttgtctcttaaaaaaaaaaaaaaaaaaaaagccatcagctggctcagggtagccacctgccaagggtccccagctgagcgtaagacctgcttcctaggatttacagagctcctgtgaaactcggttgtttcattgattgtcacatggagccagtgactttcaggccagccttgttcccacaggtgggctctcccgtgggcctgggcacccagcgctaggcctgccctgctatggtctggatgtgagcagagatctctgtgatccctgtacccctcgcttctccccctgccctctctgcagccctgcccctggcagcccctgcccaccttcgcctctgtgcagggccacaggcttccttgaagcaaatgctagaactttgagctctttgctttttaaaaaaagataacagctttattgagatataattcattatactattcatttattaccttttgcattataccatgcaattttttccatttcaatggcacaatcgaatggttttttagtctatacacaaggttgagcagacatcaacactctgtagccccagagtatttccagaccccaaagaaactccgtgggccttggcagcccctcccactccccctgtcctccacctccaggcccttaccagtgccacagtcaccaggctacattatgggcttgtcttcgtgtgacttctgtctctatgggtttgcctattctgaactcttcatataaactgaaccataaaacttgtggccgtctgtgtctggcatctttctttcttttcttaaaaaaatttcacttttattttagagacagggtctccttccattgcccaggctggagtgcagtggcacgatcatagctcactgcagcctcaacctcctgggctcaagcaatcccctcacctcagcctcctgagtagctgggataacagacatagaccaccatgcctggttaattttgtatttttttatagagatgaggtcttattatgttgcccagactggtctagaactcttgggctcaagtgatcctcctgccttggcctcccaaattgctgggattacaggtgtgagccaccacacctggctatttttattttttaattgacacataataattgtacatattcgtggggtacgtagtgatgtttctatacatgcaatgtatggtgatcagatgagggtaattagcacacctatcatctcaaacatttatcatttctttgcattacgaacactcaatattctctttctagctagctgaaaatacataatttttgttttggtttggattttggtttttgttttttgtttttgagacagggcctcactctgttgcccaggctggagtgcagtagcaccatcacgactcactgtagcctctacctcccaaggctcaggtgatcctcctgcctcagcaacccgagtagctgggactacaggcatgtaccaccacacctggctaacttttgtatgttctgtagtgatgggatttgaccatgttgcctaggctggttgtgaactgctgggctcaagcaattctacccctctaggcctcccaaagtgctgggattacaggcgtgagccgtgacacctgacccataatatgttgttgttaactagagtcatcctacattggtgtagaacactagaacttattcctgccatgtagctataattttgtatccttcaacacatctctccctccctctccctcccttctttccacccttcccagcctctactatcctctgttctacttttgacttctatgaggccagctttttttagcttccgcatatgagcaagaacatgcggtgtttaactttctgttctgtctcatttcacttaacataagtttctccagttccatgcatgtgactggcttcttcgattttgcatactttcaaagttcatccatgtcatggcatgcattagtacttcattcctttttatagcttaatagtattccactgtatggatggatcacgttttgtttgcaccgttttgctgttgtgaatagtgctactgtgcaccagggttgtattcctctgtgtgccactgggttgagggttgggggatggtaggtgctcccataaagggggaaattgactgatactggctgaaatggaccaggctcttcattaagctggcctctgaatgttgcaaaagcattctgttggtttccaggatcactgcttaagacggttcctttcagtaccactgttgtccaggggagggatgggttcccggagcttcctgatctgccaccttctctgatgtcaccctcagaccctctgcttttgagccccaggctacagagtaaaagtctgatggtaggatgtgaggtgagggaccttccttgacccggcacccacatgaggcaggactgagaacaccctgaggactgcccgggtggctggggtgctgaagccaggcttggcccctccacaggccatgcatgacaaggaccaccctgtctctgagctttgccttggccttgccgtgacattttcaggtgtgtttcagcttagattctgctctggggtttcccgtgtaagaacagggatgacgtctaagcccttgtctggcatttgtcaggaatattgggagaggcaatgtggcagtgtgagaaacaagctcacccatccaaacctgaagaatggactcagaggcacgagcagtgaaagtgagacttttttttttttttttttgagacggagtctcgctctgtcgcccaggctggagtgcagaggcgccatctcggctcactgcaagctccgcctcccgggttcacgccattctcctgcctcagcctcccgagtagctgggactacaggtgcccaccaccacacctggctaattttttgtatttttagtagagacggggtttcaccgtgttagccaggatggtctggatctcctgacctggtgatccgcccgcctccgcctcccaaagtgctgggattacaggcgtgagccaccatgcccgggaaagtgagacttttaatagtggtcttgcgagattggtgtctggtggataggcgcactcagggcagtcacagcaagtaacttatgccctagcacacaagtccctcctcctcattggtcgagtactatggggttacaatcttccaggacattgcctaagtttcattatccaccttataaggttataccccgtcgccttccccgcttaagtttcaattttccaataacgaaactttcttcccttttatgggctgaccctttttctacattctgtctgcttattgtgatcttctacgtgcatgagccgtgcggtttgttacattctcaggctggctgccagtacttagatttatcatgccttgaaaatgggccatttaaaatgttttctcatggcggtaaatcggtgagctgactgtcatacactcagtcattttgcccaaagtgtgtgtgatgtggagggctgacagccttctccattaccagtgcagtgagaggtggcacagctggtgggaccccctctctctcatggatatgagtgcgttagaggggaggtcttgggccaggagcagatcagatcaacaggattatccagaaaatggcagtcatggcgagtattggctccagatggggagggttagggtcagggtcggctcttctcaccttcctgagcgagtcaccagcgtcgacaagttactcccaacatacagggcctgggtggaggctgagtgctaggaacccaggctccaattctggtaaccaggtgcagatgctcaggagaagaatgcagcccagacaagcgtggtgtgccctccagaggagaggacgtggcatcaaagggctgtcttcatggagagcaggaacagagactttgggaagccagggggccttggcctcagccctgctggcagagggtccccaccatgtagctgaagtgccagggtgcttgtgaggactgggtgtggtccagggtgactcagggcaaggcctgggggatgcatctcaaatccacagtcaccagcctagaaactggggtcacacttcccacatgggttcccacatgtggaaatttcattcactaaataacgacacatcaaggcagcagtatggatggggcacagctgtcaaagtcaccagcaacaagtgcaagaagagaagagggagttgcagccacataggtgcccaggtgggccctgggggtcagagagggcctgccaggggtagcacccaccatgctgaccctgatgaggagaggaaggagggtgtgggatgcaggggagggaaaggtgcctgagagcagcatgcaaacagcctgggctcaggaagagccgatggcatgacaggtgctggggagaaaggcgtgataggtgtggacaggggccacaggaggagggatggtcctcaggaaggggagactggtggctatggccggctgccgaggctagcctctctccagcaaaatgagcctggattcatccactccttttgtctctcccctttgctctgtggtgccggcaggaggaagaggagcagaaaaactgttgctccattcatcaggaagcctctctctctctcgagtggtggtgatggtgtcccccaggggcacctggcaatgtctggagacatttacggctgtcccgactgtgtatgtctgtgtgtgtgtgtactacaggcctctggttcctggaggccagggatgctgatacacaacctgcaatgcacagggcagctcccacaaggaaattattcagcctcaaatttcaacattgcagaacaggtcagggagtgcaaggtacctcctgctctttccagcaggtgcaaggtgcacagggagaagcaggtgggtgaggtgggaggaggctggagccagacccagcgtctgtggggtgcaggaatatcgtgaggtgacgaggggcccagcggtgagtgatggggaggggtgcactacggcaggccgccaggggcggttccaccaagaaagtgacatctgggaggggcattgaggcaaaggggccgcgagagggtaggtgctctagaggtggcccacgggcgggcggcactgaggccgggcctgcaggggaggcggtgtggccagcggactcttgttgggtggcaagggaagggaagaaccacagggctgcacaggttccgagggggcctagtggtccgcatttgcccttgggtgggcggtgggactgggaggacaggagaggagcgcggggcaagcccctaagaggcctgaggggtgggagggagaggacggcttcccatacgcccatttagaccagaggagaagcggacccactttgagggctggattctcagccgatccggcctcagctgtgggtccacgcggctcaaggaccagggaggaacccaggtgtgcggctgcgctgatcggcgggctccggacccacctggctggcctggggacctgggaaacccggtgtggtggggagaccgcaagcctggtcaggggtcccgctcccaatggggcgggtctcctgtgaggaaggcggagctcagggcgggtagccccggggaccgggtctctcgcgggggtgtggccacggcccggtgggcggggcctgctgtggacgcacagaggtctgcagcgcgcggggcggaacctcccgaggagagggcgcggctgggagcgcggggcggggccttccgaggagagggcgagactgggagtgtgaggcagggcttcccacggaatgggggcgcggagccggtcctcccgaggagcgggcgcggctgggaaggcgggtcgggtcctctcgaggagcgggcgcggctgggagcgcggggcgcggcctcaagaggagaaggggcggtgggtcctggggcgtgccagaacccttgaggaagaagcgctggtgttctggagtatgaccaccggagccggccgggcctcgggttggggcggggcctcaggggtggggttgggacttcgggatgggttctccagaggtgagagctggggtcgtagggtggaccggcgtctgctgaggaaagggagctgcttggagcgcggggcgagggactcacgtggagaaggcgtgggccctacggcgggcggggcggggcctcaagaggagcgggtgcagatgctagggaggggcggggcccctgggatggggcggtgtctcccgaggagtgggcgcggctcggagcgtgggacttctaaggagagagcgcggctagggggcatgcggggcggggaggggcggggcgggaccaatagcgcatacttaagcggcccgggcgggtaccggcgtcccgccatggctctgcggcgcgtcttgcccgcgctgcgcccctacattccccgcttcgcgccgctgtccacggcgccggccgccagcgagcagcccgccgcgggcccaggggccgtgccaggacgtgggtcggccagggcagtgcggccgctggtgcccgccgtggacttcggcaacgcgtaggaggcgtactgcagctggcgaacctgggagctggcgcgcagcctgctggtgctgcgcttctgcgcctggcccgcgctgctggcgcgccacgagcaggtgcgcggggtgcagccggggcgcggggcttctgcccgtcccgggagcctttacggagtttcctggcgtgaaacgggtgcctcccaagcatctcctggagcaagggaagccaggaagggaggcgtttcctgcagtccctttctgatatcgcgaattttcctacttctcgatgtctaccaactaaaaacaatggtcgttttaatatttacgatatataccacttgtgggaatacagagttatcacttggaatttaaaatggagtattcttcatgttgacacaagagaagcctggtgtagggctcatagcctggaaccccagagttcaatccccgggacccagccgcttcccagacacggccactctgagaacactgttggggaaaaatgggaagcccctcaaacgcccagctttgaactcacccatggtaactttaaaaagtgtcagggcttttggtggcggtggtggggggcaacaagcagaacactgttttagccgcatcagcctaggggtactagagatgacggttatctccaggtgaccctgggaagagtttgcaaggttccgctttttggcgccagggtatctggtggtgttgatttctcaggtgagactgtacagaggtcgggggctgcacccctggcctcaacaggaggcgggggaaggcgggggacggtgtgagatgagaagcaccgagccacacttgagcttaggtgaggcctcggcgggtgcgaggtgagggcagggatccacgaactcagagtcagatgctgttggcccgaatcccatggggagcgccaaggtcagcctaggacccgtggtggcgggagtgcggaggatggtggaggaagaaggagctgaactggacagatggagggctctgggagggcactgctgtgcttgtgcacacaaggatgtcttaaggtcaagttttggccatagagagccccggccaaggagacaggagggcgagaagggacatcccaggtagaggaactggcaaggtgagggacggcgatgtggaggctttggggagtgcccacatctaaggggcatcccaaaagaggagccagtgctggtggtgctgcaataggaggaggaggcagcagggcaggaatgccaggggagggagtggccagccacagggcaaggacgggcattctaggtggcagctgagtgggacagagactagccatgcagaagccatgcccaccttgtggccaggatgtagtgggggctaggaaggcaccaggtcaggtttcttttttcttttttttctttttcttttcttttcttttccttccttccttttcttttctttttttttttttttatggaattcgctctgtcaccaggctggagtgcagtggcgcgatctctgctcactgtgacctccacctccctggttcaagcgattcacctgcctcagtctcccgagtggctgggattacaggcacgcgccaccacacccagctaatttttgtattttcagtagagacagggtttcatcatgttggccaggatggtctcaatctcctgacctcatgatctgctcaccttggcctcccaaagtgctgggattacaggcatgagccactgtgcccagggagctggtgccgcatcttctgcctgggaatcccttcctgacacagcctctgggggccagagatggggggagcagggctccaggggtagagaagccagaggtcactaaggcccagtgtccttccgtgttagaaacacccgaccctgcacagccccatgctggccccagcagccctccgtcaggggcagcgggtcccaggcctgtttatgtttttgtttgtttgtttcaaatgagactgggtcttgctctgttgcccatgctggagtgcagtggtgtgatcatagctcactgcagcctagacctcctgagctcaagccatcctcccacctcagccacttgagtagctgggtctacaggtgcatgccgccacacatggccaagtttttttttttttaatttttgtaaagaggaggtctcacagttgggcgtggtggctcatgcctgtaattccagcactttgggaggtgaggctggtggattgtctgaactcaggagttcaagaccagcccgggcaacagggtgaaatcctgtctctaataaaatacaaaacattagccaggcatggcggcaggtgcctgtaatcccagccactcgggaggctgagacagaattgcttgaacccgggaggcagaggttgcagtgagccgagatcactccactgcactccagcctgggtgacagagtgagactccgtctcaaaaaaaaaaaaaaaaaagaaaaaagatgaggtgtcactatgttaccctggttggcctggaactcctgggctcaagtgatccccccaccttggcctcccaaagtgctggaattacaggcgcacactaccacacccagctaattttcatattttttgtagagatggtatttcaccatgttgcccaggctggtatcaaactcgtggcctcaagtgaaccttccactttggcctcccaaagtgctgggatgacagggcataccactgcatctggcccttctgagcagtgcttggaagccacctcctgacgggggctgggggtcagagtggccagctgaatgctgggccatcagggtgaggggcgttttctcctcatccattgcctgttctcctggggcagatgtaaggggaaggccctgcactggggtggtgttaaacaagatgagatggtaagatctgctttcactttaaaggaacatttctggttgttgcttggaaagaagtgtcaggggcaagaatgctgcaggagggctggcctggagggcagggtgggactgcaggctggctgcacgggggcaggagcctgcgcttgcgtcagaggttcctgagagacttgggctctggggcagaggcctgagcaagggggcctcgctggggtgtctctgtcttagccacactcggtgtttctgggtcctgtgacccatgtgtgagcagcctgtggtgctggtggcacaggggaggaaaccgaggcagggagcctgtgggggctgctcggcaggggacaggcagctcctgtgcccactgctgtcccacacctgcatggaaacacaaaccccaccacggagccccctctcatctctacagggcctccagagcgccatgtgcaagaacttcatgggcggggtggggtggggtcaggagcctgctgtgggctggccaggcatgaacaccaagctggaggtggcggtgctgcaggtggggcagccttccccttccccactcctgtggcttgtgagggggtgggcaccgtgggggcgcacagggggcatggtgggcagtggtcggaggtggttttgggaactcacccagggcacgtggctcactctgcagctgctggggttggcctggtggggaggaggaggtcggagggactctgaacagagaggggagatgctggcaggagggctggagacccagccctgcagggcgtgggcgtgcatcagcagcggggtgggaatagacctgtctatgcagtagaaacaaaccagacatggatcctgttcttactaacgatgtaataaagccagaaacagcaccagaggccaatgggtggggggaagaataaaatgtgagcgaatggggctgatccaggccttctcacttctcaaggaaagtgtcgcaaagatgggcatcgcatccagggctgagattgaggactggttcacggcagagaccctgggagtgtctgggtgagagcagcccccaggctgagaggacacgagcatcagccatggttccagccaagccccagtgacgtctcccagtcctggctgccctgcctgagagggtgggccttgggatgacagtgctgaaggaactgcttttcacacagcaggacttgatggcctcaggagtccctgaggctggggctgggctgggcaggggagacacagggccagcacagaccccatagagggctctttatagaattatctgggtccagagcaaaggtggcactctcagccctccctggagtccacgccggcaggtgaaggatcagagccccatgccccatccttggggccaggggctgggacccaggtcaccaggagcctccagttgaagtggggaggtgactggggtggtgcagtagtgagccatcccctcacacactgccagccttgcccactgtgtcctccctggccgcccggagctgtgtccgcctcctgcctggctgcctgtgctcggcccctccacaagcccaaaacagccctagggtactcagtgttttcagagccgcctagatgcaggactgtttgtgttttggttttaaatttttttaattaatttattttttatagagaccaggtctcaccatgttgcccaggctggtttcaaacccctgggctcaagtgacctgcccgccgcagcctcccaaagtgctgggattacaggtttgagctactgcacgccactggttttaaatttttaaacagaaaacaatatttacatttcctctgtctttttttttttttttttttttgagacggagtctcgctctgtcacccaggctggagtacagtggcgcgatctctgctcactgcaagctccgcctcctgggttcatgccattctcctgcctcagccttctcgtcttttaaaactgaacactgaggtgggttttgtggtggttggtgaacggacaggtttgggcctggatcccccacccgaccctagcacccacaggtggggtcgccaactctgctgatgtgcctcctccctcagcactgtggacctgctggactggagcagcctcatcgacagcaggaccaagctgtccaagcacctggtagtccccaatggacaggtaacacctccgctcctcagtgaggcccagctcagcagggcgctgcgctaagaagggaattcagcctgccacatgtttctcttgttgcctaccctgggaacttaacatgaccaagatcactgcacactatggccccacagaccccctatggtccagggggaaaagaagacaaacccactagtgtccacagagtgcttggtgggacagagacccacgcggagccttaaaacaccacaaggagagggggtctgggggccttccccaagtcatctgtcttgtgcatcaggtcaccccaaacttcagaggcctaaaacggcagcagccactctgcttctgcctcatggttctggggttgacagggctcagctgggcagtcctcgcttggggtctcctgggtagctgtactcacagagtggtggcgctgggacctgggggaggcgcccactcacatgtctgggagttggtgctggctgtggcttgggctttttcccaacatggcagctgggctctaagggccagtgtcccctgagacgtgagagccaggcagaagctgggtgaccttttcctgcctcacctcagaagtcacacggtgtcttttctggcaagttctgtttgttagaagcatgtcaccaggccagcctgtatactgcggggagaggaatgagactcatctgcctgtgggaggggggcccaggacctggctgactgcttgaaaccacaacctaaactggaattcgaagaaagaacagaagcaccttcagaaaacatcctgcagaggcagctttccatgacacatctagccccagtccactaagggcccagcctcaaactcagagcccccgacccagagcctcggggcgcagtgcgtacagtgtggctgtgcaccaaggccaccagctgttggagactttagcatggtgtagcaagggatagagtggtactgcttgtgcccagtgaggcaaggctgctggggccagcaaaggggtgagcgggaggccctgcgggatgggtccccacggcctctgagcaccagctccttgaaggcctcatcctggcggttgccctggtccctggctacgtgtcagcacgtgctgcacaactgccctgtctgcctgtagccaggggtcttcctcctgggccctcttcctgctctgggtggagcccttctgtttgacgattgggtggtcagtgttcacttcctcagtgtcacatgggagctgcagggggccctcccacaatggtggggcctctgtgagaactggggaggctgttagagtacacacttcggagtgcaggcctggactgagcctggggcccactgacatgggcactgagctccctcctggtacccccagggcccgcgtagggcagtgcactggctgcgttggaggttccggggctctgtgctgcttgtccaggtggccctccctcccggccctgcatgagagggttcccgtgggctgggaacactaagagaggtttagcctgggcctcagggtggcacttcctggcccttgctgtggcctgaccatgtgctgtacccccagacaggacagctggagcccctgctgtcccggtttgctgaggaggaggagctacagatgacgaggatgctacagcggatggatgtcctgcccaaggcgagctgtcccgctcgggcagagggctggggccttggggacccgggactcatgcagaagagggcacctgcctcacttgagcaatagttgctcccactctcccaccccctgcgcctctcagaaagccacagagatgggcgtgcggctgatggtggatgccgagcagacctacttccagccggccatcagtcgcctgacgctggagatgcagcggaagttcaatgtggagaagctgctcatcttcaacacataccagtgctacctcaaggcaagcccccgctcagcccctccctgcctgccttggggcttggagaccccacaggaggggctcctctcatctgagctccctggcatttgcctggttttatactcagcacccaccagggagctcacgggatggaggagggagtgggccgtgcccccaaggggttgttggggtcttctgcagcacagctcacccagcgggccccagggtccaggaaagagccccttaggtggtggccacagccaggcctgcagaggaggccgaggccagggtgactgcctcagagtagcaagaaaggcccgctgcccgcagcctctcccctggttctcagaaccagccaagagtgtctaaggagcaagaggaagacaacgatctttatgagggtccactagatgtacccgacaccccaaacttggaaggtgtcacatgaccatttcctccagcgtgttttcagttcagcgcccctaagaacctcatgaaagctttgggccctccccggaaagactcacccaggatgtcacatgtattcagggagcccatcctagcctgtgggccccaaactgctcagggatgttagcaggtccagagctctcaggggtgagccgggtgcccagaggacacagggtggcatggggagggggtccaggcaggagcatgcagtatgcacccctcctggtcggcctgggagtctggagcacatgatggctgctggcgcctgggctgcccccatagggctgtccacaggccacagaggaagctgcagatgtccccactgccattgctccctggagacagaggttggagaaccatcctcacccacacctggtccaggtgccttgagctgcacctccccaggcagctgctgcccagccctggtgactgcacctgggcccaggaaggccccatcctgctgtcacttgggcttgcccaggctccctgtgacttttggccctggccccacaggatgcctatgacaatgtgaccctggacatggagctggctcaccgtgagggctggtgttttggggccaagccggtgcggggcgcatacctggcccaggagcgagcctgtgcagcagagatcggatatgaggaccccatcaaccccatgtacgaggccaccaacaccatgtaccacaggtgcgcagctctcccacccctctgtcttctcagggcagggcgccaagaaaccaggcctgagggagaggcttggagactgaacttgtcagccacatgtgtccccaggtcagaactggtatttcctcagcttttatgtcatgtgttactttttcaaaagcattaaggttattcttttataaatatagaaaagcctattgaacaaagtaaaattggccacagttccctgagcctgctcctgcagacacttagatccagagatgtgcatgaacactcggtcctccccaccctgcaggctcagcctgtttgcttttcagttcacacagtgggatcgcccatcagctgttctgcacctgcttttactgctctagtttcttggtgatcttttcatgtagcacaggctggccaaccatgggcttttcctcttagaggcgtgtgtgcatgctgcaaattcagagagaccccaagtgcctcctggttggctccagctcccctcctgcagccgctgtgcatgtcgtgccacagcgcacacatctccgccattgttgtttgcgctgtagcgtgtcctctgcccgatgtgtttttcatttcgcgttccatctgggtcctcttgtgtgggcttgcagagtggtgctgtcaacagccagcatggagtgcccggggctatgtgtccagcatctttgatcttactggttttcagtctggttattgtaacagggactcgctggacataccgtcaccctctgtggtacacacgggccgtcaggggttttgtgtctgaggatgcagctgtcctaggttgctggaaatggaattgctgggtcagagagaacgtgcgcgtggtcaagcctgctgagtgtcctcgctgcaggagggccgtactgctcgggcttcctggtgcaccgggatgcccacccccactgtgccctacagggacctgcttcccttttatttcctttcagggccaggggtgcactgtacgatccctccccagacgcaaagctgtgtctgtcatgaggcttatgggcatgtttgggctggtccccagagtcacggcatgtttgatgcagggacgctgtgccccagctggttctgtgtgaattgtctggtcccagacatcgcttttgcttggttgctggtctttctttttcatgaggtgctgggaggggcagatgctgctcctgttcctcctgatcctgtggatacccttggaaagagccagctcactggatggatctgggtctgccttcggcctcctctctgtgcagctggtaatgagaggtgcaggcgaccacaggcctggaactgggctcacatggcactcttcacaggtgcctggactacgtgctggaggagctgaagcacaacgccaaggccaaggtgatggtggcctcccacaatgaggacacagtgcgcttcgcactgcgcaggtaggtgtgccccaccctgcaccgaaaccccaacctgagccgttgtctcctccagctggggagaggtggcagcagtgcagagctcagggtgggcagagtgacctgctgggtggtcgggcatttgtggggaaaggctggtgaaatgagctggagggtggcttcagtgggcaggcccaggcccgctggcattctggacatcggactgtgagagcacaatggctctttgcagttacgttggtttttaaaattaacttttttttttagatagaatctcgctgtcacctatgctggagtgcagtggcgtggtctcagctcactgcaacctccgcttcccaagttcaagcaattcttcatgcctcagcctcccaagtagctgggattacaggcatgtgccaccacgcctggctaatgttttgtatttttagcagagacagggtttcaccatgttggccaggctggtctcaaactcctggcctcaagtgatcctcccttcttggcctcccaaagtgctgggattacaagcatcagccactgtacccagccttttaaaaattaacatttgacttattaaacttcacaattaaaaaactaaatttcatcagggtattcggatggctcctgaaaggtacaaatgtagtgttggagcccagtccctcaggaggcctccacagcgctgcctcatttataagcagttcccttaacattttaactacatctggaatgtaacggtttgttttctctttaaacatttgtcccatggagcacaacttcggtagaattctaacaagtcaaatgcagaagttaggtgaagtcagttcttggatactcctgtactgtcaccctggtcttatctcatgccttagcccaagctatgcacacaatggggtcctaggtccccctcccctcccagattccgccttcccagggatgggaccccctagaaccctcggaggcctgggcagtggcctcgctggctctcgccttcctaggagctgagcaggagctccactctcagcagggcagggtgccccagatccatgacttgtggcacgaaggggctccccaagaagctgtgaagccacagggccaggcttggggccagggctgcagccaacaggacacatcctggtgctgctcgggagctgactcacggctctgaaatcattcagtgatgtccacattcagcctttgtttacgatgctgctactttttcatggcctgaaattgcagcacacccatttttgtgccctgatcctctgctaattgtcatagatgtgtcggtgatgggacagactcactttctccacacgcacaggcctggtggccagcactgcccagcactcgggagctggtgggggttcctctcagcttgtaatcaggactcccagcctctgggtggactctcaatgctggtggactcacagcctgactagacacatcaccatccaactccgaaaggacagcccgccctcagcagggcttcctctctccagcttagccccggcacctgtctgtccctactatcttgctgtggcagtggcttccccagtggacacagcttccccctcccgagtggcagccgggctctctcctcttggccccaagggccctgtgccgggctcccccagtaccatgctcacatccctgcctgagaggctggacccctgcaggcttcagctctgcccctgctgtgggtggctggggagctctggggagctggggtcccctcccatgggtaagtggttctagactatggcagctgctctgtcctgtgctgggcccagactgccacaccacccaccctcaaacaacccgagttggctttggccaaggaacaaaccagccccaaacttagaggctggaacagtggcatgttctgtaggccaggggtgggctggctcagctgatgcttctgctgctggctgtgcctgtgtccctcctgcgtctgtgatctggggccggtggggcctaatgagctcattcatggctggtgtagtaaaggagactacatcctgggtccagcgtcccacaggccagcccaggcttgggcacgtggtgggctcaggcttccagaaggcctggagagggcaagcctctgcttgtgtcacctttggtacctccctgttggccaaagtgcctcacgaggccaagcccagatgccaggtggagtgagccactgtcctgtgctgggaggagccgcagtcacatggcagaggctgtgcacaccagcaggggagggggcagccagcagtggcacccggctctcgggttcatgtcctggggttgaggaagacacaagatggaagccagggcgatgtggcagagatgggtgcctgctttagactgggtggtcccgacactggagcccagcccagggatggagggaaagggcctctggccgatgggtactctgggagccagggctggggcagatggagaacaggggaggtgaggccctcggggagggagtgggaagcacagcacaggcactgccagtcacccgggtgatgcgtgagcagcaggcggaactcgccccaggctgggggacccagtgctgtgcagaccagcgaagtcgggatacctggatatagtaagctggagatgaaacttgagaactgtcactgcgtggatatttcaaaccctgagaatctttgtaagaccctatacggggtggtgtgaagacaggacagagtggaggccccaccccagtatctgagcagtgctaatagatgtataatgcaagccacatctgtaatttaaagttttttggtagctacgttaaaagataaaatgaatttcaagaatacattttaattaacccaaaatatacaaaatattacttcaaattgtattcaagttgattttagaaaagcaatgcggcatcgtgcatttttctagaaagtctcctaaatcccgtgtgtatttgacatttgcaacacatctcgattcagagcagccgccttccgaggactcgggggctggtggcagctgtgtgggacacagcagctgtggggatggggcagagcagcagcccacagagggcgagggcaggggccggagaccagtcataccacagaaccctggaggggcttgaggaagggatggcaggagagctgaggagcttctctgccctgtggggcaggctgctgggtgggtcaaagccccagaagggctgcacctccaagaagggaggtagaggagaggtgggagagaggagggtagggaaggcaggaggggggccttgttggctaagggctgaggcctccccagggagaagagtagggcagcccagcagagtcctgctgggaagaggcctcactgggagagggccggacagagcctatatcccaaccccacttcaaaggggataaagtctggagagtgtagatgggggacctggggtggcaggacagggtcagagctgggacaggggccctgtacccctgcaccggggacagtgtcctggaattagccctcagctcctggctttacctgcacaggatggaggagctgcgcttgcatcctactgtactttggacagctgctaggcatgtgtgaccagatcagcttcccgctgggtgaatggggccctccctggtgcgatggagtgtggtgctgggcctgggcctcatggcattatctgcccccatgcaggccaggctggctaccctgtgtacaagtatagggctgtaggtgctgtcatacgtgtcctgccacgccctggagaacagcagcctcgtgaagggtgcccgtcgggagcggcagctgctgtggctggagctcttgaggtggctccgaactggcaacctcttccattgccccacctagcacccccccgcccccgcccaggccatcaccacagctgcagccaaccccatcctcacacagattcaccttttttcaccccacacttgcagagctgctggaggtggagtcaggtgcctcccagccctgccaatggtgggggcactcaggtgtgggctgaccctgatacctgcctgggatagccgctggtaactgttaggaactttcctcggatgtgtgggcccaaggcccccacctctgtgacccccatgtccttggacctagaggattgtccaccttctcccaaggccagcccacatagcccgagcccctcggggagcagtggccgggctggggaggcctgcctggtcaataaaccactgttcctgcagctgagagccctttgccctcacacagggtcagctctgggcaacaaagagggagtggctcagacagggtcagagaagtctcatcccaaactctggcttccagcatcatctgttcctggaggccaggccctgcgcagacctggccacccagggtgctggacacccccaaccctgactccacaaggacccagcagggcccatgggcccaggccagcacggaggggactcatgcagatgcagaagccaagctccccaggtggccctggcatgcctccccgcagggctcctcctcaggccattcctgccaccctgagtcctctatcccagtgacctgcatcaggctcctcctagtggttcccacaggacactgaccaggctgcggcaggcgcatacttgcactccgggccttctcccatgctctccagcccccagccccacaaagcaggctggatgtggtcctcatgccctggggcttggatgggggcccctgtacagatggcagtgacagcatcctgggaccagggctggggcaggaaaggctggagggtcccagtctccaggcagggggaggggtggtgggctgggcacacagcccaggaaggggcccccaggtagaggcctctgctgcaacagaggtgggggccctaccagggccccggttatggcagaacctgcagctatcacacaagccacatttgggccacactgaggcatctttatttctctgggtcacacagagcttgggcctgggagcctcttctgcatgggggctgcagctgccaagggagcggctgagaccagaacaagcgctcgggtgggccccagtgcaggttgggatgtgcccggtggagtaaggtgtgagaacccccagcctcactctctgcctggtcctgaagcagacagcagcaggctggcccagcctcccctttatgagactatcctagggtttgacagcaagtcccagatgaagggtgacaggcagctggggtccacctggtctctcctcagcagggggaaccccctgcgggcagctgggaaggcagtggccaaaggtcaagaagatgaactctgcccagacttctgctgcctgtggctatggtgggacagggctgcctttctggtcacactgggcagcaggcgactgccagggacctcccagtcccagggctgcattccctgcccggcagcccctctgctgcagctttcggatgagttccagcaggttcatctgcagcatcagctcctgggatacagaggggccccatgaaggccagagtgacccccaggcccctttcatcccggcccaagggtgccaggcagtgagcccacgggggcgaccatcctgtgaagcctggtcatggcctgccaggacagggtggaatctgagcttctgcccccaacagggccactcggaatctgagcctctgcccccagcagggccactcggaatctgagcctctgcccccagcagggccactcggaatggcatgcgggaggggagcagaagagggccctgtgtggcacagcaggcctggagagggtgggcagtgcccatggctggctggctcaccctcctgtagggaatgggcctggcctccgtgctgggaatggcacagaaatcctttccagagcctcaatccttccacttcacccccataccctgagcctggctccccagggaccagcagtaaaaccccagatggaatggggccccggggcactcgggctagggcagagcaggcccaggcactgacctgtgggttggtggtcacgtagaagccagccacccccgccttctccagtgtgctctgctggtcagccaccttccggtccagctccaggatgatcttctggtccatcgcccgctgctcctcacggatccggtgttccacggcctgccatggggccagggcgcggagggggagaggtgagggcagctctgccatcagggggcggggaggtgagggcagctcaaacacatgctcctgctgccgtccccagtggcagcagctctgacaccaccggtgcatcctcaccacacccaggcctctcctcggccatgtgaacccctgaagggggccccaaggggcttccacgaatgccctggcttgggactgccttaggaccacacacacatctccacaggcacaccctgccccacggcttgttggttacatgccagtctctggttgtccctgtgctccctgggagaaggatgggccccttcctggccccaacaccctaccattgcctttgtacccccctgaggccacctgctctgtggaggcccaaacccacgaggagctgctatccaggggagcactggtgggttctcaacctccacccagccccagcacacttggtatccgcaaagaggagccacctggtgggactcactaggcctccagtgtcccactcaggcccaggacagccacccatgcctgagcccccacaccccttcagctcagcccagtcagcagagccaggtggtgcccacaggagagctgggccggccaccctgcctgcgcccccagtacctctagttctcgctgctgagccgcctgaaccacaggcaggttgtggggccggcaggcctgctgggcttcctggtgcttctgccgcagcgcctgcctgagcactgggagggatgagagcccgtcagcaggcggtgggactcggcagcagccctcacccatgggcacctgccttgccagcccagcagagcagccaggccaaaggggtgtctgcagtggggaggatgccagcctcctccatcctcccaccccactgtcacccagggccgggcccttatctggtggcaagtctccaggggactccagaaggtgcggggcactgaaagagtggggtggggaagactggccaggtggggccaaagctgcagccccagacccagggcagctggaggaggcaggcgggagggaggctgcagtctgagggcttcagggcccccatggccacaggccatgagacatctactcaagtgtcagagaccacctcaggcaaaggcatgggaaaggagcaggaggagcggggtcgctgaccctgagcgtggggcctctgcctaccaggggtgtggtcgggccctccaccctcagtgctgcccttcagggtagacagcccctccctcatttgcagctcccagcccccgcacagcgccagagggagaagggtgggcagacctgggaggcccaagtttgggatgagcttggggtgccataagcctgtgtggctctgaggggctcaccctcagccatcaagtaaagctccacggtccttgctaaactgtgcacaaacacagatgtgtgcaaactgtctggtctgaagggaatgtacagaggaagcgatcatgggacataaaccaccatgaaacagaacatgcagcaccccacagctggcgccagtgaccagtaagtgccaaatggctacagctccccaggagggaggggtccctggccaaaagaaaaggtgaaacccaacactctgttcctgggaagagccctgatgttgcagctcttctctggtggccagtccccagggaactccagggcccctgaggctcccctgcaggtagcctggctcccgctgtgcctacagccttccccgatctcctgtctcttcacattctgtacacacctcgacgatggtatttaccaaaagcccccctcaagacagctccataacacagggaagcagggaaatgtcatctccttcactctactgatcaaacattgctacaagtgccaggtccactaccagattccactagatagacaaccaaaaggcaagaagagagccacgctggctgcctgggcagaaggggcctggccttagacatgaccagggaacacaaaggaggcaggagcagccagtcgcccctgccaaatcagcaggagaagcagaaagtcaatgcaggcatgcctgctgctggtggaaccagggcctggcccaaaccttctgaagcacaaacagcattgggcccaggcagttactaaaactccccatcctgctataaggaactatagctctgtggaaaaatggccgattccaggactgagacacggagaaaacaagaaaagatgagcctgaacacatacctgaaccagaaagcaagaaagtgctcacagaatgatggggcggcatctaaaggtgcctggagcgcccccaactggccacacatggcacagtctgggcattaaggaataatgagccatgcgcttgggattagtaaactacatacatcttacagctcaataaaaaattttaaaaagacaatcgcccagacatttaggggaagaagtaatgccaattctacacaaactcttctggaaaactgaagaggagagaacacttcgaaactcatcctataaggctggcaaaaaccctgatacccaaaccagatattacatgaaaactatagaccacagtttatcatgaacatagaccaaaaaattcttaagattttagcaaatcaaatccagcatacataaaaaggatactacagcacgacccagtaggatggaattcaagtgactgtaattcactgtagtaatagaaaatgattcaccacgtgatcatctcaagagctgccgaaaagggaactgccaaaatccaacatccattcttgataaaaacacaccaatcctggagcagatggacactgcctgccttctggggaagggggccttgcactgctaggagaaatttttgccacattaaacctgcttctaatcaggcttctaccagcagtccagtgtacaggaaacccagagagtggagaagcaggttaaatgcaagaggaagcatttcgtctgatagatcaagagcagggcattctataaaattagaatgccctggactctacaaaaaagtcaatgccacaataaatgttggggactgtttcagaagcaaagagaccaaagtaaccaattgtagtacatgaacttggactggatccttacttataaagcaacaatttgccacaagttaggtaccatgatgtggccgtgcactgaaagtcaggagacacccggaacagttaatttctcagggggctaccttctgcagctgtgtaggagaccagttttgttctagagcacttgctcccaatccaaggccaaggttgaccccaccacccaggttgtctggaggcattcttggttttcaggactagggagggtacccctgccatcctgcaatgcgcaagacagcatctcaccaaaaagacttacccagccacaaatgtcagcatggctgggttgaaaatcctggtctccaggaatgctgaagactcttggtgaatgctatgctgtcacatgtatatattttgggatgtcaagaactagagcaaaacgttaactattgaactttagtgaagagcacaagcgtatgcactatactatcttttcagcttttctaaatgttttaacttctaaaataagaagtttgggaaaaataacaaaggtggaaactgatggtgcagggggacctgccctatataatttgcaggaaagggctcccaagcccaccaagcaggcctggctcaagtgggaagctcttcgggtttgggagggcgccacaggagacagtgcttaggaatttgatgtgcaactggaatgaggccctgcgaggcctgagagggaactgaccctgaaagacgcttgctgcacaactgtcaacagacttccaactactgaggggcaatgctgctgcagtcagcgccaccaccagagtctgcctgcaggccaatcaggcaccgaggcctagggccatcctgtctggaagcgcgtggggcacagggaagcccgaacagggagtttctgctaagaaggtgggtgctgcgcaactgaaaacaaaactggttggacccactgatcaccaaaaaggcgctgtctcagtctctgcgcccgttgattttgtcaatcttagagacctcttccgaacacttccaaggaaggagctgatctgcacagataccaagagctgcccggaggcgccgacccggaggaggcggcacctcatcccgctgcccccgcgcacctcggtgctcgttctgtaggcgcaggcgctggttgtacaggctcttttcggtgaggtgctggatctccagtagcccctgcacgatttcgaacacggtgccgtcgagaagcgccagggccaggtcgctgagcgtggtgtaggacaggcgctgctggaaagagctgcgggtaggggggcgcggtgagccccggcgggaaacgaagccgcctccgcaggcctccgcccgccccgcctgcgtacctgggcaactccttcaccaggctctgtagcgccgacagcaactggtagtgtcgctcctgctgccgggcaccgtccgccacctcctccaaggcggccgcgtagcgctccatggcgcggacgcccgctagccgccggcggcggcgacgagctcccccagcttcacgacatcccgagcgcggcgcgtcccgccccttttacgattgtcccacgcgcggcgcgctccgcccccttttacgacagtcccgagagggcctggccgcctgccccgccctgccccgcgccccgccgcctgcttattcaggaggcgcgccccgctcctctgcggagactccaaggagggttttgctcagcccaggctcgcacctgcctgctccccgcgcgacattaaaggcgagactccgccgtctggatatcgcaggaccacggagaatcccaccggcccttgctgagtcattgcgggccgaggtccgggctccgcgccggcgcgcctgcgaggtggactgtcccggtcaccggcctccccagaggcaggggtctcgggccagagcccacaggacctgggtctaaggcaccatccgcggccgagcagtggcgctggggtctgtctgcgtcctccccgcccccggggtgagacagacaggaccgccctagagcctctgggtcaggacagtcggagccagagtccccatctgggcctccgtggcccccagcccgtgagcccagactgcgctctccccgctccacaggccagctgctgggccggggctggggggcttctggtggctggggctgaaccgtctaggaacaggctttaataggaggggctcgggtggaggaatggctcctgcaaaggccctgccagagtcaggtcaggtgggtgggcgagaggaccagtgtggccaggctgcggaagccagcacaggagacaagggcgggtgctgtgcattacagaggctgctgggggcttgtccatagagcagcagggggcacggaagggcttggggacgcagacacgatcagacttgcatttcatcaggcactctttagctgcctgctgggtggctgggctgtgtgagatgaccctgctttgaccaggttaggaattatgactggtttccagagagaacattggttagtaattggctatggggaagagggggcgttgagccaaccaactggggtccccctgaagtgccagcaaagtgtctggttttctccaggatctgtttcctcagtccctggcaggattggctcccctgcacgccatgtccttgtggtcccttccagacagaaaccaggcatgaataaagtgaataatgacaagcgctcaggccactgccgtggagggcggtccacaacccagagctggtcatgcgccgggcaccctggcctccaggtccctcagaatggcaggagctggaggtgggactcgagattgtgggagctgagtctgtagtgagtgaccaggagccagctggggctgggcttggtcactgtcacctcccccggaggtggtgagtgggatgattagctgggtgaagacgcctgcctgtttcaccagtgtccctgccctcagtcccccagtccatgaagagtgtctgtgtggagactgggaggatatagggcagccccacgtgatgatatgtctgtggccagctgggcaacactgtcgccagctccggggtctgccaggtggggtgggggctgtgagccacagcaggagcaggccaggcctgggtttggacacctgctcctctgccttgtccgggtgctgatgcaggaaggccccttctccaacccttggtgcaacgtctgacctgaaccagcttccccagcccagcaacactgctcccctaatgtggatgtcaacctaaagaaacaaactgaaccacagttcatatagagagtttgtctgggccaaggctgagagagctgcccaggacacaccaagttgccctgggagtgcttcattcagccttattacaagcaagtttttaaagactgaaggggacaaggagtgggctgatatgaagtcagcaggaattctgactgctttccagagagaacccttagtgactggctataaggtgttggactactgggtaagagttatggtgtccagcgtatggctttttatgcctacttggtgtcagtctggaacccacagagcaattggcttcaagaggtcgttagctcaagtaggagtgggatgtgactgctgtttcattccagtgcctctctgggccagataattaaagggagctcacattcctcagataaaaaagttcctttcgcattaggagaaatacgtaatgtagatgataggttcatgggcacagcaaaccaccatggcacgtgtatacctatgtaacaaacctgcacgttctgcacatgtaccccagaacttaaaagaatatatatatgaatatatatatatactttatacatatatatataaacttccattgtgcgcgcgcgcacacacacacacacacacacacacacacaaagttccttttctttttcatggacatgagcagtatgtcactcaggcatggggactcctgggccacctctgggtcttcagggagggcctggtctggaaggaggggtctcatcctccagagccccagggatgggtgatatatgtgtaggaatgggggagctggttcgcagacgtgcgtttcccctgtgtgtgtggacacgatgggccccatggctcttcccgtcgggtggtatccaccgaaggcctttgctctgcggccactgtccacctccacttggcctcccgagtccaccaggctggctggtgacaccttgggttagtgtggggtgactggtgtgtgttggggagctgcaggtcccctgtctctgacacagctgtgtctgggcaaacaccaaggtttgaaggagtgggtgcctgtgtgtgtgtgtgtgtgtgtgtgtgtgtgtgtgcgcgcacgtgtgtcaaaaggctttgctgcatgccttttgtgtggctctttgtcacatgtgcctttctgtgtttctctgtgagttttcatgtgtcaggttgtatgtctgttgtgtgggcggagaaacagctctgctgtggggccctgagccattgcaggatccccataggccatgcagaggtgcacacagcacctgacctaagcctgctcctcccagaacatcaggctgcacccaggccaccgctcactccgtctgtctcccgagactgttcctcacttcctgcctcactggccctggtgagggtgaggctccctgcccccggccctcaaaacagagctgcagatgaggacgccacccagctgcagtgtcaaggggctcctccacagtgggtgtcccgcaacgcatgctctctgaccccttttgtttcagtgttgtcctttttagtgtgtggcaccaggacagcagggagctgccacctcaggcttctcttattttcactctgtgagtaataaggtctgaatgagaggggctcattgtgtctttactgtcaaatcagtcaggccttggccttggcatgtcttgcgtgtgcttgacaaatgtattgctcatggggtctggtggaggcacagcacccttttagaagacagggtctgtgcggaccagttacgggtgacatttcctaggcacagctcttgcctaagtggtgtgggatgggaggagggcggggcttcccactgtcccaccagcaaaatgggctgtgtggccagctcctcaggacccgagagcatttgctccaggttgataaaatgttgcggtgttgggtggcaagagtaggattgaaaccagccacccagttggtgctttgttaccatcagaagtgtttgctgagtcaaagcaaatggccactcaaaactgagtgggctgagtgtggtgactcacacctgtaatcccagcactttgggaggccaagatgggcagatggcttgaggccaggagttcaagaccagcctgggcaacagggtgagagcctgtctctacaaaaagtttaaaaaattcgctggcatagtggcatgtgcctgaagtcccagctacttgccacttgggagactgaggtgggatcacttgagcccaggaggtccaggctgcagtgagctgagatcacaccactgtactgcagcctgggcaacagaacaagaatcaaataataaataagtaagtaagtgagtaaatccatccatccaccccagagtgagtcagctggggctgctgcattgctcctccctcacccacaggattccctggttccagccaggagacgatggtcaacagccactgctgtagtggtgcctagttaaaactctttggtttctgtctctgtaaaaaaaagtgtctaattgcatttgggcaaaaaacttgcagtgaagagagaaaaagagatgaaagcaacctgtgagggaggctcgggttgacgtgcggcatgtgctgtttgagtgtgatgagtgtgtcggtttgcactgtagatgctcaggaagtgaggatatgtggagtgctgactgtatacatgatgcctccactggctggctgagtagagtttcatgaaacaatgttggtggactcagccctgaatccctcaggcattcagagagcaacctctgtcttttttttttttttttttttttttgagatggaggctcgctctgttgcccaggctggagtgcagtggtgcaatctcggctcgctgcaacctctgccttccgggttcaaatgtcctggctttaatttcacagattctttcttctgtttcttctgtttgatcaagtctgcaattgaaattctctattgcattttcatttcattcatttatttatttttatatatttttgagacagagtctgtgtcacccaggcttgaatgcagtggtgccatcttggctcactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgacctcaagtgatccgcctgcctcggcctcccaaagtgctgggattacaggagtccgccacggcacccagcttgcattttcattttattcattgtattcttcagttctagaatttctgtttggttcttattatttctgtatctttattgaacttttagttttgttcatctactattttcttgatattattgagttgatatatacattctagtaaatttcactgagctgtcttaaatcaattattttgaattgtcagacaatttgtagatctctatttttggggggttgattacaggagatttatgagtttattttggtagtgtcatatttgctgattcttcatgatctacagactttcattaatgtctatgaagaagcaaatacctcttcttttttttttttttttttttttgagacagagtcttgctctgtcactcagctggagtgcagtggcgtgatctcagctcactgtaacctccacctcccaggttcaaatgattctcctgcctcagcctcccaagcagctgggatcacaggcatgtgccaccacgcctggctaatttttttgtattttttgtagagacagagtttcaccgtgttgtccaggctggtctcaaactcctggcctcaagtggtctgcccgccttggcctcccaaagtgctgggattacaggtgtgagccaccatgcccaatctctttctgtctttatagattggtttcagcaggtacaaaccttttcctgctggatcccttgactggatcacagtcaagtgggcctggagccatatcacatggctgctgcctggtctgcagctgaatctctgattggcaggcctgctatcaaggcataggttagtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggtttactaggtaggtccatgggaagacaggactgcctccagaccacagtagagcagggctagagccaagtcacaggacagctttggtgaccacatttgggttcaagattggtggtcctcttattaggagaatggatggtatgtctttcaccaggtcccaggatgggctggactgtgcccagacgggcaaagcaagactggaatggagtcacagggctactttagtgtccatagctgacactgagatcagcaggcctgttaccaagggcatgtaaaggcatcactgaattcctgggcaggcaagactgactgtggtagagtggggctgaagccaggtcagggctgctttagtttctgcagtcaggaccatggttagaaggcctgttactgggggcataaatggtcatggttcctcctaggtgcttagtggatggggctagttgcaagaacatgatctagtggagctggacccaagtccataggaggacaaagctgctttcagtctgcaactgggaacctgtcactggtgtgtggacctgccttctcaaagcagctctccttggttttgggctttgctagagttttgccacctcctgcctggatattaaaactcttgcaaaggcagttttgtccatgaatggctccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttcccttttaagggggatgtcttaggattttgtcccttgtcttcatttcacaaatgaataaaacaaccagaccagacataagtaaaggaatacagcacttgaacaacacctgaaaaaacaactagacctaacagacatacacaggatattctacccaacaacataatacacatacttctcaagtatacatgggacattttcaggatagaccatataacacatcacaaattaattctcaataggggctgggtgcagtggctcacgtctgtaatcccagagtaatttgggaggctgaggcgggtggattgcttgaagccaggagcttgacatcagcctggccaacacggtgaaaccccatctctactaaaaatacaaaaattagctgggcatggtggtgcgtgcctgtgatcccagcttcttgggaggctgaagcgtgagaattgcttaggagcccaggaggttgaagctgcagtgagcagagattgtaccactgtactccagcctgtacttcatgacaaagaaaatgtaccattgtaccactgacagaacgagaccctgtcccaaaaaaggaaaaaagctcagtagatttaaaacgatagacatcatacaaagtgtcttctctgaccacaacaggataaagttagaaatcaataacagaagattttaaaaagttcacaaattagtagaatttaaacaacacactctcaaacaaccaatggatcaaagaaatcacaaagaaattataaaattcttaaagacaaatgaaaatgaaagcacactatatccaaacttatgggttgtggccagttgtggtggctcacacctgtaatcccagcactttgggagactgagggaggtggatagctagaggtcaggagttcaagatcagccaggccaacatggtgaaaccccgtctctactaaaaacacaaaaattagctgggagtggtggtacgtgcctgtagtcccagctacccaggaggctgaggcatgagaatttcttgaacccaggaggcagaggttgcaccactgagctaacaccactgcactccagcctgggtgacagaatgagactctgtctcaaaaaacaaagaaacaacaaaaaaccacaacttatgagttgtggtgaaaggagtgctagggaggaaatttatagctataaacacattaaaaaaagaaacacctcaattcaacaacataagtttacacattaagaaactagaaaaagaagaatgaaactaaacccaaagttagcagaaggaaggaaacaatagagatcagggcagagataaatggaaaagagaatagaaaaacaataaaaaacaaaaccaaaagttggttcttcaaaaagattaataaaactgacaagactacactttgggaggccgaggcgggcggatcacgaggtcaggagatcgagaccatcccagctaaaacggtgaaaccccgtctctactaaaaatacaaaaaattagccgggcatagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaactgacaagactaaggaaaagggaaacaatctaaattacttaaaacagaaatgtatttgagaatatctttatatatttctgtctgtctgtctgtctgcctgtctatgttttagaaacaagtgtctgtctatgttttagagacaaggtctagctccatcgccctggcaacaatcagatgcaaccacaatcagtggcacaatcggctcactgcagcctcgaattcctgggctcgccactatgccagctcttttttttttttttttttttaagagacaggatcttgccatgttatccaggctgatcttgaactcctggcctcaaggaattttcccacctcggcctcccaaattgttggaattacaggcatgacccaccattcccagcctagaaaggattataaaagattactataaataattgtgtgctcataaattggataacccagatgaaatagatgaattcctagacacacaaaacctaccaagactcaattataaagaaacagaaagtcagaatagacctaacctagtaagggaattgagtcagtaataagacaatctcatgacaaagaaaagtcctggacctgatagctttactggtgagttctgccaaacgtttaaagaagaactaacactgattcttttcaagcatttccaaagagtggaagaggagtgaatacctcttaactctttctatgaggccagcattaccctgataccaaagccaaaaacactataagaaaataaaacaacagatcaatatgcctctgatcattgatgcaaaaactctaaaaatactagcatactgggtggggcatggtggctcatgcctgtaatcccagcactttgggaggctgaggtgggtggatcacctgaggtcaggagttcaagaccagcctgaccaacatggagaaactcttgtctctactaaaaatacaaaattagccatgtgtggtggtgcatgcctgtaacctcagctactcgggaggctgagacaagagaatcgcttgaacccgggaggtggaggttgtggtgagccgagatcatgccattgcacttcagcctaggcaacaagagcaaaactttgtctaaaaaaaaactatcatactgaattcagcatcatattaaaaggattatacaccatgaccaagtgggatttattcctggaatgcaacgatgtttcaatatataaaaattgatccatataaattcagacaattaattttaactgatgtatagtttcacattatatgcacataccacgatttacttttccattttcctagtaatgagctttaagattatttccaatttttagctattactaataatgtttcaacaaacacctttggacatctcttctgcaaatgtgtgtgtattctcttggagaaggtttaccttgtggaatttctagtgtgtatgtgtatgtgtgtgggtatatatatatacacatatgtatatattttcaactttactatatatttccaaaaaactcttcaaagtggcagatttaaactccccttcgccgtatataaattcacggttcctaaagcccttggcatagttttgtgtttttatagaaaagggcataaagtcttattgctgttgaattgtaccttgctcttttcaattgtcttttcacaataattcactatttatcatctgttgtgaatattgtggagtagttcttaatcattttttctactaaactattttatatcattaatttgtagaaatcctctttatataatggatattatacttttcaattatatattttgtaaatattttacccaattttctggcttgcatttaacctttatttaggatgcctaggatttttcattttaatacagtctaatttatttttcttttcttcttcatgcattctggcatttgattaataagccatttgttgcccaacgtcattagttctctgtatatacttttaaatatcttaaacatgtaatattcataagtaatttcacaagtagtttaagatttgagtctgtaacctaaatagatacaggattttgtgatatgctgtaatatacagatttttatttatatatggataaaaatttatatgttttttctgacagcatttattggatagtataatttttctactgacttttagtatcatatcttttattacaagtccaatgtattcagcatacctatggatctatttcttggtgcttccattttttcccattgtttaacggtgtatcactgagccaaagcaaaccattttaattattataattaaaacacatttaaatattgataggctattattgttcaaaataactttggttcttcctttccgttgattactttaatatgacttttccaatcaagttctaaaaaaatactggtggtatatttattgaaataactttaataaaattaaatgaaagatcatgtatttgttttctgaattaattcttagatacattaatgttttatgttaccatgaatgtgatattataatataatatttttaattggttgctactgtttataagaatttcattttctgtttactttgccttcatatctgaaaaccttgctgatttgattagtgcatccacaaattttcttggattttctatgggtaattacaaatctccacacaatgaggttgcagtgagccaagatcacaccactgtactccagcctgggcgacagagtgagacaccatctcacaaaaacacataaacaaacaaacagaaactccacacaatgacaacgtatgtgttttctttttttcttcctctttctgtaatatttctttgtcctatcttaactgaactggccagaaaccccaggacaatgataaatacgagcagtgtcaacagacatctcattccctttcctagcttttataaaaaataacgattatgcttcaacattacatatggtggtgtcgatggttttgttatagataagcttatcaggttaagaaatttgtctgcttttcctagtttggtataaagattttaatataaatgaatgttgtattttaccatcttatttttttcctacatctgctaagataatcctgtgttttccctttttcaatctcctaatgtggtgaatgacattaaaataccttctattgttaaaatattcttgcaacgctgtatagaaccaatgcctttattctgtattgctgatggatttttgaaaaatatgtaggtggacttagttttctaaggggaatagaatttctaatatatttaaaatattttgcatgtatgttctgaaggacattggtgtgtcatttctataccatctggctacgagaggagccgactgaaagtcacactgccggaggaggggagaggtgctcttccgtttctggtgtctgtagccatctccagtggtagctgcagtgataataatgctgcggtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgccttggatcatctgccactgatctctggtcaacatttttatcacccaacacaaaagaagcagagatttatcaagttacttaacctgaccctttcatcttttgctacacatactcttgtaattgatctctccatgaattgttttctgtttaaaatatctagaatgttttctgcttcctgacttgattctaatattgtataggtactagaaatggttctagaaatagatctttatagatgagaatctggaagtggtttgctgacctgtttcagtctgaatgaattcctgaccttcttgtcgggaggagacagaaacctgatcatctgtagtgtacggtggtatcatgattacttaaatcatcaaatgtggttattgggaatgatgtgttttttaaagtggtacatgagaggtaaaattgctattgtagttgactgttgcagttataattttgtcaacatggtctgtaagagtgcaatggcgtcggcccggtgcggtggctcacgcctgtaatcccaatactttgggaggccaaggtgggccgatcacgaggtcaggagatccagaccatcctggctaacacagtgagaccccatctctactaaaaatacaaaaaattagccgtgtgtggcggcacacgcctgtagtcccagctacttgggaggctgaggcaggagaatggcgtgaacccgggaggcagagcttgcagtgagccgagatcgcgccactgcattccagcctgggcgacagagcaagactccatctcaaaaaaaaaaaaaaaaaaaaaaaaaaagagtgcaatggaaagctggtagaaaatggacattgtttaaagaccaaaacaaccacactactttgctaatccctatcagctaaagactagagaatatatgaggcatagatttacgtggtgtttgactaaggcatgcagaatataatcttgacataggctaagtttatcaacatagatacatagagattctaaagttaaagtcttagcccaagaagttagaagtggtgctcaagtttgtttgtctgacagaaactgtgaatccacactggcctgcttattttgaggttgcgttgccagagctttcctagcataataaagagaggtgcatacaaaggaataggaatagtaggaggtgggggtaaaaatatcaggtgtgatccacatgccaagccgacccccactgtgtcccacaggaagccccagaagatgtttctccaagaaattaggattcgtttgttggggagggctgctggcatgcttgaaaagtactgtgacggctgaattttgtgggcttggggagattgcaggttctctgatttcaaggggaatgatgtgatcctagagttgcaaagaacaagtgacagtggaggcgcttatgctttgtgactgcactagagacaaggaagacacaactagaataatggggagcaggaatggagcggccaacagaatatctgactgttagggatctttgatgaaggctgattctcagggagtgaactagatcagtgaccaactatttgtctttatataactgggtagtgtggatggattctaataaagggactacttacagcacagcaggaaagtcacaaagaaaccagacagaagagtgtaagtagtaaggggccaagcagtcatctgactagagacagtgccagcttgccaaagaaggcaccagacagaagctgtgatcttcagcaaagggacacagtctgcctgtgctgaccctgcaggggcagaggtgggggataaacacactcttctctcacctatcttctgccaccccctccattagctgaaccccaataaaagcatgagggtaagggagatctctgaagtatccaattcaggtgagcctcctaaggaacaaagcagaatgcagaaaaattaagagtgggtctagggaataaaatagagatatgcaccagagtatgatgatgtgtctgggaaagaatatacaaatacttttaaaattactagacaataaacctgagatgacactaatacaggtaaatctcatttaatggtaatatattccaagaaatgcatcattaggtgattttgtggctgtgcagacaccaaagagtgtactttatacaaacctagacagcgtagcctactacatacctaggctatatcgtacagcctattgctcctgggctacacacctgtgcagcatgtcactgtgctgaatacagtaggccaatggtccgcaacacccaagccatggaccagcaccggttcgtgtcctgttaggaactgggcacaaagcagtagatgagtggctggccagccgagcattactgcctgagctccgcctcctgtcagatcagcagcagcattagaccctcacaggagcgcaaaccctattgtgaactgcccatagaagggatctaggttatgttctccttatgagaatctaactaggctgggtgctgtggctcacgcctgtaatcccaacactctgggaggtcgaggcaggtggatcacaaggtcaagacaatcctggccaacatggaaaccccgtctctactaaaaatacaaaaattagctgggtgtggtggcgcatgcctgtagtcccagctactcgggggactgagacaggagaatcacttgaacccgggaggcagaggttgcagtgagccgagattgtgccactgcactccagcctggcaacagtgggagactcagtctaaaaaagaaaaaaaagaaaaaaaagaatctaactaatgcctgatgatctgaggtggaagagtttcagcccaaagccatccccactccgtggaaaaattatctttcacaaaaccagtccctggtgtcaaaactttggggcccactgctgtaggcagttatatcacagtagtaatatctaaacatggaaaagatacagtaaaaacatagtacattgggagaccgaggggggcggatcacctgaggtcagaagttcgagaccagcctgaccaacatggagaaactccgtctgtactaaaaatacaaaattagctgggcatgctggcgtggggctgtaatccctgctactcgtgaggctgaggcaggagaatcacttgaaccccggaggcagaggttgcagtgagccaagatcgtatcattgaactccagcctgggcaacaaaataaaactccttctcaaaaaaaaacaaagaaaaaaatatatatatattacaaaatttaaagagagtggtacaccagtaaaggacacttagcatgaacagaagttgcaggactggcagttgctctgatgagtcagtgagtacttggtgagtgaatgcgaaggcctaggatattactgtacataactatagactttatatgcactgtacacttaggctacactaaatgtatttaaattttttctttctttaacaagttcatcttagcttatcatgactttataaacttttaatttttttaattttttgattctttggtaataacacatcttaaaacaaaaacacattgaacagctgtacagaaatactttatatccttatttgataagcttcatttattttgattttttatgttttaaacatttttgttaaaaactaagatacaaacacacacactagcttagccctgtaagggtcaggataatcaatatcactgtcttccatctcgaaatcttgtccaagtgaaaggtcttcagggtcttcagtggcaataacatacatgcagctgtcattttctatgataacaaggctttcttctggaagaactcgtggaagaccttcctgaagctgttttatagttaattttttttaatgagtagcagtactacactctaaaaatatgaataaaatctatagtattatacatactgttgatccttgaacagtgcaagggttaggggaccagctcctctgcagttgaaaatccatatataattctgggatatccccaaacttaacttaatatatgatatatatcatatataatatatatgatatatattacatatgatatatatcatatatattatatatgatatatattatatataatatgtatgatatatattatacacaatatgtatgatatatattatacacaatatgtatgatatatattatacacaatatgtatgatatatattatacacaatatgtatgatatatattatatacaataagtatgatatatattatatacaatatgtatgatatatattatatacaacatatgatatataatatactatatgatagagattatatacaatatatatgatagagattatatacaatatatatgatacagattatatacaatatatatgatacagattatatacaatatatatgatacagattatatacaatatatatgatagattagatactatatatgatatagattatatacaatatatgatatagattatatacaatatatatgatatagactatatactatatatgatatagattatatactatatatgatataaatggtatatcatatatgatataaatggtatatcatatatgatatatacaatatatcgtatatatgatatagatgatatatcatctataagatatagatgatatatcatctataagatatagatgatatatcatctataagatatagatgatatatcatctataagatatagatgatatatcatacctgatataggtgatatatcatatatgatatagatgataaatcatatatgatatagatgatatatatcatatatgatatagatgatatatatcatatatgatatatcatatattatataataaatgatatatattatatataataaaagctatatattacataataaatgatatatattatgtaaaatatatgatatatattatatattatatctgatatatattatatattatatattatatattttatctgatatatattatatttgatatattatatattatattatatataattatattatattatattatattatatatattttatattatattatatataattatattatattatattatatattatatataatttatgatatatataatgtattatatataatttatgatatatattatatattataaatcatatatcatatatattatgctatattatatataatatagcataatatatcatatattatataatatataatataatataatataatataatgtaatcatatataatatataatatattatattataaaatatattatattatgatatactatatattacatattacattagataatattttatataatatataatatatattatatattatactttattatattacatatataattatacattatatttcatatataatttataattatatataattatatattatattatataatattatgtataatatattattaaatataatattatatattatattaaatataatattatatattatattaaatataatattatatattatattaaatataatattatatataaggatgcaggatgtaaaaggaaattatatatatgttatatattatatatattatattatatataattatatatatatttgggggtgccctatttcctatctcataacttattttaagaagcacagcataataatgtgtggacttgggattcagtttttgaaacgacacactgagccttccatgaccttcctgtacatgtgaaagcacacctgtctgcatggcagcatttggacctcacagtgtggattgtgccttcaccctggaatgtttatgccctatcgccatggtgatgtgattagggatctgctgcccttggtcctaagtgccactatctgtgctgagtttttcaaaggtcagagcagattgaacctttgtggttccattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatggttaggttttattcctcaatttatatatttgattcttataccaagcagagtacctttgaaatttttcttcatttaaaaaatatgtatcttggctcaagcctgtaatcccagcactttgggaggccaaggcaagaggatcacaaggtgaggagatcaagaccatcctggccaatacggtgaaaccctgtctctactaaaaatacaaaaaattagccaggcatgatggcagctggtgtagtcccagtgtgaattgggattcagtttattcccaaattcccaaaatatatatatatatataatatatattatattatatataattttatatataatatatattatattatatataattttatatatatatatttgtcggtgccctatttcccatctcataacttattttaagaagccagcataataatgtgtgggcttgggattcagtttttgaaacaaaacactgagcctttgatgaccttcctgtacttgtaaaagcccacctgtctgcatggcagcagttggacctcacagtgtggattgtgccttcaccctggaatgtttatgccctatcgccatggtgatgggattagggatctcctgcccttggtcctaagtgccactatctgtgctgagtttttcaaaggtcagagcagattgaaccattgtggtttcattttccctgattttgatttttcttatggggaacctgtcttgctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccattacagtgaaaccctgtctctactagaaatacaaaaaattagccaggcatggtggcagctggtgtagtcccagtgtgaattgggattcagtttattcagtttattcccaaattcccaaattatatatatatatatatataatttccttttacatcctgcatccttcaacgttccatcccccaccccacagattaagttattccccaggggagaatatggcaaagtctattttaatgcagtttttaacccaattaagaacctatgaaatcattactttccaaaactttggaacaaagccacagtagtatggatccgttggaggcttttcacacaataaaatgtacatctctttgtttttaacatgtttttcccttcctctcttctttttttgtgaaatgtgtatttactttaatatatttgtagtaagtcacttccatgcacatattaattttttaaagtaataagtatgtgtattgtctacgtgtgaaagaaaacacacatttatttttatgccttggaagttatccagaatcatggaattgtcaatcacagtcaatcacccaacctactcacctttccagtgtaatcttagtcaaattttttttttgttatccaatgagatgcagtatttcaactcagaaagataaatagagtgaatttatagagactattaactaagaacatacagttttatttatactcagaagcaagtagattatgtacatatatatgaagataaaaattaaaaggataattgtgtaaatttgcatgtagagagctttgaaaacctgtttacttgttaatgctgttttgatgtattgtgtctttgttctcccgacccatcatccagagctctctgcaggagctaagtgctcatcagttccatgatttggaaactgtctaagtttagaggcacttgtatttgttagtaaataaggcaagatgatattgtttcacaggttttagtgcagaagactgaatagataagctgctccacccagtacactggtgttcatttcatggtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaacattcacacataaacaaggcagaaccctataccctccatgataaatgcagtagcagtgtatgtgggtctgtggaggttgaaagggacttggtagatgtcaagaaggtagtggcagtcctgctgggcttttaaagggtctgaagaagtgacaggatgctgtggttgaatcctagcatgtattttagcatttgttcatttggagttgattatttcacgttgctttcatttgccattacctggaaagccaagggctctactctcatttccttgctgctctttctttgccttccttggtccgtgaagaagatggtccaggagaagctcattccatgcttgttaaccaggcacgcccctaagttccagtccctgagtcattcatgagtagcactgccaatgaactgacagcaatgctgtgtccctccacatcccctaggtgactcgaagaagccttccaaaaagcgtgtgaaaaggaagccctactctactaccaaggtaaagtagcctgtctttgcctaagatgcaaatgttgttttcttggatcctttatttttcagttgatatcagctatgggaaaattatccactacattataggtgttagataatatttccttgggggtggaggaggtgtattttaccaactgacacctgattccagaggacgtgcaaaattggcagtgtcagatagtacactgggtgctaagggatgttttcttcaggaacaagctttccactttagataagaattctgcaatttctactcaaaaattacctagacagaaacattcttcaagaaaagctcctgtgctttcctaagggaactctactctagagttggggcttttgacttgaaccttatttccagtcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctacgaaaaaaatgttgtgtttacccagcacaactctcagtgccatgtttcttaatttaacaaatcagaccacatactttacttacattagttcacacctcatcatcatcatgcccatatgttgtgagcttgtttactgagcccacatgccagatggagaaactaagccacataaataaatgtgccctggttcacttgctgcatagtgaagagtcaaaatgtttactcatacggtgctaatgttgaaggcctgaactacaacctctatttatcagccagtgaagagatcactattcaccatgcaagggagttccagcaccctctatgcctggaattacccacacctgcagagatcccaaacgccatccctcacataagagaacgtcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaatgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgttatccgggtatccgtcgtccttgtggcaaccctcttgtgaagctggtgtggacagcctcagtgctggagctgtgcctgccttctgagtggaccctttctgtgttagcaggtgggtacaagcgtgggggtcagcacactcagtggatttacacacacagcgttgaagagtaaggctgggcttcattatttatacattttcaataaatgatgatcttcataacataaaatcaatgatgtagtacactagaatactgtccctagtattgaatcttgtctctcagcaaagggttgcttaaagtcacgtgacagattccattcaactgatggcacatgctgtagcagcagttaaagcagtcatttgaaaaggcttttactataaacttacgtgtgagcctgaagtgggggataaaagaggcgattagctcccctgtgccatgtttctcttatgtgcgtggtggaggaaaattacacaggaaggtgatggagagaacagagcaaaggattggacaggtccattgaacccataagactatggtgaggttagtgaatgagattggtcattttaggtcaaattttacccagagctggtgcagccactgcccattcttagccagaccttattgcaggcagctctgatcaatagtcaaggaggcagtgggggttgtagactttactcattaaatcaccaaagcaccagcccacacggccacttttccagttaattgacagtagcttgcacattcaggtttgatcagtggaagggaagttactctttgcagacccatttttgacaatcattttgcggtgtcggaaggtctgagcagcctcgggaggcaagcagtccctggtccctcagtgtagtcactggaggagacagtcactgagaggcagctggcagggtgaagggaaaggggaggcaggccacagagatgacagcctttaagctgtcatactgggaggtcaaggatctgaaagaggaaggagaattctttatcattaaggacctgtccttatctcaggcatttcctccagagcaccacctttgtccacccacacaccttgggctaggaggactggagaaagacagtgaggggtctcttgggtctctggcacagggcgtgatgaagagatggcagtttttcaggaatctctctctttagggaaccaaatacatttcccatctcaggtccttcactcagcggggttgaggttctgctcgtcacttatcatctctgaatgtcagcaccctcaagtgtaaaatctcagccacagcccctcctctgcaccccctgcagggctgatgttctctataaaccataaggcgtcatgcccacggaaaagccgaacaggaaagcatgctccactgccccggagccatccaagttccccctccatattccgccactgctaagtgtccagcttattcctcctggcatgtagtaaacacttagagaacattactgaagtaccagtcctctctaaggttttcctgtatttagtgattttttagccctgtactgtgatactaagaagtagggcttaaatagggcctaaaaagtattgctaaaattacattatgacagtgcagagaactgagggcagagggaggacatgagcttgccaggtccacatggcttagtggaatttgaatccgggcccccactctgcaccagccctgcactcacagtcatcctgctgtgttcccctctccaggaaggcactgcccacgcagtctgtctgatagaggtgttgagtgctcactgaactccgtgatcttcctgaaacccaactttgattcagtgggctctgcttggaagcctgtaaagaaaaggatcataagtttaaacttagaacagattatcactattttccctctggtcttctgtcagcaagatgtcaacagccctatctattgtcaatgcattaaccagcatcttctctgatagagaatacaagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgtttcaagctaatgtctagaacttacctggttgttaaacataagcatagatctccctgaaagagtggtgctatattattatttttcaattaatatatttctttagagagttttaaattgacataaaaactgagcatatggccgggcgtggtggctcacacttataatcccagcactttaggaggccaaggcaggcagatcatctgaggtcaggagttggagaccagcctggccaacatggtgaaaccccatctctactaaaaatccaaaaaaattagccgggtgtggtggcaggcgcctgtaatcccagctactcaggaggcggaggcaggagaatcgcttgaacccaggaggcagaggttgcagtgagccaagatcatgccattgcactccagcctgggtgacaagagtgaaactccatctcaaaattaataaataaataaataaataaataaataaataaaaattgagtatataatacaggaagttcccatattattctgtctcctcaccctcacttcctaatttcacctattagtaacatcttacattactgtggtacatttgctagaataatgagaaaatattgacacattattatctgaagtctacatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtacgctttagctgctttcatgtcttttttatgccttaatggcaaaaaatggcacattaaatcaccaaataatattgcattcaatgaatttttgtctttttattcacctgttgaagaattcggtagatttcatgagagaaaccatctgggcctggtgctttctttttcggaatgctcttaatgtgaattcaacttatttaatagacataagtttattcacattaggattctagcgtgaccttgggaagattgcctttcaaggaattgatacatttcactgaggttatcagactgcggtcatagaactgttcatgatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctgtagatttccctctaaggactgcttttgctacatccagaaatcttgccaagtcacattttcttttaatgtagttaaaagtatttttaattttctattgagacttcttaacccatgagttatttaaaagtgcattgctaatttgcaaatatttggggattttgtggctcttttacagttgttgattttttgttgtcaggtatgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggcgagggggcatcaacggcagttctgctgtggcactgccctccttcttagcttgtcttgctctgtcttaggctccctcaaagatcccacccttcaggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaatcaaggaaaatgtaatagttttccataaattagaataccctacatgtacaattaaatgaaatggctagtatagtcttgaaaccaaaaccagataaggtaaattaaattctgtgatattttaaaatactttaaattctgactaatgtgagttaatctcaaaatatgaaatagtagattaacattgaaaatgcaataaataaaattagctacctcaagagtttaatggaaaaaaatgtgattattgcaatagattcaggaaattcatgaataacattcaccctatatttgtaggacaactatctgattaactttaagtgacctgttacaaccacttgaattaatgctgctttcacagcatatctcttggcttgttaaaaacccgacaagaatttccgtaacattatttttaacacctatattgggtgtgaacccaccataaagtttgcccactgaaaaggtctacaatttgatgctttattaaattgatactgtgtgcacccaacaccacgatctaatttaaatatgtttccctcacccaagttctgtcttgcgcactggcagttaatccccactcccatctccagccctaagcaatactgctgtgacattccatctccataaatttcccacttgctttatagaaatggacatatatatatatttggaatctgacttccttcatttagcatactatgtttgaagttaattgacgtgttagcacgtgctggtcatgtgttttccttcatagtctgctgtgtttattcatacaaatagtgtttattcatttatcagttaatggacatttaattgttttgttattttctttgatgagtaatgtagctttgagcattcacatacagtcatgtaatgcataatgacattttggtcaaaaaaaatttttttttttctgagacccaggctggagtgcagtggcacaatctcgggtcactggaacctccatctcccaggtttaagcaattctcatgcctcaacctcccgagtagctgggacaactggcacacaccaccacgcctggataatttttgtattttcagtagagacaggattttgctgtgttggtcaggctagtctcaaactcctagcctcaggtgatccacccacctctgcctcccaaagtgctgggattataggcatgagccaccacacccagcctaatttttttaagaaagaagggaactattttctaaattacttttgccaatttatattcctaccatgatgcatagcactaatttcaccgtacaatgtatggtaggccccaatatgtaagaaatgatgaaagtaacacataaagattagtataagacaaatgagattatcgttgttgctatcatctttgtcaaattctgaaaacaatctgagtatatttttatataaatatgcttggcaacatagctgaaaaaagcattatcagttacatttatcagtaacaaagacataaatttgaagggggaaaaacacttgtactaacaatgcaatgtcagaattaacataaaaattctgctggtcactttggaatatttaattgcctggggcagtgtttagtagacaaatgagcatctatggagcacccaaagtaggggaatcaacagaacttgggtttcaaaagttatctgggtttagagcgtgaaactttgttagaggacacacaccttgcatgagtgaggtgccttggtgtgtgtggacgtatcattatgcttggaggtacagcataatggtggcttcctccagaaagggacatttggggtagattcatgccatctagacaacacagcctgatgtggcatggacatgaatggaggtgaaatggtcagtagttgagaggatcagtcctgacaagggccgaggtgaaaaacctgggaacaccttcaggtgcaaagtcttcagttgaaaaaggaggtggtcacaggaaatactgagatgggtcagcaatgcatgggagacagagttcttggccctgcagggtgagtagtgtggattctcaagttttctcctctctccattaatttctttcccaatgcagatgacttccatcatacagtcttcagcaaccttgaaagattggacaagcttcagcccactcttgaaggtaaaggaaggcagctaacaagactggcatctgggcttggctgtgcatgttttctatcgtggggaaatatatgtaacacattatttatcatttgaaccttttaaccaaagtgtgcactccgtggcattcaatatattcacagggttgcataaccaacaccactatctacacccacaattttgatgatttcttacaaaaccttgtccacaataagcaatatagcaccttccccctatttccagcccatggtgattcctatccgactttctcttgtatgaatttgactattctaggcacttcatgtaattacaattatacaatatattccttttgtgtctggcttatttcactaagcataatgttctcaatgtccacccatgttgtatcatctatcaaaatgatgttcgttttttacagatggatgatgtagcattgcatgcagaccaccttgcttttattacattcatttgttcactgatggttggattatttccaccttttggctcctgtgaaaagtgatgctacaaacattagtatacaaacatctgtttgatttctgttctctattctttggggtgcctaagagtagagttcctgggtccaacaggggttctatatttaaccttctgagccactgcagactgtttttcacagtggctgcaactttatccatttctaccatcaatgtatcagggttacaatttctttacgtccttgttcacacttattttcctttaaatcatcctagtaggtgtatattggtggctgcttgtgtttttcatttgcatttccctaatgactaatgatcctgagcagcttttcctgtgctactatctgtggctgtatcttctttagggaaatatatgttgaagtcttttgcccatttttaaagagttgtctgatttttatttagttagtttgttgctgtagatttttgaatatatcttaaatatatttaaaaatattctaaattttagtctcttacaagataaatgatttgcaaatatttccccctttgtgtagaactttagattcacaaacttcattaatttgtatgaaatcctcagcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgattagttcaccacacttgttgcaactgtttgcactgcagagttaaaacataccagcattcaacccatgtctcctgtcttgaagtaaactgtcgtatgttggctggcctgaacaagcgtagatattctccatcctcaattaatatgcatgcatgacaaagaaaaggaggcctggatgaaaaaatactgtgtgattaataattatgctttaattaattttaaaggatataatttcagtacttctaattctcccatcagcagttataacaaaggattagtgaataaataccatagactgttttgcctagaattgaatccaacctgtctattaaactttgcttttattcaagtgcaaaatgctaaaacacataataactgcagtgacagccactgtggatcctcagaggtaaaagtagtcttgggacataaatcctgcaagtaatattgtttttacaggtttagaaaaccatttagctgggtttcaaacctcacagtgtgagcagtgggactctcatcaaactatagcatgtgcttcagtaccatttgtagactgactcattcccattgccttaagttgccatcagcaaaatgccagggactctatttcttgctccttagctcctcgttcttgcctgtctttccacgagggaggattttctagcaggagctcaagctgtgcttttaatgaaacacatccacacacactgtcctgttgtccacattaagcagagctccctgaataactcatgaacaaaagcatctatgactaactgttgctctgtgtcctcctagcctctgaggagtctctagttcacaaggacagaggagatggagagaggccagtcaacgtgagggtaaggttgccttgctttctctgaaatagaaatgttcctttcttgttgtctttctttttcaactgactttacatgtgaaaagatgacaatgtccatgacaggtattaaatgcagttttctgagggggaggaagaagtgactcttagcaactgatatgtaatacaaaatggcatttagctatgatggcttcaggttgtagactgtatccttggggtccttgtccttggaagcaatgtcttctccttggattcagtattttgcacttgccaacctacgtggacctgagagatccaccatccagaagctgatgtcttttccagtgtgtatcctacccttgttttggaggccttgaagttgactacactttctgatcaagttttcaatattcattgagagaaacacagccttgtgcaaacaatccacaacatgacatacccctcaaaaagctttgtttctgtattgcaggtggtgcaggtggcccctctgaggcatgaatctagtaagtattctggaatcacttaccaagaaaacaatctggatgccaagaaaggtgtggcatccttgcctggtttcaatgtgaagagccaccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccacttatacaacccaatcaccagtgtccacttctaacaataaaatccacccccgctctactctctctgtacagtgactcctccaccctcaccagagccatccccgggtctgccttattatccccactgctcaggtggagaacctgaagggccaagggagtggccccagctcccgagttcctgaatgaaaaagtgaaaacacgaacccaggagtgtgggccagtgctgacgctgacatgcacttagtcatggggtgttcaccaccacacagggagtccagcattcatgtataaaccctaaggcaccgagcccaaaaggccccaggcactgcccatcatcataaagtggtctccgtggtcacacaacccagggcagttataggttcatctccccacggacaggcatagtcatcagtgtgtcaaaagcacaaagatccccaggtgtttggctcagctcaccgatcctttttttttttttttttaacttttaagttcaggggtacatgtgcaggatgtgcaggtttgctacatatataaatgtgtgtcatgagagtttgttgtacagattattgcatcacccatatattgagcctaatatcagttatttttcctgatccaccccctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgactggctagtgccgggtatggccaccagcccaactgaaacaaaatgttgctttaaaacaagtgtaaatctcatacatacaacaggcaaatgcagaagcagtgtggtctcgcaagttgtaaagaggacagtcgcaattttgctggacttcaacctgggtagaagacacgagggaactctgtcactaaatcacggcagagttcaaggccgcttgtagactatttcgtgttatagaaggtggcctttagctactaagcaaaggcctctgtttctcatttctttcctgttcatctccttggtcatccttcttccacaagggaaacgagcccaagcaaaaggcagtttcaatattaatttgaccgaggttttgtgcagttaattatcatccaggtaatcaggtgcaacccagtctgcctagcagcccccctatctctgctctgtgttttcatttaataaacattttggtctacttactatgtgctagattttctcgagaccaagtaaatgagatagaatccttatgttggcagctaagttagatttcacataactgacaaaaattaaaatttctgatttcttgtaaaaatattttgtatgtgtgaatgcatactgaatgtaaagtggataaaaaactcacacttgcactcatggaaggcttttcatgaatttgtcaatttttattttttatatttccccacttcactggataatgcatacctgaacctggaaactgatgcccactgcagaaagtgttctgagccacatcccttagcttcactagtgcaggtccacctgggaggatgtcccagcatcagcttggcccatgctgtgatcagccacctccatgcaccacaccaagcaagcccctgggtgattcacagtctccactaccagggcactgaccttaactctgtgttcttctagctccccatgaggacaccgtacacaacatcactaacgaggatgcctcacacgatatcactaacgaggacgctgtccacggcatcgctaacgaggccgccgacaagggcaacgccaacgaggacgccgcccagggcatcgccaacgaggacgccgcccacggaatcgccagcgaggacgccgcccagggcatcgccaacgaggtcgccgcccagggcatcgccaacgaggacgccgcccagggcatcgccaacgaggacgccgtccagggcatcgccaacgaggacgccgcccacggcatcgccaacgaggacgctgcccacggcattgctaacgaggatgccgtgcacggcatcgctaatgaggactccgtatacgacatcgctaatgaggatgccatatatgacatcgctaatgacaccgtacaaggcacgctaaagaggacgctgtacacgacatcgctaatgaggacaccatacaaggcattggtaatgaggacgttgtatatgacatcgctaacaaggacactctacaagccgtcgctaacaaggacactgtacacaacatcgctaatgacggcaccgtacaagacatcaccaatgagggcgctttatacgacattgctaatgataccgacaaggcacgctaacgcggacactgtacacgacatcgctaatgaggactccgtataccacatcgctaatgagggtgccgtatatgacatcgctaatgacaccgtacaaggcacgctaacgaggacgctgtacacgacatcgctaatgaggacaccatacaaggcatcggtaatgaggacgctgtatacgacatcgctaacgaggacaccatacaagccgtcgctaacaaggacactgtacacaacatcgctaatgacggcaccgtacaagacatcaccaatgagggcgctttatacgacattgctaatgataccgacaaggcacgctaacgtggacgctgtacacgacattgctaatgaggacaccgtataagacatcgctagtaactatcgcaagaacaaaaaaccaaacaccgcatattctcactcataggtgggaattgaacaatgagatcacatggacacaggaaggggaatatcacattctggggactgttgtggggtggggggaggggggagggatagcatcgggagatatacctaatgctagatgatgagttagtgggtgcagcgcaccagcgtggcacatgtatacatatgtaactaacctgcacaatgtgcacatgtaccctaaaacttaaagtatatataaaaaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacgaggcacgctaacaaggatgctgtacacaacatcgctaatgaggacagtgtacaagccatcgctaatgaggacactgtatatgacattgctaacgaggacactgtacaaggcattgctaacgaggacgctgtacacaacatcgctaatgaggacaccatataagacatcaccaatgaggatgctctatatgacatcgctaatgacacccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaacagaaatgttactttcctggcttctttccaatcagatgtagacatgaacatctgccagtgtgcattatcgatgtcatctgcagtttaatcaaatgtagacatgaacatctgccaatgtggactatttatgacatctgcaattcccttggtgtggtgctattgattggcggcctctcaccaacccatgccaggcacactggggtgtggtagatggcagcatccacgatccactgcaatgcagaggtgtttccctccacagcagttttcccccatggattaagagttgtgaaactgccaatctagatacactttaaagataaattctgtgggaaaaggtcttgtcttttccacaggtgtcttccgtgccagttttgggggactttgacctttgactcaatcactataccccttcttattttctctctcaagttgtcgagagactatcagatctgtgtgacgtgtatggcatcatttcaccctcctaatgttttcttttctataattgcaggagccattgacactggagaatgatacctaccctgaaataactcacttcctgaggaaaaaacgccatctctagggtacagaaacctgattctgggctccttttgggaaggaggatttggagtctggtgagagcaaatgattttgcaagtataaaacaatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaaggaaacaggaaatatgtgtcatattggatttggtcttttccgggtttattggcataatagttagaactgtctctctgggctatgagggtgctgtgatatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttccttcaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttggtgagaatcaggaattgaggctaaccacatctgaaattgagatgggccttgagtcatataaatagtttggaaaagatgcattttactacgctattgaaagaaaccatttatttctcactccagcaggataaatggttttcagtatccacttaactgctcattgactcttactgtagatgaggaggtggccagcagcccctgccctcccccagttgtaggcccaaggtaaccagcaattgactggatataatggaagagtggtgcattcggaggtatctgtattaatgggacccacatgatatggatgagagctattagggtgagaaaaagcctgggagcacaatgaaatatttaaatattaaacaaaacattgttgaaatctccattgtactttagtagttgaagtcattcttgtggtcatcactgcctttcccaagcataacaagctacttaatatcacatggacccgtgccatgaggaatgatgatcagtttgtcaaatgccaataaaacaattgcctctataagccacaatgtttcatccatatatttcaatttccatgtgtaagtatagttcaaatttcagaaatttattattatctaatagaatatgcatggtatatcaatgagcaattatcatactgtttctattaacaattatttgtatgatgaaaaaagcagactcccattcttggatttttctcagtttgcacacattagcatgacagccccatttccacctgacatgtgccagcaagaggccaggaacagaggcttttcttattaactaagatttctaaatgtattacgtattcacatttagaaactctaaatatcataaaaggttagcaaggaagtttcccttccactctgaacttccaaacaccaagtcaacgtttttgtttgcatatcatccctgcaatctatgtgcaaatagaagcatgcacctggaatgcaggctgatgtgtgatcgtgtttacacaaagtcctctgcacctctgcatatatcactgggcaatgcaccttagttatcattccacatttcaaatgtaaatccattgtattgtttcagagctataaagtactgcaccccatgactattcccaaaattacttaagcaccccgctatgggtatccgtttgttctgtttccagtcttgctcttataaccaatgctgtagtgaacagcactgtgttgagaagcggtgaacgtgggcatctttgtcttgttcccttcctcagggggaatgctttcaactctcccccattcaggaaaatgttggctgtgggtttgtcatagatagcttttattaccttaaggtatgtccgttctatgctgattttgacgaacggttttaatcataaagaaatgctggattttgtcaaaggctttttctgcatctattcagattatcatgtgatttttgtttttagttttattgatgtgatgtatcacatttattgacttgcgtatgttaaaccatccctgcatccctagtatgaaacccacttgaatcatggtggattatctttttgatatgctgttggattcagttagcttggttgtagcatttcttattattccatctgtggaatgtattggttgaaataatgaaaacatgttctatcctcactgcttagcactttgtgtttctttaatagccttcccaacagggcaacataaaagcaggagccctgctagtctccccttaacccggaatccccccttctccacagctcgctcattggacaggatagactgggcgcccaggcttcaaggtaaggacgtgctctgtcacctagaggtgcagtgcttgggaaggccaaccttggagggttgcctgccagctttacagtgacagaggtgttgagagggactgaccaccagtgcataaggctgtgctttgttggtgacataaaggattgtttcacagattgttggggagggacaatcccaaggcctcccctggccctggtgctggctctgcacaaaggcaataagagagggatgctggtaagggctgacctgttgctgtgctggggaggaaggtgctgggctgaaattcaggaggctgaggatgcagcagtcccataggaggtacatgaccttcaggatacattttcttcattgatgatcaatggaaatgagaaatcactgactattttttctatcattggaatctactctccactgctcatgctgttcctgtcttttggggaagatggaggatcaatcagtgtgcgctgcactgagtggaaggaaggagaactgtgacaaaaattaaggaaggatgagagacgggagggcccttcatccagctgcttgcagagtcctcctgaggaggaaagccccgtggctccctggcgaaggagcagtgagggctgcgtgactcccacagtgaagtgtgtggtatgtctgaggacacccaggctggtggtccatgaggagccagtggcagagtgagaagaagaaaggccaggagggtggctggaggccaggctctgagtcattctccatgtgatggaaacagccggagcccagtgggcttggaggtacaggatgcggtggctgatgacagaacaatgtggagagaggcgtcatttgtcaaatccttactttgttctgggcattgtactaaaaattctaatggctcatcccatttaggggctgaaagttgcagaggtttaggaagctcacccacgatactggagcccccatctcttgccctagtgctgtccaccttctcacccagccaccacctgtttcgggggaacacacagaagtggtaacctcttatggagaggcaagtaaattctgctgtttttgttattcacagaaaaacactggctcgtgtgggttgggaaggtgaaataccagaagtatttcatctggttatttctacccatgcaactcctatagtattgaaatgcataggttagcatttttggccaatttactcagcattctgggttaaaggcttttatttattttatttatttatttatttatttttgagatggagtttcactcttgttgcccaagctggagtgcaatggtgcgatcctggttcattgcaacctccgcctcccaggttcaaactattctcctgtctcagcctcccaagtagctgagattataggcacatgccaccacactgggctaatttttttgtatttttagtagaaatgagatttcaccatgttggtcaggctggtttcgaactcctgacctcaggtgatctgccctcctcggcctcttaaagtgctgggattacaggcgtgagccaccacgcctgccctaaagtcttttaaaattcacttgtataagttgacttagttttctttaaccttgtagaaaaatacaaaaatggcaatctcttttatcacacaaataatgtctttttaatggagtgatttttttctaattgaggtattatgtacttttcatttacaaattattgtttacatttgaagtgttttatgaattaatatttaattgcatagatgaagattactagttataggcattttactaaccaatactcattaagcatagcatggattcatatgacatcaaggagctattttatttggtaaaacgaaaaagcacaagaatgaacgaatgcaagaactgaaacagtggagacacctagaatgacttgtctaagatctaaatcattttgttgtcttcccagcatacttattatcctgatcattgtcatcagcattgtttgggtccttttagcacagatttctcaaaatgggtaactccataacagttggaagcttacgaattcatataatttgtaagaggtcaatttggaagtacctatctattttaaaattccaataacctgggaatttcatcccatgtctagagtcttttatgtaaaatatttccacaattaggagaaatatgtgcatggggattttctatgtagcggtgttttgatagaatagaaaattgggataaatcaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgccttagtgattttacatgtggctaaattgagctaatgacaagccgttcgaagtatggcaaaatggaactttaaaacagtatcttgtcaacaaccaagaggacctgtttcacataaagcccatgcattcatctgcctgtccatcattctgtctgtccacacgggcatcattcgttagtggaactgagtgcccactgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccacttttacctcctctccaagacaaaacaaacaaaactagcattttaaaacttagttgtaatctttcttccttcatgaaaatttctccaacagccactcccacggtcctgtgtgttccagatattttaaaataatggctataaggctgagcacttcaggatatgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggattctctacatatctacattgtttgcagattttacaataatcatttattcttgcatggctgatcattgttaaccaatacaaataaaataataaagaaatgacccacattttatgttgggagtttgatctgccatttatcaagtatggaatcttgaacaaggggttaaacatctgaatgtctccatcacttcatctctaaagtgggggtgctcacacccactgggctcccccacccaggttggtgccggactctccctgggcccccctgttctctcaccagccacatccattctccccccagaggcgctagtgactgtgcgtggctttccattcccaccatgtttgtctctaaccccagtggcagatcagtgtaagaacacagctgagtgctcctcgcctccttgccccttcaagggctcctcaccacccaccagatcaggtgcaaacttccaagccttactggatccccttccacattctgagctccgcctgccttcccatcgctatccttccccacctgcctccctggtagagaaaagcagagtgtgtgatgctgtctgaatgctgagcacggccttttgcagccagtccactgtgtatgctgcccctatcggagacctccaccttaaccctttccagcctggaggctcctcccagggccccacaacagaagtgacttcccttgcctttgaatttctatagcacaagccctactgccccccgttaaaactgcaaagtccttttgtggaaaataactttattcatgactgtgtttatcacactatcttatggagaagagatgatcaataaatatttgttgaataaatgaatagcagttacaaaacacttgattcatatggaattaatgttggttctcaaagtgaaaaattacaaacagcactgatattcagccagtatacaagtctggtcacagcagttgtataatactgaaataccccctgccactgacctttggcccccagatgcctcccactgccactgctctccccactgggaacccctgaagttcccacaggctcataactaaagggctaatgtctcgcacagcagcgagcacccaggaccgagcagccacatggccgggtctgctggtgaaagcatccattctgactgatcaggacctgaggggcctcatggttacatattttgataatatccctaattataaataaggctcagttatatagtttgaaaacaatgcttctcctcatcgcaaaatctcttagaagactccgtagatccaggaacggaaatggaaaatgacagcgtgtcaatctctgaaggttttgggcatttccattagcactccatcttcatgtaaaccagaagatatgcagtttcctgcctagagagaagagaagacacatcagcacagcggcatgaaagcttcatcagaaaacaatgcttcattaatccgtgacaggacaagcgtcagcaaacttccaggcggctggattaggccttcatctatccatcaccttggagaggaacaaaataggtggcctgggaagataagcactatgtttctattccttaatatctaaagcggaggttaacaagctatggacacacaagccaaacccagccctcttggggttttttaaatctactttcaacttttattttagattcagcgggcacatgtgcaggtttgtcacgtggatatgagcatactccccaacagttggcctttcacccctcccctccctccccatccagcagttcccagttgttgccatctttaagtcaatgagtccccatgtttagctcccatttataagagagaacatgcattatgttttgtttggtttttgctggtttttttttttttttttaatggagtcttgccctgtagcccaggctagagtgcagtggcacaatcttggctcactgcaacctccgcctcccaggttcaaacgattctccctcctcagcctcccgagtggctgggactacaggcgcccgccaccacgcccggctaactttttgtatttttagtagagacagggtttcaccgtgttagccaggatggtctcaatctcctgacctcatgatctgcccacctcagtctcccaaagtgcagggattacaggcgtgagccaccgtgcccagccttttgtttattttttgacgagacggttcttgctctgtcaccaggctggagtgcactggcacaataatagctcaccacagcctcgtgctcctgggctcaactgaccctcctgcctcagttttagcttcctgagtagctaggactacaggtgtgtaccaccatgcctagctataataatttttatttttttgtagagatggagtcttgctttgttgcccaggctggtcttgaagtcctggcttgaagtgatcctcctgcctcggcctcccaaattgccgggattaaaggtgggagatcgcacccagtctccaaccctctttttgcaagtaaatgtaactggaccccagccatgctcatctgcccatgtactgtctacggctgcttttgctctacagggcagagttaagtggttgcaacagacaccgcacagaccacaaagtctgaagtactttctctccagccctttacagagaaagtctgccaacctctaatctcaataacagggaaatcaatgacaaccacaaagtgacaaagactgggtgtctaagatggatgctcagaataaacaagagagaaagatgaaaagtagaaggaggatttcaaacgcaagcttcacctaatccgttatttttcaaatgaccaggcctatctctgtagctgaaaatcacctcaaataagatctctgatatacagtctccaaaagctcagccaagaaacttacaaagtctctctgccttaacttcatccaccttttttctctccagcttctcctcggtagttaatgattataaaaatatttattggctcatgcctgtaatcccagcactttgagaggccgaggcgggcagatcacgaggtcaggagatcgagaccatcctggctaacacggtgaaatcccgtctctactaaaaatacaaaaaattagccaggcgtggtggcgggcgcctgtaatcccagctactcaggaggctgaggcaggagaatggcatgtacccacaaggcggagcttgcaacgaggtgagatcccactactgcactccagcctgggcgacagagcaagactccatctcaaaacaaacaaacaaacaaacaaaaaaacagtgtgatggccaggcgcagtgctcatgcctataatccaagcactttgggaggctgaaatggatggatggcttgagcccagtagtttgagacaagcctggcaacatagcgagacctcatctctacaaacatctttaaaatatgccaggcatggtggtgcatgcctgtagtcccagctattcaggaagctgaggtgggaggatcacctgtgcccgggagttcaaggctgcagtgagctatgatcacaccacagtgctccagcctgggcaacaaagcaagactccatctctaaaaataaaataaaattaaaaaaaaaagatcttcgctgtaaaagaggtacactcaaatgcaataaaagcatataagaaggccgggtgtggtggctcatgcctgtaatcccagcactttgggaggccgagacgggcggatcacgaggtcaggagattgagactatcctggctaacgcggtgaaaccccatctcctctaaaagtacaaaaaaattagctgggctaggtggcaggcgcctgtagtcccagctactcaggaggctgaggcaggagaatggcataaacccgggaggcagagcttgcagtgagcctagatagcaccactgccctccagcctgggtgacagagcgagactccgtctcaaaaaaaaaaaaaaaaaagaaaaagaaaagaaaagttcttgtgacatttgtgtatgaaatcagccttcactacatggataggaccagcacgcttctgcggcacgactctgcaatcttactacatttttttttactttgtattttatttattccttttgagacagagtctcactctgtcacccaggctgaagtgcagccgagatctcggctcactgcaacctccacctcttgggttcaagcaattctcttgtctcagcctcccaagtagctgggactacaggcacacgtcaaaacgcccggctaatttttgtatttttagtagagatggagttttgccatattggtcaagctggtctcgaactcctgacgtcaggtgatcgacctgtcttagcctcccaaagtgctaggattacaggtgtacatttatttatttatttgagatggaatcttgctctgtatttattaatttatttatttgagatggagtcttgctccatcgcccaggctagagtgcagcggtgcaatctcggctcattgcaacctctgccttccaggttcaagcgattctcctgcctcagtgtcccaagtagctgggattacaggtgcctgccaccacagctggctaatttttgtatttttagtagagacagtgtttcaccatcttggccaggctggtctcgggctcctgacctcatgaaccacctgcctcagcctcccaaagtgttgggattacaggcctaaggcaccatgctcggccatatttatttatttaattatttagagacaaagtcttgctctgtcacccaggctggagtgcagtggcgccatctcagctcactgcagcctccgcctccgaggtttaagcaattctcatgcctcagcctcctgagtaactgggactacagatacttgccaccacgcagggatttttttttctattttttttgtagagacacagtttcaccatgttggccaggctggtctcgaactcctgaccttaggtgatctgacagcctcgtcctctcaaagcactgggattacaggcatgagccccttgcccggcctctcactacatttaagtgacgccatggctcatgcctgtaatcctagcactttgggaggccaaggcaggtggatcacctgaggtcaggagttcgacatgagcctggccaacatggggaaaccccgtctctagtaaaaatacaaaaattagtcaggtgtggtggtacaagcctgtaggcccagctacttggaagactgaggcaggagaatcactttaagcgggaggcagaggttgcagtgagccaatatcatgccactgcactccagcttgggtgacagagtgagatactgtctcaaaaaaaaagaaaaaaagagagaaaaacatatgatgccagggcatctcggcctcaatacctgggtgagcacagtcatgtccaggccagggctgctggtcgaggtccggccccatctcttccagcagaaagggagtaagcttgcagggaggctgggggacaagatcccaggatctcagcctctgctcatggatcagctctgagaccccgagtgagctgggggtgctctgtgcgcattggtttccccagctgtcaagtaaagagattggatgaggaagtcttgtcaaggtggaatgatctcagatttggggcagcagtgaatgatcccgctccctgggccatgccagtggcccggcctcggctgaacacagccccaacactctggaatggggatgagggggcagtcagctcttgctcctagtaagagagatgcaacagggctctgtggctgagctgggtgccttgcctcacacctgtaatcccaacctttgagaggccgaggcaggaggattgctcgaggccgggaattttgagaatagcctggacaacatagccagaccccatgtctacaaaataataataaaacacacagctatagtccaagctacttggcaggctgaggcaggagggtcccttgagtccaggaattggaggctgcattgagctataatcgcaccactgcactccagcttgggtgacaaagtgagaccctgtctctaaaagaaaaaaaaattggcctgtgagcatgggcttgattttcaaacaggacccggagggtagggtaaacgtgtgggtaaatctaaatgaatgttattggtataaaattacagtagtatagaaaatgatatcttgtggggtttaaaataaataaaacatactgaaatatgtatgggtacagttatatatctgggatttgcactgaaataatgtggggtagagggaagcaggaaagagtatacatgaaatgagcttggccataagattgttgttgaaattgaatggatactctgggcttcattacacaattctctttactcttacatagctctacactctcaacataaataagaataaaaacacaaaaaacacacagatacatctatgcacacacacatatttaaaatacacaaaaatattagcatataagtcactgggggtaaatttagttcctgttccaaggttcttgtactgactaggaagaggatagaagtactaactcataggctgggcgcggtggctcacgcctgtaatcccaacactttaggatgccgaggtaggcagatctcttaaggtccggagttcaagaccagcctggccaacatggtgaaaccctgtctctactgaaaaagaatacaaaaattggccgggcatagtggtgcacacctgtggtcccagctactcaggtgactgaggcaggagaattgcttgaacccaagaagtggaggttgcagtgaaccaagattgctccactgcactccagcctgggcagcagaggaagactctctctatctcaaccacaacaaaaagtactagctcatgttagactttgataagggaaggatgcatgttgtaagctctaaaataatccagtcatcttttaaaataactctaagactgcacagttatgaaactaatagagaaggaggaaattaaataataaaactaataaatccaaaacaagatgtgagaggagataagaagaaatagaataggcatggaaaacaaattggtggtgggtttcaacccaaataaatcattagttacatttaaaaggacaataaaaattaaaataattgaaaataaagtaaaacccaactaatgccttttatataagggtacagagaggtggaagatcatgaaaaatatgtcatgcatgtactaaccaagaaagctgtataactttttttttttttttttttttttttttggagatagagcctcactctgtctcccaggctggagtgcagtgatgtgatcttggcttacagcaatctctcccttctaggctcaagcgattctcccacctcagcatcccaagtagctgggactacaagtgtgccaacttagaattatattagccacacccagctaatttttgtattttttgtagaggcagggtctcgccatgttgcccaggttggtcttgaactcctgggcttcagtgatccacccacctcgacctccagcaaagtgccaagattacagccatgagccaccatgcccagcataactatttttaatgaagtagactttaagaagaaaagtattattagaggtaagggacacatcacagaaaagaagaatttactaggagccaggcgcaatggctcgtgcctgtaattccagcactttgtgaggccaaggcggcggatcacctgaggttgggagttcaagaccagcctgaccaacatggagaagccctgtctctactaaaaatacaaaaattagccaagcatggtggcacatgcctgtaatcccagctactcaggaggctgagggaggagaattgcttggacccaggaagtggaggttgcggtgagctgagattgtgccattgcattccagcctgggcaacaagagcaaaactctgtctcaaaaaaaaaaaagaagttactagctagtttcggtaattcttaacatccaggaaactggatgtgaaagtttttcagagaaactaaaccaatagattatacatagagagagacttatttaggaattggctcacatgattgtggggactagcaagttttaaaatctgtagggcaagccagcaggctataaattcaggtaagagttgatctcgaagtctggaacctaaaatctgtagagcagtcagcaggccagaaactcaggcagggtttgtgtgttacagtcttgaagcagaattcctgcttctctgggaaacctcagtttttgttcttaaggccttcaactgattggaggtggcccacccatattatggtgggtaatctgttttacttaaagtcaattgactgtcagtgttaatcacatctatgaaataacctcccagcaagatattgacaagtatttgaccaaacaacaggacaccatagcttagccaagttgacacataaattaaccatcaggagcaagtagaatatccaaaaaacaacatactaggggtattatatcttatatagctattataattatataaaacatataattatagaatgacgatattaagataaccattagaacaaaaatataaacttttctttctttttttttttttttttttgagaccaagtcttgctctgtcacccaggctggagtgcagtggtgcaatcttggcttactgcaacctttgcctcctgcgttcaagtgattctcctgtctcagcctcccaagtatctgggattacaggcacctgctaccatgcccagctaatttttgtatttttagtagagacatggtttcaccatgttgcccaggctggtctccaactcctgacctcaagtgagccaccccccttggcctcccaaagtgctgggattacaggtgtgagccaccacacccagccaaaaatcaccttttttacaaggatcaaaacagtcattatgctggagatgacagacctcactgtcaccatgctccttttgtatgtctactaggcacggtgctgggtccacactcacagaaaccttaggaactcgcacccaggggctccggctgtagcagaatcccaagaataaaacctggtgctgaaagagtaggagatgaggccgggtgccatgactcactcctgtaatgccagcactttgggtggccaaggcgggtgaatcaagagatagagaccatcctggccaacacggtgaaaccccgtctctactaaaaatacagaaattagcggggcgtggtggctggcacctgtagtcccagctactcaggaggctgaggcaggagaatcatttgaaccgaggaagcagaggttgcagtaagctgagatcgcgccactgcactccagcctggtgacagagtgagacaccgtcccaaaaaaaaaaaaaaaaaaaaaaagcaggacactgaactctgggagggcctcctggtgagaggtgagcacagaggggagagatggaggcaggagcatgggcttctggtggccccagcagaccctgtggcagcgtggccagggtcctctgcagggaggaatcttggccaggatgacgctgtagcaggcctcttcctgaggcctccagccagcccggccagggtcccagcgtccagtgacccctgtttcacagcagcagctggggccagccccaggctctcttccactcccagcttcttaaaactggaagtggagagagttgtttgataaaacactggggcaaaccacatcctctcttcaccaagggagagttcgaggggatgccggcagagggagctttagagtagagacccctacccaaccagtgaccgtcacgcacacagcagggcatgctatggagacccccagacagtcactcggggagacccagcaggtccagactcttcagagatctgtggcagcaggtccccactcccaaaagccacgtgcccacgggtggtctctggtgcctgagaccccagtctcatttgcatctttgcaacttcgagtttaagtgggtgtcgcatctctgtatgtcctcccgagcagaggaggggcacagcctggggtggcagctggcgtcaaaccctcaaatcccctgagagccactggggagactaagcagtccccagcccccacttgtccctgagctgccattctcagccctgtgggaggagacagaaagccctgaagagaaaccaaaggaccaggtcaggaggggctgggggggtggcatgagcaatcagggcagggaaggatggaccgatgggggaatggagggaagaaggaatgaatgaaaaggtgaatgaatgaacaaagagagagaacggccactcctcccttgctttagtttacaaagtactgggatcctcccaacagcctgcaagacagaatttctgggaagcagaccaggtggctggcagggaggggaggcttgccctggcttttgtgggcccaatgggaggcagggggcaagaaggggcatcctgtgtgtgtcctccctgcagtggcagcagcaccttcctggaagagggtcaggaaacacccgctgtggcccctctccaccacgccctcatccaggacaccaagtatcagtcactcagctcacgagacccaggccctgactcagggagagaggatgtgaggggtggggcaccgggctcctcaggactgagagacctgggatgtggccccgggctgggtgtaggggcagactggctatggcagcattgtgtgtaccccagcaggccagtacccacgcagggagcctccaaaccccttcacccatgaccctgggagaagaccgcagccttggagaattggcctcactgaaggggcctgcaccggccagcagggtcaggcggggccagacaggttcccacctgggatatgcaaatgggcctcctgaatcctggagccaggtatggactcacacaccaccattgtccccaagtccccatctgccccacgggcacaccctgccgcctgttctgtgcaagggccctgaggctgtctccttgcgcccaagacctgcaggtgctgaagcccacacacacggctcctgcttcctgggccagtgcacgtgcacacacacacacgtgcacacacacacacacacccacaaatatacccacacacaatcacacacattcacacatacccaccccccatactcacacacacatttacacacacccacacacccacactcacacactcacagtcacacacaccctcacacagcgaaacacaatcacacacattcacacccacccacaccccacacactcacactcacatatactcacacacacccacacacacatacacaaacacaatcacacacattcacacacacccacactcacacatacacacacccaaacacgatcacacacattcacacacacccacaccccacaaacacactcacacatatacccacacacactgacacataatctctcacacacacacatgctcacacacacacgccttctccaggaggggctggctgccaaaggccacccagcttcctcccacgtctcactcaccgtacaatatttgagaagaccttggagtcagcagcaacagcggcgtgggcaaaggccgggggtcaaatggggcctggtgtcgagagaggaccacagccagcacaatgacagccagcgccagccccagccccagccccagcaggaccaggtcacccatggctccgtagtcctgggccatggctctgcggcccagaaggagaggggaggccggtgggcagatggagggacagatgggtgggcagatgaatggacaagaagatgcatagatagactcacaggtaattggacagatggacaaacaggtgggggctgaagacagacacgaagatggatcgacagacaggccagatagctagacaaagaggacagtaagagaaagatggtcagatagacaatgggacagagatgggcttacagatgggcggacagacagacaggtctgaacagcgggctgccagatggacagatgggtgaatggacagatggctggcagctgtggcgagctgctgccctcaccaagtgcacactacggagtggccaaactcatgcctcaacttctagttttcagctcctgcttgttcctggcaggaggccaggcagcaaagcgtctgaggggagttttctttgcctagagaagtcagctgctgtgttaactccctcactgctggtaggtccaaaggccccacctaccgcccgccagagcccatggtcacactgtcgcaatgtgcaggagaacttggtgcgtgctgcactgcggttgccaggtaggggcagggctccctggaacctccacaccattccccaggttctcagcagctctgggaaagcagagctggggccgcttaactctgccctggatccggcaaggctgcccccctcccagagtggagccctgctccccagctcccatctctatcccctaaccctctccgcatggcccagcctagtcagcatcaaggtggagctgaacagaggcagaaggaggaggacccaaggtggtgtcactcaggacccgggttcaagtccttatgcttctgcagcctggcctgggtcccccaactcccccagggtgaccaagggctttccagtctgcacagaggacagggggtcttgacagcatcaaattctggtgactacgagacacttacgtgggaaatgcagacagaccatgcctctagcccttggcaccaggcaccatccatccctgggacttgctgtcctggaaatgcagcatggtcctccagggaggggggctgtgccatgtgggggccccaccccacctgcagctctttcccaccctggctgcaggtctgcttccctgaatccaaatccgctactactgtgctggcagcgcagcctctctggggacactggcctggctctgttctccccaggcctcagggtgcctaaatgggaggcaaccaggggagtgaggacccactgaggggctccgttgaccaggctcagcaggggtgcaggtgatgtggggtggaatccttcccacatggcccccacagtcctccccgcttcctccccaactgaacactgcctgctccagatgtgtacacctggagtctgggcccctccatctgggcagcagagaaactgaggcacagagacagactgtgtccttacagggcacacagcctgccaggcccctatgtccggccagagcccctggtcagcctgggctgcagtgattgtttagaggtaggctgttcccacggctgcctctcacggtaggggggcctgtggacgcctcctcccgcccccacccgactcccaagcctcagtgacattgctcaaccaggagctgaagtgcattcctgggctccggccagcccacccacccacccgctgcagtcctggaagcccagaggcctgggcagcaggaacagtggagacagcagtgtgggggacgtccccctcctctccccaccatcctcgtcaggcagaggccagggtgcagggaccaccggagcaaaggcccagggaaatgaatgggtgtcattctggtcctgacccgaggcacagccaggaaggtccctgtggggaaaagaaagagatatcagactgttactgtgtctatgtagaaagaagtagacgtaagaggctccattttgctgtgtagtaagaaaaattcttttgccttgagatgccgttaatctgtaaccctagccccaaccctgtgctcacagaaacatgtactgtgtcgactcaaggtttaatggattcagggctgtgcaggatgtgctttgttaaacaaatgcttgaaggcagcatgcttgttaagagtcatcaccactccctaatctcaagtaagcagggacacaaaacactgcagaaggccgcagggacctctgcctaggaaagccaggtattgtccaaggtttctccccaggtgacagtctgaaatatggcctcgtgggaagggaaagacctgaccgtcccccagcccgacacctgtaaagggtctgtgctgaggaggattagtaaaagaggaaggcctctttgcagttgagataagaggaaggcatctctctcctgatcgtccctgggcaaaggaatgtctcagtgttgattgtatattccatctgctgagataggagaaaactgccttagggctggaggtgggacatgctggtggcaatactgctctttaatgcattgagatgtttatgtatatgcacatcaaagcacagcacctttttcttaaccttgtttatgacacagagacatttgttcacgtgttttcctgctgaccctctccccactattaccctattgtcctgccacatccccctctctgagatggtagagataatgatcaataaatactagggaactcagagactggtgccagcgtggggcctccatatgctgagtgcaggtcccctgggcccacttttctttctctatactttgtctctgtgtctctttcttttctcagtctcttgtcccagctgatgagaaacacccacaggtgtggaggggcaggccaccccttcaggtccctgaatgtccttcctcaggaaatgatgggggaaggggcgatgagaatgaaggagacgatttaagtccctcaccccccgaggtagtcctgggctgagccccatgggacctagagaaccagggtgtaccccaccagcatgtcgggtccaggaagcctcgtggccagctcccacttctcttcctgctgtgcaacccagagcaaggcctgcccctccagcttcagtcttctcccctgcaaatggggccacggcctttcctctcaggccaatataaggattgaggccgggtgcagtggctacccctgtaatcctagcactttgggagactgagatggggggactgcttgaagtcaggagttaagaccagcctggtcaacatagtgagaccccatctctattggtttaaattttttttaaaaaaattaaataaataaaataaggattgaagagtgacttgtacaccagttgagcccacctccatctcacccttgcagagccccagagacacagccctccagagctcagacccagtgggacttgactccacaggcataaaaccctgtttgtctatgggccctttggaatcaccaggttttcggggctcctgaaggatagccccgacctggcctcacctggcccctggccccagtgcccctggtgatatccaggtgctgggctgtgatcaccgcctcccaccagcccacctccaccagcccttcccagaaccctgctccaggtgttggaactgtgcacagaggagggagcaggccccgagggaggcctggaggggctgccaatggtgaaggctgctgtgtcgagctgtttccttccggacccactccctctgggctgcgtccccggctggtccaagccctgatccctgggatctggggacatcttcccgtttgctgttccctgagaaccaggcctccctgtggagaggatcacaagcttgggtttcactctgggcttgctcttgggaaccccccaggggcatggctctgaccgagatgttttcctccagcctgttgcccagtccccattcctcggaccctcagcttcacctccagtgtcatcggcagggtgagctggacgcctacgggtctgagaaggcgcccgggttcccagcatcggctggccaccctctgcctaagaaagcgccagggtcgtgacaccccctggtggctgatcctaggtagtgtcactgcccagccccagtaagggagggcctggccccaaagtctgagggatcagggtgggaaggggcagggtttggtgtgaaccttcccctggcccccagccatgtgccttgctctccccatgctgaagatgctgaggctagttccagtgcccgcattgtgaagatctccgaatcccacctctctgttcctccccagccagatggctccatttcacacacaatacactgaggcccagagagtggggagacaggccagggaggccacctggagcctggcacagtggcctcatttattatgctgctctgctgctcacaggggaagcccgtcccccaaagtcctcttcctcatcctggtgagtatcttgtccctggattgcttgtcagccttgtctgcctggagcaatcagtagccagcaggttccccgcctttcctggagtccgaggcagctgcccagccaccagccgtgcggacgatggcttgcaccacagcgatgaaggtggatgcgatctgggtgtgatggtgccgggtctccagggctgcagtcactgcctgggggtgggaggagaggggaagcctgagcagggctccagatgccacctgaaccacacctgtgtggtcacaggcctcagcccaggtggtgccatttcaggccaggtcatcaggaagagcaggttggggcctgctgggtctcactggagcagggggcttggctctcatgtcacaggggctccagatggcccaggcactagagagaggacaccaaccattgtccactctgtgatgatccaggcctccagcccaggatgccctgggaccccacaccgtgactcagtttctccaacccctggcccacctggtcaatgtttctctccactgtcgtgacgttgggcagaagcttgttgtgcagccggggctcctccacggccctcttcacgtcatagccgaaccagaggttgtagatgatggcctggggcatgggagtgtgatcagcgtggcttgggggctgtgcagagtgggcagggccagggagaaaaggggtgacacataccagtgcagtgtctgtggtgatctgcgtgcccccagcagctcccaccaccatccggacctggccgtcctggcccaccatgatcgtcgggcacatggacaagagcggctgcttccctgcggccgatgggagaagacagggatgcccgtcagctgcctgcccaggacacccgcccctctccaccccagtcccccaccccccagacctccaccccatacctggctggatgaaattggcaggtgaggggggtgccccaaactcattggtgaatgctgggagagctgaagtcgtccattcattattgaacaggatcccactgaccggggagcagaccttggagccaaagctaccgcccagccaggtcagacagcacccgaccttgcctggcccagcctggtccctatccacccactgaggctcaaacatactcactgagaggcccaggataagctaccaaggttgggcctcagtttcccaccaggaaaagaggtgatggagccaccttactggataagtgggcagtccctgggccacccgcccctggccctttcccacccaggcggcccagcagcccctactagaggttgatggtgctggtggcggacacagcactgccgtcctctgcgacgacagacaggtgagcagtgcccccgtcatccggcgtgtagaactcgggcttgtagtaggagatcgggtgagtggtgtggtcagagatctgggaccggagctgggcagcgaagaactcagaggtcatgttgcggaccacctgctgagaccccagagctggcctgaggaggtggggagggagggtggggagggggcacaggtctcagaaggcccttgactgtgactctgaccgcaaccctctggcacccacaaccttccgtggctccccaggacccaagggcaggcccaagaccttgcatgaccagtctgactccctgtctctgtcgcgttccagcaactctgaatgtctgtctgcctggtcctcagcctccagacccttgccgcattcaatcactcattctttcatgcaaaaaatatttctacaatttgcactgcatgcctggcactggggaatcaacagggaacagacacttaggtcctgccctcatgccaagaaaaacaaacacacacagggaaagtgctgaaaccacaggccaggtaaggggaatcaagaggcatgaggtatgggcagagtggtcagggagggcttctcagaggaggcaacgtgtgaaaagagcctggaaagtggcctaaatggtcagtgcaaaggccctgaggcaggtggcataggctggtgagcgataggcagagagtgaatggagtagggtggggagaagaggatgaagatgcaggctggggcccatcccacaagacctcctaggtcccataacaactggcttttgctctgtgccatgcaggcttaggacagaggaatgagcaggctggggagtgttttcacagggtccctctggcagctatgacggggataaggataaagcccaaaggggaggctgtgggtatcaaccaggcaagagatgatggcctgggtgggagaaagagaagaagcctgtgcgttctgtccatgtgatgaggtgggctcctctcaatcttcacacagcacagctgagcctcaaacccagcactcaccctgacctctcacctccccacaaggtaggaaaacctgttgcccaggctggagtgcagtggcacgatcccggctcactacaacctctgcctcctgggttcaagcgattctcctgcctcggcctcccaagtagctgggactataggcgcccaccaccacgcctggctaatttttgtatttttaatagagacagggtttcactgtgttggccaggctggtcttgaactcctgacctcgggatccacccacctcggcctcccaaagtgctgggattacaggagtgagccaccgcatccagcccctatttctttttaagacacggtcatgattcattgcccaggctggagtgcagtggcacgatcacggctcacttcagcctcacactcctgggctcaagcaatcttcctgcctcaacctcttgagtagctgggactataggaatgccgcaccacacctggctaatttaaattttttttttttttttttgtagaggtctcactatattgcctaggctggtcttgaactcttgggttcaagcagtcctcccacctcagactcccaaagtgttgggattacagttgtgagcaaccatgcccaaccagattttatttttatttttatttttgagacagggtctcactgtatcacccaggctagagtacagtggtatgttcacggctcactgcagccttggcttcctgggctaagtaatcctcccactttagcctccctagtagctgggaccacaggcacacaccaccatgcccagctttttatgtttttatttttttattttttgtagagatgaagttttgccatgttgctcaggctggtctgaaactcctgggctcaagcgatctgcctgcctcagcctcccaaaatgtggggatttcaggggtgagtcaccacacctggcccagattttattatttaagttaacattttgttaccattgcttaaagccacctggtccttttcatcagatagtttcttacagccaggcacagtggctcacacctgtaatcccagcactctgggaggctgagacaggtgaattgcttgagccctggagtctgagaccagcctaggcaacacagtgcaaccatgtctctactaaaagttttggtctcgatctactgaccccgtgatccgcccgccttggccttccaaagtgctgggattacaggcgtgagccaccgcgccggcctaaatattttttttttaattagctgggtgtgattgaggctgggcactgtggctcacgcctgtaatcctagcactctgggaggcaggtggattgcctgagctcaggagttcaaggccagcctgggcaacatggcgaatcctcgtctctactaaaaatacaaaaaaaaaaaaaaaaaaaaaaaaaaaattggccaggtgcagtggctcacgcctgtaatcccagcactttgggaggccaaggcgggtggattacctgaggtcaagagttcaagaccagcctggccaacatggtgaaaccctatctctactaaaaaatacaaaaattagctgggtggtggcgggtgcctgtaatactgggtactcgggaggctgagacaggagaattgcttgaacccaggaggtagaggttgcagtgaaccgagatcacgccattgcactccagcctgggcaacaagagcgaaactccgtctcaaaaaaaattagctgggtatggtggcatgtgcctgtaatcccagctgctttgggggctgaggcatgagaattgcttgaaccggaaggcagaggttgcagtgagccaagatcgtgccactgcactccagcctgggcaacagagtaagattatccaaaaagaaaaaaaaaaattagcgggtgtggctacacctgtagtcccagctatgtgggaggctgaagtaggaggatcgcttgagtccaggtggtggaggctgcagtgagctatgattgtgtgaccgcactccagcctgggtgacagagccagaccctgtctcaaaaagaaaagggtcatgatgcctccccaacaggatatggtggggacgctccaagaccatgggagaagaggatacgagccggagctatggaagaagtgaacacgtaagactccagaggcaaactgcccgtctagacagctctggcctgcagagcccaccactcccaggccagcgccgtgaggtcctgttgagccacccacctcactgtgatcatccccaggtaaaccctcggacgtgggcccggtgccctccttgctgaggctgaagccacgtggccatgaaaacctgagcatcacaagccgctctctgcgtttgtggtgtgatcagggccttctaccacaagccatgtgcccaggctgatcctctctaatgtggagaggcggctgcgctggaaaggcctcagtaagagcagctgggcccttgcagacagacatcacggtgtgaccctcgggactggctccctgcggccactgcagcacaggtgttcacatctcacagtggaggcagtggagaccatgctcgcctgcaggctctcggcgaggctctgagtctggccccttgcgtagcccctggtgactccttggcttctggagcggaactccatccttcacatggcgctttcctcgagggcctgtgtgcgtgtcatctgtggccaagttcccacttcataaggacatcagtcatattggatggggtcccaccctgctccaatgagaccccatcttttttttttttttttttttgagacagagtcttgctctgtggcccaggagggagtgcagtggcacgatcttggctcactgcaagctccgcctcctgggttcacgccattcccctgcctcaacctcccaaggagctgggactacaggcgctcgccactgcacccggctaattttttgtattgttagtggagacggggtttcactgtgttagccaggatggtcttgatctcctgaccttgtgatccaccctcctcggcctcccaaagtgctgggattacaggcatgagccaccgcgcccggctgagaccccatcttaatcacacctgcagtgaccctgttttcaagttaaggccacattctgaggtattgaaaattaggactccaatatgaattcggggggacccaatttaacctgtaatatgtatatcccaaatgcaattttctccttttttcttttagacagttgctctgtcacccaggctggagtgtagctcttggctcactgcctctgcttcccgggctcccgcaatcctccacctcagcctcctgagtagctgggaccacaggcgcacaccaccacacccagctaatttttgtatttttgagagagatgaggttatgccatgttgcccagactggtcttgaactcctgagctcaagagatgcactcacctcaacctcccaaagtgctgggattacaggtatgagccagcatgcctggcctccaaatgaaattttcagaaaggccttttcataatagtaacgggaaacaagtgacataggcatagccttgataaatgtgccaaaagcccatttggaaatagcacatttgtaggaggcctgaggcaagacttgtgggattggacgggaatgctctgttcctgggaccaatacctgatgatggagagtgtccattcttccctttaaaatttttattttaatattttatttttaaaaaggggtcttgctatgttgccctggctggtctggaagtcctaggatcaagtggtcctcccaccttggcctcccaaagtgctgggattacaggtgtgagccactgtgcccagcccattcttcccttttaatatatacgcttcacatacaggctttgtttttgcaactcctatcaaatcccaacaatgtatttgggagaatttgacaagacagttctaaagtttatctgaaagagaagcagcagatcctaaatggctttccccaggcccagcactggcagatagcacctttctaaccttcgggtgtgaatccaagggtggtggtggagcttcaggacacatgcaccctcgtgtccctcctctatgtaaatggaagccttcagtgccagctcctttaggttgtaaggactgaacacgctcacagaagtcgtgtgcacagtgaggtgggggctgaaatgcagcagctcctctccctgtgttctgtccccgccccacctctcccccacctcaactttgaccactaggggaccaattataacatgagatggcaagaatagctcatgtaaagccaccccaccccagtcacctggttgctgcatagtgtcacattcataggagtacaatttagtcactagtaatcctttgcgaataatacaaacgtccagtaattctttgctgcataacaggccttgtgctcaaaaggttctgcagaccttgcctgggtgctctggccaagctgcagtcatcccagggctggctgggggctgggggtttgccggcatgcctgctggttggtgctgctgccagtcccagctactcgggaggcggaggtacggggacggcttggtctcaggaggttaaggccgcagtgagccatgatcgtgctattgcactctggcctgggcaaccaagcaagactctgtctcagaaaaaaaaaaaaaataagggggtgagaggggctataaaggctctgaggtccacgctctggaggcccacaaagtcttttctgcatcatcttgtttgtcagagcaagacccaagggtgagcctagattcctgagctggggaaacaggctccacctactggtggtgagaactgtagacaatctgtggtcgttttgagtccactataagtaaccaaaataccttcagtcttgcttgcatttctcaacattagtgaaaggggacccagtgcttggttgtagcaggcgtcctaaactctccttctgacctgcagagttttcatctgcagaatgtcccctcctggtgcacagcattcatgtcccttgtcctcatccctggtgggtgctctcgccgcctcctttctgatcccatcctcctccttgtcctaccaaccgtctgtactcaccctgtgtatttagtttatataaatgttaatgcctggccagccgtggtggctcacgcctgtaatcccagcactctgggaggctgaggcgggcggatcacctgaggtcagaagttcgagaccagcctggccaacatggtgaaaccccgtttctactaaaaatacaaaaaattagctgggcatggtggcgagtgcctgtaatcccaactactcgggagactgaggcaggagaattgcttgaaccctggaggcggaggttgcggtgagctgagatcataccattgcactccagcttgggccacaagagtgaaactctgtctcaaaaataaaaaaattaaaaataaatgttaacacctgtagtcccagtgctttgggaggtcaaggcaggaggatcactttagcacaggaggtcgaggctgcagtgagctgggatggcgctactgctcctcagcccgggcaacagagtgagactcgatctcaaaaaaaaaaaaaaaaaaaaagaccagcgggggtggttcatgcctgtaatcccagcattttgggaggccaaggtgagtggatcacttgagcccaggagtttgagaccagcctggtcaacatagtgagacttcatttctacaaaaaaataatcagccatgctgtagtcccagctactgggggtgctgaggtgggaggattccttgagcccaggatttcaagaccgcagtgagctaggatcaagccactgaagttcagcctgggtgacagagcaagatcctttctctctaacaaaaaattaaaattaaaaaatattggccaggtgtggtggctcacgcctgtaatcccagtaactttgggaggctgaggcaggtggatcattcgaggtcaggagttcgagaccagcctgaccaacataatgaaaccctatctctactgaaaatacaaggattagccagacgtggtggtgggcgtctgtagtccagctacttgagaggctgaggcaggagaatcacttgaaccaccacgcccaacctaatttttttgttgttgttgttgttagtagaggcagggtttcaccatgttggccaggctcatcttgaactcctgacctcaagtgatccacctgcctcagcctcccaaagtgctgggattacaggtgtgagccaccgcgcccgatctgaagacatttttgattggttgattgagttgggggtctcactgttgcccaggctggagtgtggtggcatgattatagctcactgcagccttaaactcccaagcccaagagatcctcccagctcagccttctgagtaaccgggactacaggtgcacaccagcacacccagctcattttaaattttttctttttttttgagatggatcttgctctgtcacccaggctggagtgcagtggcgcaagctccgctcactgcaagctccgcctcccgggtttatgccattatccagcctcagcctcccgagtagctgggactataggcacccgccaccacgcccggctaattttttgtatttttagtagagacggggtttcaccgtgttagccaggatggcctcgatcaggagatcgtccatcttggccttccaaagtgccgggattgcaggcgtgagccaccgcgcccggccccgtagtttcttacatgttcacaaagagacaaacttaaaagagcaaagcattacgaactttaagaggccagtgcaggaggatcacttgtagctagaattttgagaccatccagggcaacaaagtgagactctgtccctacaaaaaaaattttttttttttttttttttgagacagactctcgctctgtcgcccaggctagagtgcagtggcgtgatcttggctcattgcaacctccgcctcccgggttcacgccattctcctgcctcagcctcccgggtagctgggattacaggcactcgcgaccatgcccagctaattttgtatttttagtagaaatggggtttcaccgtgttagccaggatggtcttgatctcctgacctcgtgatctgccctcctttgcctcccaaagtgctgggattacaggcatgaaccaccgtggccagcctcttttactatttttttttttttttttttaagatggaggctcacactgttgcccaggctggagtgcggtggcacgatctcggctcactgcaacctccgcctcctggttttatgcgattctcctgcctcagcctcctgagtagctgggattataggccaccatgcccagctaattttttgtatttttagtagaggtggggttttaccatgttggccaggctggtctcaaactccagacctcaggtgatccacccaccttggcctcccaaagtgctgggattacaggtgtgaaccactgtgcttggcctttactactacatttttttttttttttgagatggagcctccctctgtcaccaggctggagtgcagtggtgcaatctcggctcactgtaacctctgcctctcgggttcgattcccctgcctcggcctcccgagtagctgggactacaggcaagcaccaccatacccggctaacttttttttttgtatttttagtaaagacaagatttcaccatcttggccaagctggtcttgaactcctgatctcatgatccacccgcctcggcctcccaaagtgctgggattacaggcgtgagccaccgtgcccggccgtctactacttcttaaagggtgagaggcggaaggatcacttgagccctgaagtgtgcgactgcagttagcttttatcgtaccactgcactccagccagggtgacagcaggaccctgactctaaaaaaaaaaaaaaaaagcaaaaaaaagcatatactattaatacttcctccttactataatgtttactgtggcctttatcagactagagagtgcttttatctctcccttttgttagagcttttagaattatcaatagatggtcaggtgaggtggctcaggcctgtaatcccagcactttgggaggccgaggtgggtggatcacgaggtcaggagttgaagaccagcttggccaagatggtgaaaccctgtctctactaaaaatacaaaaaaattagctgggcgtggtggcgagtgcctgtaatgccagctactctggaggctggggcagagaattgcttgaacccagtaggcggaggttgcagtgagccaagattgtgccactgcactccagcctgggcaacagaatgagactctgtctcagaaaaaaaaaaaattattaatagatggtgaccctcatcttcatgttttctgcatctattgaagtgcgccattgagatcgtggagttcttccctgtttgtccatatggtgaacaacactgattttctgatgttgaacaatctctggaataaactctgtttggtttccatggatttctgtttccctttagattttgttagtaatgtattttggatttttgcatccaagttcataattgtaactggacaaataaaggcagattttaaaaggacaagttgggaggctaaggcggaaggatcacttgagcctgggagattgaagctgcagctagcctcgattgctccactgtactccagcctggtgacagcaggacctgcctctaaaataataatacttaaaaggacgagtttacctacagtctcaccaagcaatgaaagagcttatcttcctcctgtttcctttacggatcttgctcatgtattttatcttagttactttagcataaatgctaaatcaaattctttttcactagacatcatcatagctctaggcataccacataatacccaagcacattttaatcattaaaattgtttcctttttttgtggctactgtaaccacttcagcgaaccatttagtgtgtagtgggtttaaattattttttctcctttctgggataaatttcccaggagaaggataattgggtcaaaagctacgaacatatttatgggttcttttccacaagagatcgatcagtttgcaagtgccatctgcagtgtgggggaaccaatcttcaacttgcctgcatttggtattagtattttattaacctttcattgatccaattacggctctttgacacaattttcatcagtgatggactaagtgtgatccggcctgacccgcctccggccggcgtgagaaggggcatgtgtcgggctacgctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggaggtgcgcggggaacgccgctcttctacctggcgggcgcgcgagggtcggtcccgcaggcagcgccgcgaggtgcttcgcagagtaccaggctgatccgcccgggcccgcatctctgctctaggcccttgggaacgggtgatccacccagcggacccaggtgggggactcggccaggacttcccagtcctcaatcatgagcctgcggctggtccttcctggcgactgcgggatcctgagcgacccagtccgccttgtagcgccaacctcagtttccctctgcagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctagaatggggctggacccagggtggggtgaggcagggcgggcggaagggggcgggatccgggggtggggtgaggtaggaccggcggagaggtcggcaccgccccaggaccccgtccgcaggagcagcacagcaggcagctgcaggagcagtgggaggagctgtcgagtcaggtacgtgcaggagatgggagggcctgtctcttggttcctctcggaagtcctgcccttgtcctcgcccttgttgtctccccgtccctgtctcccctgacactcgttcctccagaagcccggtaaaccccgcccttacaagccccgcccctagctcttctacggaggggaaccgcagagccagaagagcacggagcagcaactcgcagcccaattggtgacgctgcaggtgcttgagcgggaccctgaggtctttagtaggggcggagcagcagcgtgagcggggccgtgaccacctgggggtgtggcttaaggcaggccctgaaggcgtgggcggggcgggggatgtgggcggagcacaatcgcatgggggcggggctctgagggctagaataggggcggagcgcggagggggcgtggccatgaccagttggggcgttgcttacgactggtcctgaggacgcgggcggggtcatgatcgcctgggggcgggcactgagggccgggggcggggcccggaggcgcagcgggttgccggcctgcggacctcctgacattccctgggtccttctcaagaatgaactggagctggcggagaccaaatgcgccttgcaggaggagaagctgcagcaggtgagggcagaagcgggttctgttggaggagggtaggctttcgagtgtggatggggaagggcctgtcgccccgacgccgccgagtctaacccgggtgtccacacccaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcctgcgggcgcggcggggcactgtggggccgggctgggctcccacctgcatgcctgtccccgcaggtgtgacgggcagcttcgcggagtgcagtacagcaccgagtcgctcatggaggagatggccagggcggaccgagtgagcgcctgcgcgggtccgggcggggtgggctggagcgggacaaccctccccgtcccccccgcggtaccgcctccccctcctcctggaaaccgggccggcgccgcgggcgcggaggtagctggatgcggccctctctccccgcaggagacgcggctgttcggcggccctcgcgcgctggccatcaggtgagccgggcggtgggcgcggccgcggtcccccacctgcccgcctttcgccccgcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcacctggctttatttctggtgcactcctctcctgagagtgtagaccaaggttgcctaataaactcaagggatgaagctcgtgggttcgtcgtctgtctcccatgtcatgtaggagcttgactggcttttcagcctccaaagattccttccttccttacagctcatggatttagagccactccccagtattgtaaacagcatttttagtttttcaggatacataatttgccatattgccagaaacttgtacatagcatttgacactttgccaatctgacaagctgccttttcaagtattgtgatttgaaattatttctactatatttgaatttatttctaccatttgtaacatgttgatcctgatttttcaatgctcccctttccttctgtttatttgggaagtcacactctgtattctggtattcttactacttgagctcagctcatcgctgtcatcttcccctaaaccgccttaaagcatcttaggtcttttccctctgatcacatgtgctacttttttttttcttttctttggagacggagtcttgctctgcgcccaggatggagtgcagtggcatgatctcggctcactgcaagctctgcctcccgggttccagcgattctcctgcctcagcctcccaagtagctgggacttcagacgcccgccatcatgcccgtttaattttttgtattttttgtagagacagagtttcactgtgttagccaggatggtctcgatctcctgacctcgtgatccgcccaccttggcctccccaaagtgctgggattacaggcatgagccaccgtgcctggccaacattttctccagatatcttactgagtcctaatttccactgtggccagagaatacactctgcatgattttaattctatctcatttactgagacttgttttgtggcccagcacaaagcttgtaatgaacactgagaagaaagtgtattgttgctgttgacagagtgattttttttttttgagacggagtctcgctctgtcgccaggctggagtacagtggtgtgcaatctcggctcactccaacctccacctactaggttcaagtgattgtcctgcctcagcctcctgagtagctgggactacagatgcattccaccatgcccagctaatttttgtatttttagcagagacagggtttcaccgtgttggccaggatggtcttgatctcttgacattgtgatccgcctggcttggcctcccgaagtgctgggattacaggcatgagccaccgtgccaggccgacagagtgtgttctaaatacccagcaggtccaggtgagtgacaggcttgttcagggctcctgtgtttactttcttgttggtagcgccgtcaattgcttattgtgaaatgccccttcataaacacccatacacattttgattatggatggccagtcttttttctatctgttattttcatcttacatctgtcttcatatgtaaagtgctttggttataatcagcacataactgggtctcacttcttcaattcatgtttgtaatccctgacttttaaattgggctggtaagtctattatgtttctccttttctgccttcttttggattagtatcttttaaaactccttttaacttatacgctgactcatattttttattaagacagtctcactctgtcatccagtgtggagtgcaatggtgtgatcttggctcactgcaacctccacctcccgggctcaagcgatccacctcagcttcctgagtagctgggactacgggcttgtgccaccatgcccggataattgttgtattttttgtagagatggggtcttgccatgttgctcaggctgttttcaaactgctggactccagcaatccacccacctcagcctccgaaagtgctgggattacacatgtgagccactgtgcccagcctatatttttatttgtactgctcaggactcaactgtgcttcctaaagctgaatatttgtgtttttcaactctggaaatcccattagaagttgattggggccgggcacggtggctccaatctcagcactttgggaggccgaggcgagcagatcacctgaagccaggagttcaagatcagcctggccaacatgacgaaaccccttctcttctaaaagtacaaaaattaattagctgggtgtggtggcgtgcagctgaaatcccagctacttaggaggctgaggtaggagaattgcttgaacctgggagacaggttgcagtgagcagagatcacgccactgcactccagcctgggcgacagagtgagactccgactaaaaaaaaaagaaaaagttgactggagcttttcattcaactcttctttttttttttttttttgaccgttacccaggctggactgcagtggtaccatcatagctcactggagtcttgctcttcggctccagtgatcctatctttcttaccctcctgagtagctgggactacaggcatgcaccaccatgtggctaattttaaatttttttgtagagacagggtcttcccgtgttgcttatgctggtgttgaactcctggactcaagcaatcctcctgctttggcctgctgaagtgctgggattaggagccaccccgcttggctttcctttccttcacactgcatgtttggtcatttcactattctgatcactgattttctcttcttacctgctgctgtttagctgatcttttggagtttctcttttgtttcaggtctttattcctatctgcttcagatgcagggcctcggtgggtgggagtagatgcttgctgggtctagtcacacaaagattttggagttccagagcacagcacttgaaaacaagcaagagggaaagactagagcagtgggaagatgctgcggagagccacagacaggcccccacggcagccctgagggagacagttttggagcgggcagacagcagtcaggacaaacacaatgtgtgttttggtgcacctatgccgtggtgagattatgggaatctcatgtttgttaagccacaacccgtgctcctgggccccagcctatgagtgcagccaacactgggcccccctctctaggggcaaatccaggaactgccctttggctgaaggtggacttaggacttgacacaaaacctcacagattccaacacagcactattttgggtttttattttgttgatgttggttaaatcttatctctttttttatacacaatacttcatgtacctatgaaataaaacaggtagggaatatgtccagtgcaaacagaggactcacacctgtgcatagacagcaccatccactgattgtcgctgcagtccacggcgttactaagcctgcgccacccacgtgctgccccaggaggcgctaccaggctcttcgggccacaggcctctcctccactgcatgtggcggcagggcgggtaggtcgcagggctccatgattgtggggcagcttcaagggcacatggggcagaggccctcgaaggtcccctcctcagtaggggatgtcattctgatagtactggatcatgttgtaggtccggctcctgaaaggccaagaagagtgaagggagattcgaggagccagcagggtctggggtccctccctgcagggagccctacctgtccaatcagccccttatggctgcccagcacctgaaggtacaaatgtcccaggcgtgccctcccccacccagtgaccacatctgctccaacccgggggactctgaggccacctcatgctcctcagccaaaccgcttccatccgtgggagccactgctctgccccatgggcctcgggccccttggctcgtcctggccagatgcctccaaggggtctgtacgctctcctcgcacctctggagagccccttctcgccctgccccagcccctcttgaggtcctggccgcctggcttctctgcttcctatcagcaagagctccttccgtgcccagcctccacagtgcccttgttagggtgacggacctgggcgccacctgggggcaggtctcagcttcctctcacgctcctccggcagttccccatgcagatggccacacctgggcccctcctcctagtctggatgtggtctgtcccatggcacagccttgggctcccacatgcccctcagggccttaccaaccccacatgtttaagtgctgcccccttcggggatggctcacttgctgggatcgccatcctccctttgttcaggccggacccctcaaagccacctctgactcccacagcagggagcctgtcagcccggtgctctgccttcagaccctgagccagccctccccagggccccctgcacccatctcctcccaccacagtagtgaccagcagcccggcctgcacctccagtcactgcccacgaagcagcccgaggcaggcgcagggaaggagtgggctctgactcctcagccctcctgggaggagggaggcctgacaccacactcagttctaatactcctggccttgtgtccctattgctccttcggcctcacgagccctgcccaggtgggcccggcctctgccaagtgttcccctcggcacaccacagccccctaaaccagcaccccactgctcctcaagagttcctgtcaagacttgggtcttcatgagaggggcggcttggggacagcagaatcctcatcgcctggtgcaggcaaggccctgcaggtgcccagtggccaccgaggcagtgggagaaggcaggggggcggggcactcacctgttgctgaggaagcagctctggatgaccttcatgatgaaatttgcagcctcgcgctcagtcatgttggggctaaacctgtgcctggagaagaggctgtgtcagggctgccatgggcagggccgtgctggctccctggcccagtgggaggagggtcttccatggggacggacttcagctgagagccatgccctggaaatgtacctttggggtccacatgttggaagatggggtgctgtgaaggccacacctggcctatcatgggccctgtccccttcccagcatcacctgagtggccccatggcattaggggactaagcattggggagctaagctactgcagccccagaccttagggtggaggtggggtgggcgtagcatccttgacataaatagaggcccctgggtgggtctctggtgtggccggcacaagcaggggcccctcacagttgtggtctaggggtagagcctcacctaggaaccctgtctgctctgaggttccaaggagatgacaaccacagtgacaattacatgaaaggtacctatcttggatggagcctcagctaatggacaactgtcccccagatggcctgcgtgtccaccaaggaacctacttcaagaacttgattgtctggccgcgaaaacagggcaggcccgtgtccaacatgatagtgaccagggagacgaccacatccatgtagggcctggggagagacaggagggagcggtgggcagaggccagcctaggtggtggccctgcctgtagtcctgtggactggctgatgccaacagcctcaggtgtgggctcctgccacccacctcgcctgccacatcttgcacatccccgaggcaactttcgatctgctgcactcggtcacccgtactgcccaggcaagggctgcccatacgcactctggacaggctgagtgtcctgccctgtcccccacataaggctgccggccatggcttctgcacctgggtgggatgcagacacgctgacctgcctttctctgcggggcagtggggatgaacccaggttggactgtggccttggccaagtgacctgtatatgaaactgggacaaagcccatctttggcacgtagcctgtggggtggcaggtgctcaggctttggtgacagggtggatgggatgcccagaaagggagagcccatggctgaaggcgtgggcaggattgtggggaaggtggttggaattagatgcccagagcaagaatttactggcacaggtgggcagacagaggtgaccaaaggacaggtgtaggtcagcaggtggctgctagcacctacctcactctctggaaccggattcccttcatcctaaaggggatctcagaacgttccacacaccccctccgcctccaccctggtcctcacccaggctcaccgcacagccaggtagcctggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacgagtggtctgttttgaggagtggaaaaggactctgcaacaggagcaccccctccacccccaaaaggcaggttgtgttttcttggagacagtgatggggtgggtggtggggcagcaggcagagaaagagaagggaggaagtggaggaaggagccaagctggggcactgaacctggacgagccccactccgcccagctccagcttctgactcagagcaatggcggctctcgccccagctccctggggccggggccaggcaccctctacagcagaacagcttggtggccgacagttcggacctcagagctggaccctgacactcctggcagggtggtcctgggcattctcctctctgtggggtggggatccctatccacccctgggtgccggggtgaagggagaggagggtggcgctgtggctggctgaccgatgtggatgatatggcccttcttgtccagcataatgttgccgttgtgtctgtccttgatctgcagcaggaacagcaggaggctgtaggcggccatgcttcggatgaagttgtagcaggcctgtgcagagagcgccctgggctcaaaaaggccctggggcctgtgggcattctccctggtcccacacccaggatccctgggcctgtgggcactctccctggctctgtgcccccactatggaggcagagcccgaatcagcaagtcagtcttcggcagcaggagtgacgggctgtctggatgtgggggtgcaggcacttcctcccacactcagaacttaactttcttctaaggagtccagcccagctctacattcttttgactcccaaagtggcttacagatgccctggtgtttttttttttaaatggagtctcgctctgtcgccaggctggagtgcagtggcatgatcttggctcactgcaacctctgcctcctgggttcaagagattctcctgcctcagcctcccgagtagctgggactacaggtgcccaccaccatgcccagttaatttttttacttttagtagagatggggtttcaccatgttggtcgggatggtctcgatctcttgacctcatgatctgcccgccttggcctcccaaagtgctggcattacaggcgtgagcactgcgcccggccaggtgccctggttttttttttttttttttttttcagatggagtctcactctgttgcccaggctggagtgcagtggtgcaatctcggctcacagcaacctctgcctcctgggttcaagcgattctcctgcctcagcttcctgagtagctgggactgcaggcgcgtgccactatgcccagctaatttttgtatttttagtagagacagcgttcaccattttggccaggatggttttgatctcttgacctcgtgatctgcccgcctcggcctcccaaagtgctaggattacaggcgtgagccaccgtgcccagcccaggtgccctggttttaacccttaacaaaggatgactgaggagagcagggtgtgggtagaggctgggtatgggtggctggggtagggtggagcgcacacgactttccccggcctgtggccaccctggctacctgctggaaggccagagtggactcatccccgtactggcgtgtgaagtagtcgtacatgccaaagtctgtctggcggcccagctggtcccgggaggtgcagtcggggatgcactcgatcaccccgcactaggaggaaaggccagttctgaggcccgccgggtgcgaggtgcccagggctgccctactggctccactcagggaacttaccccaggggcagtggccaccacgcggtagggaaaaacaaagaggtccaggccgaccagctggaagatgttcttgaagaggtcgatgatctgcagggccagcatgtcctgggaagccgggaggcgcaggatgcggtcagttggcgtccttgcaccccagtagctcttctggctcatgcagggcaaaagccgagaacccagagatggagtgaggtggggagaccacagccgagcaagagtctggaaggccttcctttctgaccaccgggggctggactcaggctgctgggaccaccaggccctgggctgagcatgaggctgagctgtctggtggggtgtgtgagataaggcacccaacccctggacagttccctcaggtgggcactggcatggcagggacagtgggaaaggggctggaaggagaggcctctgggttttgcagaagccctaatttaccccgtggcacctgaaccatgtaagagaaggaaaagattcacatttctgcatatgagattggactctggtgggcctggagccttggggagcagcaagcccagtccccaagcctacttgaggcctgaccctgcttacctgccggcagtcgtctcccagtttgaagatggctgcctgccaggagatcttctggccgtcggcctcctgcgtgctgcactcatcctcagagtctgagcggcaccgcagacctgcccgcagggagagaggccactgttagcctgtaggcagtgagaagccctctgagggggccagggatgagtcctctcacatgcctgaaaggaaccccagcaatcttggggatcacttcttcaaaaccccaaggaggccaaggaggagcccagcagggcccaaggaaagccttggaacagcaggtggaatccagggttggagtctaagaacatttaggcttaaatggaactaaaaacagagccccatttcatctgcagtgaagacccaggtgtgcctgagtcagtgttgggtgctgtgagctggggggcaggaggaatgtgtctgtacactggggtcctgggagggctcggggccagtgtgcagacatggccatgggaggcaggtccctgcaaggggtggcagccccctctccacagctggccacaccgtctgtactgggttgaagagtgtctccctaaaattcatgttcaccccaaaccttagaatgtgtccttatttggaaacagggtctttgcagatgtaattaggttaagacaaggtcacagtggattaggacagtccctaatccaatgactgatgtccttcaagggagatcatcatgtgaagagggaggcggagatgggagtggagcatctgcaggccaaggtgagcccaggactgctggcaacaccaccagaagctgaggaggcaaggtgtgacctgcccagagccttcagagggggcacgaccctgatgatggactccagcctccagaactgagatcgtccgtacagtagccccaggaaactaacaccccccaacggccccgggcccctcagcctcaggaaggagcctgctggagcatgccagctgactcatggcagacagacctctggggtggcacatctgtcagtgcatttgagctccctgccatcccctagcgaggggtctgactgagggcagacagatggacagacatcatcttttatggagagctgtactaaatttaacacatgccagaagaaactggcattagcaaggaaaagcactgagctcccaaacaaaatcagggttctttactgaccttctttttcaagttcactaactccacatcgcttcaccttgaacttggccagatatggggcttttgcagcactgaaaacaacaaaaagaatgtggcacccatgatgcagccgagaaaaacttcacacgcggacgctgtggaagcgggggatgggtagggtgaggcgctcacctctacatcggggtcccagacttgtagtcgacgtccagcacaatggcttcagggttgctgggcagggagcagcctgtgcagggacagaggcagtcacagggagtgcatgtgtcaccacaggtgagccagagtcagtttccaacacggatgttacgtgcgtgtccaccctgcaggcacaccccacccctgtggaggggcctctggtccttgtccagggcaccactaacttattattctgtggccgctaagggtccgtcctccttgactcttcgactcttccaaccatcgaccaaatgagtctgcaccttctgggaaatgctcttcctagaggagcactgagccccatcctcacggatacagccctactgcttctgggggtgtgtgtgaggcctgtcctgcctccacctgcctgagcaacagcctctgaacagccctccattcttggagtccctgtttttttttttttttttttttttttggatagagtctcactctatcacccaggctggagtgcagtggtgcgatcttggctcactgcaacctccgcctcccaggttcaagcaattcttctgcctcagcctcctgagtagctgggattataggtgcctgccaccatgcctggctaatttttatatttttagtagagatggagtttcgccatgttggccaggctggtctcaaactcctgacctcaagtgatccacccgtcttggtctcccaagtgctgggattacaggtgtgagccaccacgcccggccttccttacccatttgaacactactctctcaaaagccttacttaaatgtcactatgtccatgaactgtccttggttctcccagcctttaggacttttgtctaacacgtttctttttttctttttctttttgagacggagtcctactctgtcgcccaggctggagtgcagtggctcggtctcggctcactgcaacctacgcctcccaggttcaagcgattctcctgcctcagcctcccgagtagctggaattacaggcgcccgccaccgcgcctggctaatttgtgtacttttagttgagatggggtttcaccaagttggccaggctggtctggaactccttacctcaggtgatccacccgccttggcctcccaaagtgctgggattaaggcatgagccaccgtgccaggccaacattgtttctttatgcttattttatatctctgtgagttcaagcttcttcagctcagggaccatgtcttactcatctttttaacagccacaatacccaatgtcatgccttttcttttcttgtttttgcttttttgagacagagtctcactctgtcacccaggctggagttcagtggtgcgatctcggctcactgcaacctccacctcctgggttcaagtgattcttgttctcagcctcccaagtagctgggattacaggcacgcgtcaccatgcctggttaattttttttttttgagaccgagtgtcgcactgtcatccaggctggagtgcagtggcgcaatcttggctcactgcaagctctgcctcccgggttcacgccattctcctgcctcagcctctcgagtagctgggactacaggcgcccgccaccacacccggctgattttttgtatttttggtagagacggggtttcaccgtgttagccaggatggtcttgatctcctgacctcaggtgatccacctgccttgacctcccaaagtgctgggattacaggcatgagccaccgcgcccggcccaggctcccctttctcagtgagtgctcagtaaatgtgtgaaataagaggacaagggaaagcctgtttctggccaaggaactgccagtccccaagggggatgtgtgctccttgagccctgagaggtgggctttgaggggagccaagcttggccttgctgtggggtacagggagaggggggcatgccatctcctcctcttcctcacctgcccttctgcctgctccaggctgtggctcacactcaggcccctctgtgctctcctgctagagccctgctggcttccctgacctctggggcaagactcagccaacacaatctagagccaggggctggggacttctgtgcatgccccctgcagtacaatgcttccagctctttttgcccctccccagcagttgtggccttcccaatgcgggaacagaggccctgcatacatgtcctgccctctctgggaagccgtgctgttgtgtgagctcaatacaatgtgttgggaagaaatggttaaaccggggtcctgcagggcactcaaggaccagccgctgtgaacatctgcacgggacagacagagtttggaagacaagtttgtgccaatagttagaaatgcagagagaggccgggcacagtggctcatgcctgtaatcctagcactttgggaggccgaggcgagaggatcacaaggtcaggagattgaggccatcctggctaacacggtgaaaccctgactctactaaaaatacaaaaaaattagccgggtgtggtggcgggcgcctgtagtcccagctactcgggaggctgaggcgacagagcaagactccatcgcaaaaaaaaaaaaaaagaaatggagagagagctgcccagtgaagtctggatttccatcttctcttgaaaagctcggcttgaattcccatgtggccacagccacaggcacccaggagcgacttcccatggaggcggtgagggggtggtgctgatgggtcccagcacacctgagccctcccacactgggcccgccatccccttgtctgtgtgacctgctcctgtaatgctggagcctaggaaccctcttctagagtaacagctactgaggtcagtgtgagcctccagaaaaacagcaggcagcaaggaagatgaagggcacccactgacgagcagctcccgctcactagcggcagattttggggaggggctggggtcctggggcaccaggcaccgtgggcccaagcaggtgtggggctggccaagccactgtgtccacatcctgcagtgcctggagagggcagcagccttcacgccccgccgcccgcctgcaggaagaggttggtctgagcctccagaagccacctgctcacctggctgcaccgtcacttcagacagggccgacagacaagccttctttctctggtcgcctttagggtagggcctgagaaacaggaaagaaattcttgctttgtctcctggaggaactggctactgggggacagcccagggcccctcctgcctggattgccctctctgtccctctcttcccggctctagctgctcctagcgcagccaggcaccactggcagcgattcttgccctgcattcctcatggagaatccccgacagccccggaagggctgttttctggcaggctctgcccctgctgtgtgcgggggtgtgtggctgggggtggtgggggtaataatgcctgccacctgctgccacccaggaaacgctagctcccgtccttcatctcttgggttagaagctgccagcactgctattctcagcacccagcccagaaaagggcctcaaagtgaccaaggtcagagcagtgtacgcaatggagacagcccagccggcgtgcccagcattgatgactccagggtttcatcccttatgaatgcacaaagccaccaacatccaaggatggtgtcaggtccacatgaatggaaggtctaggaaaacgatgacaggagctgcaaaggcagtctggttttcctgacaccaagaggatcgatccttcagagtgtggagagggcagggtgacctcaaattgtggagccatgtgctaaattccacaaatctcaggaatgaaactaagctgtgtttcctgaaactggcgtggccgtgcattctgccataccttcaagagccctgactcaccccaagcagtgcttccccacccaccctggctgtccatcagaaccaccagcagccccgctgctagagactctcattcatctggttggggccacgcacgggtatttttaaagcttcccaggcaattctgttaagctgcagggactggaacaagattccagaaggtggtttccgaagcactgcacttacttgatgacagccgacacgttggtgatcttgttaaagaaatcaaactcccgctggtaaaagtccttcgctgggcccgacaaggagcctgtgttctcctctactaactgctcccggaggtcgccgatgtcagctgccaaggaaacaaagaggctgagtctctgtggctgtggcagaggcccctcaggaataccagccctgtttcccaggccccagactggcggtgcccagagtatgctctgcaggcttggtgagaccataacagctgctgtgtgccccttttgctgtgttgacacagccgacactgctgggaagctaagctggtgcctaagcggagctcaaggtaggggccaagcgcacaagtggacgtggaatcctcactgctgcacacgctacacacgcaggaagaaaaaagcccgtgtcatttatgaatgtcacagggcatagaatcctcactgctgcacacgcagggagaaaaaagcccgtgtcatttatgaatgtcacaggtgaagcaatgaaaactaattcttattaaactctaccctgaatacatgtctttttttttttttttaatagaggcacacagtgggcggggctctatattaaatagtgtctctcactattcaaatcccaggctgaatttaaattcctgggctcaagagatcctcctgtctcagtcacctgagttgctgggactacagctagtaggtgggactacaggtgcgcatcaccacatctggcttttaaagtatcctttgtgatgaaacgggatgtgcacgaagcactcttgccgcatctaaggcaggcgctgtcctgagaagcacctggagcttgtctgattttggagcctggactaacctttttcacagacctttgtttttacttgaagaaatgactgacagacaacatatagctattcagacttagggatgtggcagatgttttcctgaaaatgaacaaaaaataaatcttccactcaaaggaactgaaacatttttttggaaaacttggatctgctgctgtgagctcaatagcttcccttaaaaactctttctgggccgggcgcggtggctcatgcctgtaatctcagcacttcaggaggctgaggcgggcggatcagaaggtctcagccaggcaatgtggcccacacctgtaatcccagcactttaggaggccgaggtgggcggatcagaaggtctcagccaggcaatgtggcccacacctgtaatcccagcactttaggaggctgaggcgggcggatcagaaggtcaggagtttgagaccagcctggccaacatggtgaagccccgtctctactaaaaaataaaaaaattggccgggcacggtggctcatgcctgtaatcctggcaatttgggaggctgaggtgggcggatcacgaggtcaggagattgagaccatcctggctaacacagtgaaaccccatctctactaaaaatacaaaaaattagccgggtgtggtagcgagcgcctgtagtctcagctactcgggaggctgaagcaggagaatggtgtgaacccgggaggcggagcttgcagtgagcggagactgcgccactgcattccagcctgggcgacagagcgagactccgtctcaaaaaaaaaaaatttaaaaaaaagtccgggtgcggtggctcacgcctgtaataccagcactttgggaggccaaggcgggcggatcacgaggtcaggaggtcgagaccatcctggctaacacggtgaaaccccgtctctactaaaaaaatacaaaaaattaggcgggcgtggtggcgggcgcctgtagtcccagctacttgggaggctgaggcaggagaatggcatgtacccgggaggcagaggttgcagtgagccgagattgtgccactgcactccagcctgggcgacagagtgagactgtctctcaaaaaaaaaagaaagccctctctcgtctctcagtctgtgcttagtaatcagctaggcgctgagagaacagggcatggcctccttacagaggtttgctgcttctttgcgtggcatgttttcatttggcattcccttccctggaatgctctgccctgtccaccctgcatgccggtgcagcctttcagactcagctcaactgtctcttttccagaaaaccatctctgattccccaactctggatgggccaagtgtctgtaccggaggactgctcccacagttccctcaaattgaaatcacctgtccatttgactgcctcctacaagacaacaacagaccataccccagtcatgtaggtgtgcaccagcctcagcccaatcctgggccgtcagctgctcagaggggtgtgtgaacgcagctggtgccagtgcagggaaagtgcggtgagtggagtctgctcagctgcctcgggtgcgtgtttatgcttctcagctcaggccagaggagaagcagagccaggcatgcaccggcctccaatgaccgtgcaacacagtcaaggccagggctcaggggggtctaactgcttttccgtccctacctctggcaccctcagggctgcccacgttgcacccctgtcctgcctgcctccaccatgagcagctgcactgttgagggttacctgggggaacaagctggctggcggtcaggtacttcttatctgagaacatggcggtccaaaatttaatcatgatgcttatgtcttcacgcagccgcttctctccttgagtaggaaactttgggggacagcttcaaacaaccataagaggacaacggctgagtgtctggagtcagggactagaggccagtcacacaaagcagtgagaaggtgatgcagacaatttcttaatgacaaaaggtcagcccaaagccagtcattagcaaggatgatctggcccattcccatgggaaggtgtggtggctcgggagccctcttatgccctcctccctcactgcccacagcagcccctacagctttccactgaagctgcacttgtggcagatcagggcaaggaagctgcactcacacaacagcacagcctatgggtgcagagccccaggcagtgggtgtttgcaattcttcgtgcaataagccttcacattaacagggaaattaaatggacgcacttaatctcctaaatcagttgaactgagggaaaatttgcctacatctcgctgggaggctagctctaagtacacgggacacatgcacagggctgaagggtatttaaatccacagggccagggatactgaaggaggaggttggtgagcacaactgggcaactgtgtattcctgtgagtgacttcctgggggtctggggcgatggagcacttggaggggctgggccgtccctggatgccgcacagcacatcttgggggagtacctgaagtagtcaaaggcagtggagtagatcttctcgcgaagcacattgcggatggttgcatttggaaccacatcggcatgcaggagggacagccccagggtcagcagcctgtgagggagccccggacccggtcagagcaggagcctggcctggggccaagttcaccttatggactctcttccctgcccttccaggagcagctcactgaaatgtgttccccgtctacagaagtaccgtgatacacagacgccccatgacacactgtacacaccaggggccctgtgctccccaggaagagggccctcacttgaagcggggcccgatggccgccacatgccggttcatgctccccttggccccaccgatgttcagggacatggagcgctgcagcaggctggagaagatctccacttggtcagagctgcagtacttggcgatctcaaaccgctgcaccaggaactgagcgaaaagaggaagacgctgtggtggtggggctgagccgggctaaccctggggccggcagagacagctgaggaggggttctgggctgactggccgagcttgccgaaggccttgggctcggctacccccaccccaggaacagtcctggccccccaggtggagcaccccacagccttggtcggggaacaggcacgtacgtcgatccagatgtagtggggggtcacttcggggggacagggtttgggttgacttgcttccgaggcagccagggggtctgcttcctttatctcagcagaaaacaggccaaatttctgctccactgtcatgtgccagcccctgccatctcccgcatgaactacaggtacagaaggaatgttagctcctctgtgaaacacaaaaaggggctactgtcaagttttctctaattaaaaaaaggaacacgtgctcactgaataagatttagaaaccaagaaaagtatgaagaaaaaaatgaagatcgcctatagtcccacatcccagggtcatctgtgtcagtgcttggtgtattttctccagcctctcgaggctgcattctgttcaacccggttcaccgtgtggacattgcaggtgtgaggtggcagcacccgggatgtacctgatgccctgacaggcactgggtaggtgactcttctctataaccctgataaccctctgtggctgtgagcgggaagacccctctgtgggctgctgagctggcaagggcagaagagggttctggatccagggcctggctcctcctctccaccccacacagaccctacccgataccttcatcccgctaaccagattaggaaggcccatggagccgaggcgagcctgcagccaccatggccaggcctgggagcccagggtcaggctgctcccatggcccagtcatgctcagccaggtccccattccgtgggggggcatgaggggtgcccagagggagcagcatggtgcccgggagacacctgggtgctgcagagagtaagaggtgcagctcacacatggaaagcccccatgatttctgggtgtttttacaaggagaccaacaaacagcatttggcatctggccaaagaggattctatccctctgttgtcccagcagcaccagcttctacaagggctccaagcgcctgtgcagaggtggcaacgaggcctagtgagtagaacacacaccgcggctccctccccagtacccatcccctcccttcttcctcatgaggtggatcagggtggccacgtggccagtcacagggctctcagccagggtccctgctggctgaggcggccactgttctccccggccactctaatgagccagggagagtgaactgggcaaggccctgggaacacatgccagggtgagcttcataaggtcaaggcagctggcctctgccctttgcactctgtccttgtcttccttcctgctgggaggcacagaagccatctggaggctgtgagggtggagacaaaggccacataagcccaggatggccaggagccgacaggagcctggggcggggctctgtctgctgcttccctctaagctgcccatggggtgaggactcctgggggacgaggcactacagcctgctttgtgtttcctgcagaccgattagtcttatggaagcagacaagggagcaaaaaaatggcggtgggggggaccccagaactgccacggacaagaagccatcgaagagacacactcccatctatttgttaaacaaccacatcctggtggctgcctctgtgccagggcctcgtggactctgggcatggtgctctgaatgaagacaaacatgaccacacagtctatggtggggaccacagacaacaagaaataagctacacacactgagaaacactaagaaacagcagtgcgagtgagcgtgtggccaggtggccagggagagccctggcaaggaggggacatctgagatgagccctggaggagacgcaggagtgaggcgcaaggcacggccatctgagaagagggaatgcatgacgcggcctatggtgggagcagcccaggagggcagcttcaaaagtgaaactgatgggatgtgctgagaatcatccgtgggaagtgcaagcaggaccccagcatggccacagcacagcaagcgaggggaagagagaggatggaagtcaggtgggaagggggcttgcaggtcacagaaacaagcccaccttcgagtctgtaggggggctctgattcccccctggcttgcgccaaccgcatgtggagaaggggaagatgcctggggttggggagcaggaggccaggccagggggcagcagctgggatgctgggacttgtcagatcctggataaacctcaaaggtgaaggtgatgggatgtgctgagagtcatcagtgggatgtgcataagagggagtcaaagatgtctgagcagagagaaggacctcgctggcatctacagtgaagggagggacctcgctggcatctacagtgaatggagggacctcgctggcatctatagtgaagggaagggtcacgctggcatctacagtaaagggagggacctagctggcatctacagtgacgggagggacctcgctcacatctacagtaaagggaggggccacactggcatctacagtaaagggaggggccccactggcatcaacagtgaagggaagaaccaccctggcatcaacagtgatggcggatgggcgaccagtgcagcggtgtctggagctgaggtcggacccattagttggggctgctaatcagttcaccatgcaggccgtgggccaagccactgaagggatccacctggactaggagtgactgggctgggtaagcagtggagctggccagagtagccaggcagggaggaggagccctggggcatgccagtactgagaaggccctgagctcaagaaggtccctttattctggaggatgaaagggctacaaaaattacaaaggccttaagtccctgggaaaagcagttaggctcccaaaacagctgctttcaagacccagaactctgaaggaggctgtgagcagctttccctgagctgatctgtcctcctaccatctgggacctgctagtgatatctgtactccaactgccctgcccccaggggtcaaccaacccactcctatctgaggacccactcctatctgaggaccagacagagaggccagaggttcaagggcacctggactaaggaagtggagaggagagagacagatctgggctccagagccccaggtacaatgtgagggctgacacgtggtcaggagcacccccagtgccctgtgaaatgggaacggctacagcccctactctttttcttttttttttgagacggagtttcgctcttgctgcccaggctggagtgcaatggtgcgatcttggctcaccgcaacctccgcctcctgggttcaagcgattctcctgcctcagcctcctaagtagctgggattacaggcacatgccaccacacccggctaattttgtatatttagtagagacagggtttctccatattggtcaggctggtctcgatctcccgacctcaggtgacccacccgcctctgcctcccaaagtgctgggattacaggcgtgagccactgcgcctggctgagcagcccctactcttaaggcccaccgaggtctgaggctgaagcagcatatggaaaggaatcctgaccatagcagcactgtgtcctgacagtcacaatttgtggtgaaaccagggctttctggtgaccccagaaaacatcagtgccggctctgccagcacccagacacctggtaccccgagactggcaaggggactggaagagggcagtggcctccaggctccctccacactgcccagtgctgtgtgcacacaaaggaccacgggtcagacagatagaggccgagctgtggggctgtgtgccacccagaaactccggggaaaggggccagtggcggtcccccctcccctgcgcctcaccagagtgccaagggcccagacaccatgtgagcagcagccagcggggcgggggggcctcctgagcccgtggccttcctgggggtgcatcaatgcctggtcacctggggaagagaagacgaacacagtcacccagacagccatcagcgaagaagggagggaagggcgatgaagggacgcacctgggggtctctggctggggcaccaggggcagcccagcaggagactgtgaccacagagcctggtagttggatctgacagccaggaagagtaaggaccagcgaacaggtctagggagttcggtgggtgcaatacctgcccctctaacacaggacattaaggacacccaggggccacctaggccagggggcgctggtggcagacacacaattcttggcctgcgggtgtggtagcaggaggcctgggcagggcccttcccaagctggccacatttacataacaaaaggtcaaaattggagccacttgtgcaagggctatttataagaaccagtctcaaccgcttttggctcccccgttccttcccttcctgatctgctctcaccgcctccctgcccagagggcccagccccctagcccgcctggcctgaccacatggccttccctctccagaggtttcactgcctaagggctcacccaagctgcaggcctgggctttcaataccggcccaccaaagccttgggcagctgccgccaggaaacgaggggttccctcccacccccagagctctgggtcctgcaggaggggggatcctgaggtggtgggtccttgcaccccacacctgccagcctgggcccccacggaatagagccggggtcggggaaggggcgtgcagcggcccgtccccgtttccccttcccccactccacccccagggccagggaggctcagcaggtccctcaggaatgtgaccagacccggggtgccggcccagagctgggaggcctaggctgcagctggccagctgtctctccagcccctagtgcagctcccctctgggtggggggtgtgaggggagggggtgcatggctggtccaggaccccaccaaaggcccagagggcagcagaaccagctctgttggtaggaagcccaagggcgtccacagttagcaagggttgggcccagtgggctaatgctgggatgaggccagtagggcaggggccactgaaacactggcgggagcagtcgaaaaactgggtagagggtctcggtggcacactggaggcaatcagataccaccatccagccctgtgccacttcatctgctccccaaccactgcccctcaggacccagtcaaccatgggtagagcgcatgccaaactctgcagccaggggtcacctgaccttgccagaggccaggccagctactggatgccgcgcagggagtgggtggcagaataggactggggggcacctgagtgccatgggggtgggaacaccctccgtcagtgcccactgcctggccctgtcgggcactttacaagcccaaggctagcactaggtctccccaccaaggaaggatggccccaggctgggtcagctgtgatgtagaacagggcagggctcctccctgaaccctccacttgagttagggggtgtcagagccacctgcagaaagttcacagcaagcacaatgccaccatgcgtgccatccacaccagctgggccaagtctgggccacatctaggccgccactgtgtctgcgagcagcaatgcagcctcaccccatggcggggcagggggtggcacacgccatcctgctgcgaaacgcctactaagcactgctccttccttctcagccacagagctctgccctacccgctcaccgctggacatgaaacagcaagtgcctatcctggagggctccgcctggggagtgccaggtaactagaaacacggctctgggtgctggcccggatgctggtgctcagccctggaagcagctgactgcaggctgcgatgagaatgccacctagcacccagcagcccctggcagcaggcccgggcagcacgcctatcagcccccaggctagcacgcccagccctggcctactgcccatccagaaacgctggctcccaggacgcccaggatctgaggcagtagggcagcaggcctgggctatcggggccagctgggcattcgcctaaggctgtgacccatcccctccctaggacagagccttcaggggtccaggggagaggcaagaagggtagcacagaaactatctcccaagttaggatccctcagctccaggattccccctgtaggtggactggccccagctgggaaggacaagagccccagcagctggagggagggccagctctctctgcggaatcctgaaggtctgcaggaaggaacacaaagcctcggggttaccttcccaggccatctgttagagcagacacacggccctgtttacggaacagccaacatgccaactgctctcctttccttcccctcccagtccccgccacaaaaaagccagaaagccatgtccccagacactgagggcaggcccagggcccaggcaggtgctagcgggctggaacagcactcagatactccagcctctcaagccactggtggcacatgcccaagctctgtagaactgggccagccacagcagccccacccccgctctgttcgccctcaaagaacttacagtaaggcagctgctctgcaaggcccagtcagagcctacccggcccagcaagtccattctgtggcaagaaaaaccttggggacacacatacccaactgctaagtaagattatctctggggagcgggattacagaaaaaccatagtatctgtatattatgttcatttctgtaatactcaacattttaaaaagtattacctttttttttttttttgatggaatctcattctgtcccccaggctggagtgccatggcgatctgggctcactgcaaactctgcctcccaggttcatgccattctcctgcctcagtctcccgagtagctgggactacagccgcctgccaccacgcccggctaattttttgtatttttagtagagacggggtttcaccgtgttagccaggatggtctcgacctcctgaccttgtgatccgcctgcctcagcctcccaaagtgctgggattacaggtgtgagccaccgtgcccagccaaaagtattacttttaaaaccctaaaaatacaaagggcagaaatgatgcagagacatggatgaacctcacagtcgtggcactgagtggaagaagacttttgcgagagtacagactgcatgactccatttacatcaagttctagaataggcaaaacggactgagggtaaaaaccagagcagaacaggctgtgagcgacaggtgaggactgtccaggatggggcgagggacaagcgcccactgcctggccctgacaggcctatccaggacggggcatgaggaactctttggggtgagggcagctctctagcttgctgggaatctgggttaaggtaaatgaaaatacaattttaggcccttaattgtatgtaaactttacttccaatgaaacctccagacagaggctttcacaggacattctcatctcagaagctcagcacgataccctggaaacaccaccagctaacctttcctgggcactgttgtatgcccgaccatgtgctatgtcactggagccgcagggccacccaggagcctgtgcgttctgtccatgtgatcaggtgggctcctctcaatcttcacacagcacagctgagcctcaaacccagcactcaccctgacctctcacctccccacaaggtaggaaaacctggggctgaaagtgtgcagggacatgtcatctttagccttgggcaaaggcaacctttcccactgatgatttccagatcacccaggggtattggttctgcctcaattttccaactggcacagagatcaagggcgacggtgaagcagattggaagggcaaagacgccacggtgggaacaggttcctatccctcccggctgctctccagctgggtggccctcagtgcatctccagagggcagtcaaaagccccaggccaagaccaccctgcactctggatccctctactcgctcaccaaacacagaccagccaaataaccaacggggatggcagaggccagggcactgtgcacccctcgctgcctcctgacactcgaagcagccccccattgggggacccactagcccatgatcctacgcgagcgaggtcaggccacacctgcccgtgtgtggagcctctggtcagtccacatggctgcaggggcctgtggggaggctggaacagggttacctcaaggcctttcttctaagcacccagcaaagggcaggagagtgtgctctagtcagcatctttcaaaggccaggagagaggaggttttcagatcaaagtgatccctgctgaggcagaaagcagaaaactccagccccaattctgagaggcactgccccaacccagcctggatacccaccttgcctagaaccttggcctccaagaagccaggcattcagaactgctccaggtgctgggcctccacatggctccttctggaggccatgactctgggagacaggaacacatctcacgcccatatccaggcccacaggcgggggtcaaactcagggtcaaactcatctcagccacatgataaccctgccttcagactgaaacttctggctcacgcccagccaggagggaggcctggggagaagggtgaagaccaggaaagggcgccaccccaagcaggccatcccgcctagccctcctaggatccttctcatccaccttcctccctggaagctatcctttactaccaagaaaggggcttcctgcaggaggcctggagctatgctggaggactgaggagaagctccccccagcccactcccaaggagcagcaccttaaccacctcccagcctaaacaaaagtaacagtgaaatgagaaccctccagctaacgccaagacagctgagagtgagcagggccgcccacggcccgcccgagctccactgtcaggtgggagggacaagcatgccaggctgagaagccatgctaggcagggcagggccaccaggcaacttccacaacccagaggtctaagtacatctgaccagggtcagagagagccccagacttgctgccactgctcccaaacttcagtctaaggtcagcatcggccctggttccagaccaacccccaactatagtcacctcatacttcaggtgtggccgggacagatgcagctgcaacgggtggccctgtgtgagctcagcctcttcccaggagcccctaagccatgggagagactgcctggaaggcacaaggcagccaggcaggaggcagccagtatccagaagtgccccaaggcccagcccctggacacaccaaccagccctgcacagtcacaagcccaggactttgttcatcctatccccatggcctggagtcctccctgaggaagccttggtagacaagagatagctccaaggggcgaaggctgcacctcgcccaccgccacagccctgtatgagatggcagcctacatgtgggcaggtctgatctcctcaatcttcccacaggcccagtgagcggggcgttatctctgcagtttcagataagaaattaaaggttcttgggggttaagcaacttgcccagggtcacaagagcatgtaggtagcagagtgaggacctaaagcctgactccagtgttgtagtctgatgacccccccgcccaacgcaggcagggccagggatgccactcacacatggcttccaactgccaagctgcttgggggagctagaggaggcaccgccctccatgcactggtgtgccaggagcagggactccagtctgcacctccaccctcactcccccaccccccagcaccacctgcctatccacagcagggccccacctgggtgtattctcccaaactcactgtgagggcatggggtctgcccagctcctccaccagaagtgacaaggtggagcccccatgcagcctgctttggaggcccaggttgtgcttgctgctcctctgggaacacccccaccctccatgacctccttccctgtcccttcaggaatgggctggtggtgggtggggctcactgctctgggcaagcccagccatgtaatccagcccagacctggatgccggccagcagctcctggctctcctcccagaccatcctcctggaaagcaacaggctccacaaatgccaggagcccagctctctccaacgcagcttctacaaaataaacactcgggttccactcaacacattggtgatgcagcgattgggacctgaggctggcctcctcctcctctgctcctcaggccagccctgtggcctaaagtgagggaggtagcatccaccccagcccagtgactttcccaagcccatcctgaaatgcccatgggacctactgatgacctcgtactgcccacagcagggccaagccctgcatggtccgagccacccgcccatgggtactgtcccttctgaggtgaggaagcccgggctaacaccccagcacaaggaaaaggctggaatgggctgctgagaggagagctggaccgaaagtgcctccaaactgtgcttcccccagaaggtacagcctcagtcccctccctctcctcatcacttccgggtttggagccagcaaggaatgaggccaggaagaccttggagacctgcagctgatttcccctgctagtgctggcaccaaggagggccccaggcctggcacagtctggctgacagttctgagacaggatattggagacaggcaggggaacattgctttaacaagcagaataacggccaggtgcggtctgtaatcccagcactccgggaggctgacatgggtggatcatgaggtcaggagatcaagaccatcctggctaacactgtgaaaccccatctctactaaaaatacaaaaaattagctgggtgtggtggcacgcgcctgtagttccgctactccggaggctgaggcagaattgcttgaccctgggaggcggagcttgcagtgagccgagatcgcgccactgcactccagcctgggtgacagagtgagactctgtctcaaaaaaaagaagcagaataacaatttaaggttgtgatagtgactacgaatgctgtgctcacctccaaactccatcccaacactaccctgccccctaagaggggcctgagcatggggtaaaaggctcgctgacagccacagagcaggagcccacgcaagaccaccagaggatgtgcagctgctgttcctagtaggtgaggaaaaagcaggaatctggcatccacacatgtcaggaggcaaaacaggccctgtgctggtttctgcagtcctctccagcccacttccctgctcttcttgctcactggccatgacccaagaaacagcagcagcaccaccagggatcttgttagacacgcagaggctcagactccatccagccctaaccaccagaaccctgggggctcaaacacacagtcaagtctgagaagggctaggttagaagctttttttccttcttttgtttttacctggacaccactgattggaaagctctctacggcctgaaagccaagcgctccacaagtagtaaacgctcaagggatgggcatcaagtggaaggagaaagcccccaaaacgaagatacatgtcccatgtacacaagctcacaggctggtgaatacaaacggtagacctagaatgtgccacaccaaggctgagcgtgttaccacaggtaccagaatggtgaccacgctggagggttccacaaaccctgatcagagaagtaggcgtgagtggcaggcagagaacacagctctgtgtggcagggagggaggacaagcagtggcagcacagcagacaacaggtggaaattctacatgaaaggcactaaatgggcgaggaaagcctgggccgcccaggtggaagggactatcgtgatcatctctctcaccctagggacaccttaaaaggaggtaactgagccccaaagggaggcacccagcacagctgagtcacagagctgcagccatccaacccacagctccaggagggactctccaacttcacaatttcaaaatcaaccctagcagctaacaatttcttaatgccaagtaaagactagaattagaaacaaacagaaaccctatcatcttctaccatcattacttcacaaaagaaaacatttcaatgatcaaagagcaggaagaactactggcagtcctgcacctatgcagttctccaggcctggcaaaggctctgaggcaaccagcatgaaggagccactgcaccgtctgtacgcaacaccgcctgacccccgggctgggacaagactgagatgacatgctgaaagggaatcagaaaaaacaaaaacacaaaaattcaacaacagatactaaagacgggattttgactagccaaacaaagactaaaagagtatctcccagggatgaaaggaaaatggggatgtttttaaacaagaccaggactgttccagaaacaataagaacgtcaaagcccatcaggaaaaaggtaacaccaaatgttggccaggcagtaaggcaaccagaagtctcacatactttataattttttatttttttgagagagagtcttgctctgtcacccaagctggagtgcagtggcgagatggctcactgcaaccttcgcctcccaggttcaagcaattctcctgcctcagcctcccgagtagctgggattacagaagtgcagtgcgccaccacccgcagataatttttgtatttttcgtagagatggggtttcaccatgttggccaggctggtctccaactcctggcctcaagtgatctgcccatctcagcctcccaaagtactgagattacaggcataagccaccgcacctggccagaaaactcacatggtttagaaaacccttggatggcacaatctaaaactgtgggcccaaggccgtgggtggtggctcacgcctgtgatctcagcactttgtgaggccaaggtgggtggatcgcctgaggtcaggagtttgagaccagcctggcaaacatggtgaaaccccgtctctactaaaaatacaaaaattagttgggcgtggtggcaggctcctgtaatcccagctatttgggaggctgacgcaggagaatcacttgaacccaggaggcagagcttgcagtgagctgagactgcgccactgcactccagcctgggcgacaagagccaacttcgtctctaaataaataaagcaaacaagctagctagctagctagctgtgggcccaaaaactcacccaaggtatacgccaacaagaatgcacacgtatgcacaccaaacaggcaggcacactcatgaaggcccaacaatggaaaacaactatgcccaccctgagaagggacagctgcaggtataaaagactatgagccagcagtgaacaggacagaacgtttaggttgaactgtatgaatttaccttttaggggtaaaaaaacagctggctgctgataatttcacatggtttgacttacaaacaacgcagatgaatctctcaaatatacttttgagcaaagatgccagagccaaaaagactattacagttccatttgcatacattcaaaagcaggcagcactaatcttatgggtgggggttgagagtgactacaagcttcaggatacgtgaggggcttccagggttgtgtttcgcactctggatgctagttacaagggcataatcatttgtgaagaactcttggagctgtgcacacttcttacgtaggctgtccttgaattcaatacgtgcacagaaaccttcagaagggaagcagagatcaacttcatcctgatcagcaagtagactcagtccaggcagcaacctctcctggacccccaaccaataacaacaacacaggaagcaaaatattggcaggacagctggcaacgcggcaatgtccaggatggagtgcccatcctagaggagggagctcacacaagccagccaggagcccacaggaaacagagagactactgtaaatccttattaagagcagactcatgtctgctatctaaaagataaaaacctgataatgtttttaagttgtcctaaggtccaattgactttttttttttttttttttgagacagagttttcctcttgttgcccaggctagagtgccatggtgcaatctcggctcaccgcaacctccgcctcccgggttcaagcgactgtcctgcctcagcctcccgagtagctgggattccaagtgtgcaccaccatacctggctaattttgtatttttagtagagacggggtttctccatgttggtcaggctggcctggaactcccgacctcaggtgatccgcccgcctcggcctcccaaaagtgctgggattataggcgtgagccaccacacccagccccagttgacacttctaaaggagaaggggttctgcaaatcctgaaaggcaagcccaggagaaacaggaaatctgggagcacggcaagcaaggttcaaacaggacaccaaataattcccagcaaccgcctccagcaggtcctggtggcagccaggtagggcaggagccagctgggcatatcaaagggaggaagccaagaagaaaatgggcgagactctcagggatttggggtcaaaggaagccgctgggagaaggaaacagcccacttgctccttcataggtaatcaacacacaaaccccccagtgcctcaaatggctcaggagctacagccaaagatcaaggatcaagttattttactccaagaaagaaaaaaaaaagaaaaagttatacattcggcatccattggaagttttgtgattgtttggagacagggtcttgctctgtggcccaggctggagtgcagtggcgcgatcatagctctaatttatgggctcaagggatcctcccgtctcagccttttgagtagctggaactaaaggtgcatgccacgatgcccaaccaatttttaaaattttttgtagagatgaggtctcactatgttttccagactggcctcaaactcctgggctcaagtgatcctcctgcctcagccttccaaaatgttgggattacaggtgtgagccactgtgccaggccttaaaaagcaatttttacagataaaattgggcaactgctatggaaaatattacaatctatggtcctgtgcctgaaaagcctccaagtgtgatactttatagagaagaggtctctcctgtccagtaggtaacttgaaagtgtctaagagacaagtgcccaagaactcaaagaatgagagagggatccattcaaactcagggagaaaaatgctcacaaagtttcactgtacttctaaactgagtctcagtggtgcattaaggaactggatttagagacagaaaacaaaataaactggcacttctctgcctcaagaagcatagcttgggggtgaaaagtcagctacttagaaagcagcaaaaacaaaacccagaaacccacccaaatgctcactgccagcaggacaggtgattatgtgtggatggcgccaccttggacactgaaatggagaatgggaacgcaggaactgctgctcctggtgtcccaagagtgcaggacacccggctcccagcgaactgagccaaaatcattcgcagtttcaggatccagacaaaggtgggaaaccgacaaaagccagcgaatggctgacccgcaattcagaagactgttggcttctagagggaagtgggaataagccagggagaagtgcatggggtgtcccaggaacttgggaggctatttcttatgtggccatgagggaacaacggtgtcacgcttagtgggacacccacgattcaaccaatagtgggtttaccactacttatctattctttaagatttgtgcacacacatatatacgtgtaatttacctttgtttttttttttttttgagtattcctctgtcgcccaggctggagtgcagtggcacaatctcggctcactgcgacctctgctgcccgggttcaagcgattgtcctgcctcagcctcccgagtagctggggattacaggcacccatcaccacacccagctgatttttgtggtagagacagggtttcaccatcttggccaggctggtctcaaactcctgacctcaagtgatccgcctgcctcggcctcccaaagtgctgggattacaggggtgagccaccacgcccggcctatttacacctttgtaaataacttcttagagttcaatggctaagtatactaaggaagctgagcctgctctgtgcagaagtctcaaaagaaaggaaagtcgggtgtggtggttcatgcctttaatctgagcactttgggagattgaggcaggaggatcgcttgagcccaggagttcaagaccagcctgggcaacaaggcaagaccctgtctcatttataaaacaaacaaacaaacaaacaaacaaaaaacagagagagagagagaaaagaaagagaaaaaagaaagaggaaagagacctccctggaaatcccaatccagggagaagccaagaggctaaagctgaggtgcactcacagagcacctccctttcaccacccgagagatcacctggtccacagccgtcaaactcagcaaggccacacacttgggcagctatgacaacaatgcacaaatgagggctttggagggctcagttcccacaagagataacccagaaaatatcaccctgtcctaatcatacaaagcaaaagaacctggggcctccacacctggggtagcaggtatgcttcactcaacagaagttgtccaggagggagaaatcccaggcaacctcccaaggtctacaggagaaagaagggcagaatcagagccactctaagtgaaaatatcagcgtttagaacacaatcacccccctgcaacccctccagccaaccctcgcctagtccctgtaccctccaattcagagtccaataaccctgagttatctttctcaacacccatctcatcaagccactcccctgcttaaagctttcaatgggccgggcatggtggctcacacctttaatcccagcactttgggaggcccaggcgggcagatcatctgatgtctggagtttgagaccagcctgaccaacatggagaaaccccatctctattaaaaatacaaaattagctgggcatggtggcgcatgcctgtaatcccagctactcaggaggctgaggcaggagaatcacttgaacccgggaggaggaagttgcagtgagccaagatcgcgccattgcactccagcctgggcaacaagagtgaaactctatctcaaaatacaaaaaaaaaaaattaaaaaaataaataaagctttcaataaattcctgatgcctagcataaagtccatgctcaggcctggcatgcaaagcacttcccacaggggcatcaagcccacctcatcccttccacagacacacctgagagctcctgcaggccgtgccctactctgggaggagcctgccccctcacgactccctcctctgtgaagccagaactgcctctgttgtccccccgcttccaacgtcagcaccagctgccaagctgcttccctcctgcctacccccaccaccccatagaccagtacccaaagttagaccctgtgtcccaagcagccacagcagcaggcatgcagcaggcactcataaacattcattaggtgagcaaatgctggtcagacccaatgctgagaagagacagagtgaaacaacatgtgaaagataaggaggcacgtggggaagatggaaatgtccagtaccctccttgccactggttctaaaattgtgttgtttacattctgaaatagtcagggctcctaacgagcatctgcttatgtggcttctctattactgttttgtggggttttttctgagacagggtcctgctctgtcacccaagctgaagtgcggtggtacaatcatagctcactgcaacctcgaactcctggcttcaagccatcctgcagcctcagcctcccaaagtgctgggattacaggtgtgagccactgcatctgggctgttgctgtatttgatgttaccatgtactacaacagtgccctcttattcagtttttttttttttttttcctgagacggagtctcgctctgtggcccaggctggagtgcagtggcgtgatctcggctcactgcaagctccgcctcccgggttcacgccattctcctgcctcggcctcccgagtatctgggactacaagcgcccgccaccgcgcctggctaatttctttttgtatttttagtagagacggggtttcaccgtgttagccaggatggtctcgatctcctgacctcgtgatctgccgcctcagcctcccaaagtgctgagattacaggcgtgagccaccgtgcccggccaaaaaaattttttttaaaggctgagcacagtggctcacgcctgtagtcccagcactttgggaggctgaggtaggtggatcacttgaggtctggagttcgagaccagcctggccaacatggtgaaaccccatctctactaaaaatacaaaaaattagccaagcgtggtggcaggtgcctgtaatcccaactacttgggaggctgaagcaggagaatggctttaccccaggggagggtgtggggtggaggttgcagtgagccaagattgtgccattgcattccagcctgggcaacaagagcgaaactctgtcttaaaaaaaaaaataggctggacgcagtggctcatgcctgtaatcctagcactttgggaggccgacgcgggtggatcacctgaggtcaggagtttgagaccagcctgcccaacagggtgaaatacaaaaattagccaaatgtgttggtgcatgcctgtaatcccagctactggggaggctgaggcaggagaatcacttgaacctgggggaagcagaggttgcagtgagccaagatcacgccattgcactccagcctggacaagagcaaaactccctctcaaaaaaaaaaaacaacaacatttaaaaaaatacaaaaattagctgggcgtggtgacaggtgcctgtaatcccagctactcaggaggctgaggcagcagaatcccttgaacccaggagacggaggttgcagtaaggagagattgtgccactgcactccagcctgggtgataagagtgagactctatccgaaaaacaaaacaaaaaaagggctgggcacggtagttcacacttgcaatcccagcactctgggaggccgaggcgggcggatcacgaggtcaagagatccacaccatcctggccaacaggtgaaaccccatctctactaaaaaatatatatatacatacaaaaattagctaggtgtggtggcgcgcacctgtagtcccagctagctagaaggccgaggcaggcaaatcacttgaacccgggaggtgggggttgcagtgagcagagatcgcgccactgcactctagcctggcgacagagcgagactgtctcaaaaaaaaaaaaaagaaaagaaaagaaaaaaagaaggatagcattgctttacacttttataaatctctttaatgtctagcctaatagaagaagctggattctcatatctcctgcattcagtctgttaggatatgcggttttgattaaagtctttaaagaaatttggccttacacagaaagaaggaaggagtattttaataactttttcagaaaactgtctattcttcattgatattacactaaagctcgacaaatgagtttcttaaaagttgctatgggccaggcgcggtggctcacgcctgcaatcccagcacttcgggaggctgaggcaggtggatcacttgaggtcaggagttcaagaccagtctcgctaacgtggtgaaatcccgtctctactaaaaatacaaaaattagccaggtgtggtggcaagcgcctgtaatcccagctactcaggaggctgaagcaggagaattgcgcaactgcactccagactagcaacagagcaagactccgcttcaaggaaaaacataaataaaagttgctatgtaggccaggtacggtggctcacatctgtaatcccagcactttgggaggctgaggtgggcgatcacaaggtcaggagtttgagaccagcctgaccaacatggagatacccagtctctactaaaaatacaaaaattagccgggtgtggtggcacgtgcctataatctcagctacttgggaggctgaggcaatagaattgcttgaacccgggaagcagaggttgcagtgacccaagatcgtgccactgtactccagcctgggcaacagagactccatctcaaaaaaaaaaaaaaagttgctatgtaggctgggcacagtggctcaacacctgtaatcccaacactttaggaggtcgtggtaggaggactgcctgagcctaggagttcaagaccaggaagatcccatctctggaaaaaaaaaaaaaaaacagctgggtgtggtggcacatgactgtggtcctaactactcgggaggcttatgaaggaggatcatttgagcccagaaggtgaggctgcactgagccgtgattacatcatcactgcactccagcctaggcaactgagggagaccacatcgtcaaaaaaaattaaaaataaaaaaaaaattgtaaagcctcatgccgggcatggtggctaatacctgtaatcccagcacttcgggaggccagggcgggtggatcacctgaggtcaggagttcaagaccagcctggccaacatggcgaaacccagactttattaaaactagaaaaaattacaccaggcgcagtggctaatgcctgtaatcccagcacttcgggaggctgaggcgggcggatcacgaggtcagaagttcgagaccagcctgaccaacatggtgaaaccccatctctactaaaaatgcaaaaattagctgggcatggaggcgcatgcctgtaatcccagctactcgggaggctgaggcaggagaatcgcttgaacccaggaggcggaggttgcagtgagcgagatcgcaccactgcactccagcctgggcgacagggaaagactccgtctcaaaaaaaaaaaaaaagaaaaaattaaccaggcgtggtggcaggcgcctgtaatcccagctactcgggaggctggggtaggagaatcgcttgaacccaggaggcggaggttgcagtcagcgagatcgcaccactgcactccagcctgggcgacagggcaagactccgtctcaaaaaaaaaaaaaaaaaagaaaaaaattaaccaggcgtggtggcgggtgcctgtaatcccagctactcgggaggctgaggcacgagaatgacttgaacccaggaggtggaggttgcagtgaactgagattgcgccactgcactccagcctaggcaacagcgagactccatctcaaaaaaaaaagcctcatgcatccttcctatttcatcacacagaaaagtaaaaatatgtgtaattaaaggtctagatttaatactcagtcatctgtactgcctcccctggacatgtgtagaactggtgggtctcagcccccagtgctggctaacagtggggaacacaactctggcagtgcaagtgtccacccagggcagaggccagtgatttttttttttttttttttttttagatggagtctcgctctgtcacccaggctggagtgcagtggcaaaatcttggctcactgcaacctccgcctcccaggttcaagccattctcctgcctcagcctcctgagtagctgggactacaggcgtgcgccaccacacccagctaatttttgtatttttaggagaggcggggtttcaccatgttggccaggctgatctggaactcccaacctcaggtgatccacccgccttggcctcctaaagtgctgggattacaggcgtgggccaccgcatctgaccttgtaacttctaaatatactgaaaaaggtatcggggaccctcagggtctgcaaacaactttgagaatagctgacaagcactgcctcaaatatttctaacaactcgtttacaggcaaggagaatgaggcctggagagcttaagagactggcccacggaggaagcaggagtcatctttccacaaaactacacttccccaaaagctgaactcttggacaaggagcccactgccaaacctaagagtaacaaatttcagcaaataaaaggaagtgccatttccaatggcatcctcgaatactctaagaggcggggctggcagaatccatcaacaggcctccagaggcctgctactaagagccagcaacgctgctgaaagcggcactgcctctgcaggctgtgtgaccaggacccggcgggggccctgcacctggaagcagagggggtcggtgggggaggggtgctaccaggaagcaagatgtgcatgctgcctgctgggggcatgaagtcaaagtcccctcctgcccaaagtggctaggccagccctaggctgccttatcagcatcaacacatgcctggaatgtgggactttggcaacaaccctctcccttcggccagcacggggctgacgcctggtccctgggctctggttcacagtcagaggacaaccaccttgaagcaccagaacccgcacccccagcccatctaccagaagacaatctaccaagagtcaccgagaggagctatcctgcctgtgtccccacaccaccaagggccgtgtctgagcacctcgtttgtccacactcagagaatctcaagagctcagctctggtccctgcaatgtccagaccatcccccacatggctctcctggaggtgttcggcaaaggcacaggctgccgtggggcagaagattcccacataccagacagtaaggagctgcgtgtgactggaaggatgaggacgacccagagaatgctctctggcccctggtccttggggaggaatgggggacctgcaggggaccaccttcccactctgggagccagattccctggctttgtccagagcagccaacccactaccccactcaaaatgaacacctcagctgccctccagcccaagcactgcgcagagtaaggagtcctcactcacaaatgtgtccgaggctttcacacacttcacctggagcttcgccactcacttcttagatgtacgactctgacttctctgagccacttgtacaacgaggactgacaagatgatgaggaccacaccggtgtgttctgacaactgaaccgggcatagaatgcccactgccaggctgagcccaggaacgagcccaggatgagtgcttaccctcttcaccactaccttcctagccttctgtcagaactccgtggggaccatcctcttcccatcttctaagccaagtaccctggtacaagccagacagaaactataatagcagctgcttccataaaggggaagggccatggggtcccggacagggctggggtgaaggggcacaagacctagggcaggaatccacccccagatcactcactcaggacaggaccacctggacccagctaccaagatgtgcaccacccccttccttctgagccccttttcccatctcctctactgcccctggccaggttgctgtcccacctctaagaggcaagatttcctacccaggatgctgaccaaaaccacacccaggggcctacccgtcccctcacatgataggctgctcctagctggcaggagccgtcttatagcctctctccctcaaatacaaacaaaaccccagaacaacctattgttctgttccagcaaagggggccaggcccagccaggccctacctgaagctctctgtctcccgtcccccttcagtcccctcccactcgtccttctctgcccctattagtggcctcatataccttgtccagataacacagcccaagaaaccaacctcagggacaaatctcttctcttccagggagaagaagacagaggtcccaggagtcccaggggcccccattactggccacctccgctcaacccaaactgcactatgtgaggtcccgccagactacatacaggccaacgagagcccaagaatgcagccaggaaaccaggccaggcagactccaaaagcccgtgctacggggtcagtaggacccgcctacagctgagggctataggcagctctccagaggacctcccaggagaagccaacagtgcacatgggctaggttcctcctgctgttcaccctctgtgcccagtaactacccaggaacaggcatgactgactctgccaactcattcactgggtaaccgctgaccccaccaggccctcggagtaaagcagttagtgagaaccgcaggtaaaagcgcgggctactcatccctccgcctgtggattctattatcaacaaagatgcatcacctgctagaagagcggttctcaaacttggctgcacatcaggttcacttcaaaagcttcaggaaaagctagtgccttgggcccaccccagagacaggtatagctcaaggtgagaaccagagcaccagcaggcaggcctctgccaggcagcatgggcaacgtgtgctgggtgaatgtgcggcctgcactcatcacccagaagagccccactgtgtccacacaaggacaggccaccgaagtcccagtccccactctcccttctcacttactttgtgaatgagagctcaccaacagtttaccgtcttccgagtgctgcggcctcaccgcccgacccgcagcaggggtgagggcttgcaaaggccatgcaacagatcctccccctcaaaggggctcaggcctcagtgtggtaatgggagcggccccttcccacacttgtcagagaacccacccacccggtggaatgaagccgaagcccaagccgcagggcaacagcccgggacggcaggggacaagtctgtacagcagccacacccctgccagagccaggagctcttccatttccacagcaggccaactctcacctggaagcacccacctaaccaaacccaatccctgccttcttttagtcacactgggaactgccacaggaaggctggggactccacatactccctcctcaccacaccccatgtgtgatcacccttaaacagaaaacatgcacctaagatcctacgatgcgctgcccacctcacaaaaaaccggtgcctctaggtaagagcacctagctgacccatccctgttccctctcaccattagaaggacccccaagtccccctgttctaacaccgaggctgcactcccactctccacccactaacattaccataaaaaataaattgaatagttagaaggaggggctccccaaagcctggccaccttcccgagggtcccaagcagtttcttggagtccctctccccactcagtcccgccacacccctctcaggcagtctggcccttccctcctgaactttggcgggctggaaccagctcccagcctctcctcccttatcaagctcactgggggcccacacagagctcccatccccaccagcttttctcgctttgccactcccagctaaaactgggctcaaggcaagcaagcctgcagtccctcagtccctcggggcccagcccctcctcagagccctcccccagcccaggtccctaacccttagggcaaggcccctcccagcaggaagcgaaccctggcggtgccaggcagagtcaaactggaagggctggttcagaagcccctaaatgggagccaggacctctcttagggagggggctttcagccccatcctccctagtgcgatctcagatctctccagacaccacactatatgggcctccacaggcggtggagtcaaaggcatttaccctccagcccccagcaagctacttaacttccaaaagcagctccttccctcctccagaggagaacgggccgcgtgctgaactgcaagcgcctctatcaccccgcccaggcaagtctgtgagcaccagaaagcaggggccaacatgacttggtctaaaccaagggggccaggcactgactttgcgctcagaaaatgtggcggaatgaataaaaagcttgaaaaagagccgcatacatgcctggctggcagtggggtctcccaagcgggcttcacagctcacacagtacccgtgggtccgcgtcctcagtgctctccagctgtctccactgccaccctctaccctaccactgccttttaaaacccagtagcagtcacttcctggttaaaacccctcccctccaggccaaccccaacccacatggcatccagggttctcagccagcccacggccggctcctcccacgccaccgctatgccctctgcgctccgctagatgccagcccttatcaccccatcttataatcatttgttgagtgtctgccttccctaggctgagctccagaaaacagcgatacatgaatgtaaactccagttctgttcccattgtagaaacgaggcaggagagtcaatcactgctcaaggtcatgacgggagtaaatggcagagccagcaatgcactacagactttgcgaccgaccaagtccagttcccctctcactgccccacaggggtccgtcctaggccaggctcggaggagacaagaagggaggaacccaatgtgttctttcttcccgcggtgaaagctgcctcccaggccagcaagagcagcccagaagaagtgccccactctcccagggatcaggtactgggggcagcgggcaggacaaggtatggggtggggctgactgctccaggccaacagaccaagcaataaggttggaaccacaagtcccctgggtaaactgaactttattccttcctcacggctctcactctccagaactgccccgccagctcttctccaggggctggctgctgattaaatggcacttccccacccctcagatctgaccccgcaaacaataaggacttgaggggaggcggcaggctatcagctcaataatgcaaaaccctgttgctcctcgtccacaacagctgacttcaagtggatgggaggctgcgcttattaacaaaatgagaaatctgatctacggaaagaaaacactacgtgaggattaatccgcgactgcagcttgtggagaaggctgggctgctggccaagaccaaggatcgaggatgggatcgtgcctacctgtccccagagcaggtatcatgcagcacaacaggactcatcacccctgccccacctgcgccttctcttctccttccagcaacttcgacaatcatttcggttttgctttaattaaaggcctgactccctcgggctgcttcttcctctacacagaggcagcaaccagagggagatttttcttttcaggaatcggtcgtaaaaactcagtgactaatctacaagttccaacaactggcagaaaaacaccgcagggagaggttgctgggcacacagcagcactcagagccaactgaccagagaagctgggccacaggcactctactacaacctccctcccccagcccgacactggcctgccgacccacctgagagctctgacctcccaaggcaggcagctggggagcctcttcccagccttccaagtctactgctcgtcctgtgggacccagagatcttcacagtctcaatggcacaagacggaacgttcacttccaggcaacaatcctgggccacaggactcagttcagcccccaagtatcagactcccggccctgttcttggtgttcagagcccactaaaccagcagtcttgccacacagctttgtctccagaggccagctcatctgctttttttcacactactccagcaaccctgctccaccaagcacgcacactctccttgacacagggctccagaccaaccacatggcctgtgctcctgaaaatgcctgcctgaaggcccagggagtccagacactggcagatgagaatggacgaaaagaagccaagccagaagccaggaagcaataaatgctagacccagaaaggccttaggtttgagtgacccagctccatccctccatcctggatccttggaggacagccccaagttcagcctaggagctcccaaggcccctccactacctgccagctctccgacagcacaagagacacagcaatcccacatcagtcaacaacccaccgccacaggattcctaggggcaaggctctgcccctccccccagcacatatgtcagaggggtggcttccctgggttacacccctcctgctgttgggggagtggggggtcggggaacacagctttccagatgtgcttggcaactcctactagaaaagactaggggtgcgggggacaggagaagacatggataaataactttaacaccgctccaacccatccggctcagcactgggctcccttacacaggcagtcccaggcagttctgggtggggccgttgggagcattatctggcctcattccctcctctcagcaagtcactgccccccagggagaggcattcccccccccccccaaccacgcacacacccaggcctgtgtgaatatgaaccatcttggaagataaacagagagtgacaagctggggcccctcagccccctccctcagccagccggtcccttccccctgaaagccgaccccctcccccaagcccatctctcttcctgccaagcggctgcctacaggagaggtctgggggcagggcagcgagcccaccagccgcagagcccggccctctgggagcggcccctccaggcccgcccctgcccctgccgtggccagtcttcccgcggggaggaggcaagaggagaggagaccgcagacggtgcaggaccgcagtcctggaaatcgcaaaatcctctagcgagggggcggccgcgggcgcagggccgtttgcataatgggagccctcccgcctgtcaggcagcgcagctcgcccgacgctgttcggattagattgctaatgaaaaggcacaaagagccggcgcccgctcgcccgccgacccccgctccgcagacccgcgccgcctgggcctggcgcggcccggtgggctttgtgccccgggtgccccaccgcccgcgcccctccgggcatctggcccacaaagcccgggcctgccaggggtcccgcgtgcgccccagcccaggcccgccagacgctagcgcgtcccccacgcgcgcagtcccacgtcgcccgggcgcgcgcgcgtccacgcccctctccccggggacgcgcccagcccgcggccccggcccccgcccgctccccgcgacccccgccccccaaggccgcccctcacctcgtgtgcgtcggcggcggcgctccgcccgccggccggccggccctaccagcggcccttgtcctcagcgcccggctcgcgccgcacgcgcccgccccgtccgcctgccgccagcccggctcggctccccgcctagcgcgccccgagcgccgctcacagccgcccgcccagcgccatcttggaagcttgtgacgtcggcgccgcccgctcacccctgacccacatctgaatgggcgagcggcggggcggggacagggggcagctgggggcgtggcctgtgaacaggggcggggcctcgggggcggggccgggccggacagcggtcccagcactaggcgggcgggctgccggggtccggcgccgtggggaaggggtgcgcgggaggagacggggacccagaccccggacatctaaccggactccgacctcaagcgccagggcaggaccgcgacctcgcccctgaaatacccgaaccgcataccggcccccgggacagggaccctggccccccccgacaggctgacgcccaccccctcaaactctggtggacttacccccttttagccctaccctgacccctaggagccccgaattagggacctctatcggcctacgcgccccctccccgacccctttgcgacccctgctcgacgctccctgcggttgcccgaggctcaaaggcgcagccagcagtgactgcaagctcgggggtctgggctcctggggaagcccgggctggttgggtgcaaaagagaaggggcgcccctcccgtgaccccagcgcccctcgggcccccgcgggcgcacccccgcgaaccctacctgctccgagggcgcggaggacccagcacgctgcgctcagccagccccttccggtggccgcagcccctcgcaggccccaggggtcaagcgcctgcccgagccggcccaccaggacccgggctcccggccgccatgcagatagccttcccaggggctgggctggcctgagccgccactgcttctctagggagctagttaatggacctctctctactttgaacaccaaacaaaggaacacaccgctatcgaggtcgcccaagtccaagaggagcccaggtctgccttacagggaagttgtgccccagctccagtcaagatcaaaaaccagtttcaataacccttcgccaagctgatgatgcaacctttctttcctaatggatgtataggtttaatgtcatcctaacaacatttcttagacttcacaaaattctaagttcacctggaaaaataaatagccgaaaacagctatggttttccccccttgggaacaaaagcaggcatgagggtagacttgccctaacagatatcaaaacaaattgtaaagctaccgcaggcatttcagtgtggtacagaacaggaaatagaatagaaagcctagaaacatcctagaaatggtaagaacacaatagatgaaaaaggaaatatcaaacatctgtggaaaaaaaagagctatcaaacatccctgaagaagaacaagaatattccacaaatagagcctagcagaggactcactatttgaaggaacgactgaaaaaaaaagtcaaccattctactaacccaagacatataaattaaaactataggccgggcgcggtggctcacgcctgtaatcccagcactttgggaggccaaggcgggcggatcacgaggtcaggagatcgagaccatcctggctaacacggtgacaccccgtctgtactaaaaatacaaaaaattagccaggcgaggtggcgggcgcttgtagtcccagctactcgggaggctgaggcaggagaatggcgtgaaccccggggggcggagcctgcagtgagccgagatcgtgccactgcactccaacctgcgcgacagcgagactccgtctcaaaaaaataaataaataaataaaataaaactataagaagctgggttttctcctaaacaaattaaaaatcagtttcaagtgataaccttcaaacacaaggtctgataggtaatcactctcatatacttttggaagcacataaatcacctcaaaattcctggacatgagtttggcggtatgagccaaaagttgtttttttggggttcttttgtctttttttgttttttggagactcggagtctcactctgttgcccaggctggagtgtagcctcaaactcctgggatcaagtgatcctcctgccttccaaagtgctgggattacaggcataagccaacgcacctggccccaaaaatattttaaaataattataccctctcagaccagtattccaggattctgttctggggaaattagccacgtttgcagaccacgtacttattatctgtctctctacccataagtaagtttgtacctgtaagtttggaacccatgcctaggagcacacctgagacaacaggcattccacggtcccttgtttcatctgcatttgaaaactaatgtggctggctcatgcctgtaatcccaacactttgggaggccaaggccggcagatcgcctgaggtcaggactttgagaccaccctggccaacatggtgaaaccccgtctctactaaaaatacaaaaattagccggatatcgcggtgcatgcctgtagtcccaattactcgggaggctgagacaggagaattgcttgaatctgggaggctgaggttgcagtgagctgagatcatgccatgacactccagcctgggcaacagagggagactcggtctcaaaaaacaacaaaaaagataactaatatatgataatattttttaagtgtcatgtataatagtgaaagaaagcatatacaggcggtggctcacgcctgtaatcccagcactttgggaggctgaggcgggaggatcacctgaggtcaggagtttgagaccagcctggccaacatggtaaaaccccgtttctactgaaaatacaaaattagctgggcatggtggcgtatgcctgtaatcccagctacttgggaggctgaggcaggagaattgcttgaactccagaggcggaggttgcagtgagctgagatcctgccattgcactccagcctgggcaacagagcaagactccgtatcaaaaaaaaaaaagaaaaaagcatatacaaatttctcacaatggggttaaatagtccacataatggaatgtagattaggccaggagtagtggctcatgcctgtaatcccaacactttgggaggccgaggcgggcagatcacctgaggtcgggagttcgagaccagcctgaccattatggtgaaaccccgtccctactaaaaatacgaaaagttagctgggcgtgattgcgcatgcctgtaatcccagctactcgggaggctgaggtaggagacttgcttgaacccgggaggcggagattgcggtgagctgagatcgcaccattgcactccagcctgggcaacaaaagtgaaactccgtctcaaaaaaaaaattagccaagcatggtgtcacatgcctgtagtcccagccactcagcaggctgaggcgcagcacgagagttgcttgaacctgggaggcagaggttgcagtgagccgaggtggtgccactgcactccagcctgggcgacagagtgggactccattttaaaaaaataaataggccaggcgcggtggctcacgcctgtaatcccagcactttgggaggcccaggcaggtggatcacgaggtgaggagttcaacaccagcctggccaagatggtgaaaccccgtctctactaaaaatacaaaaattagccaggcatggtgacgggcacctgtaatcccagctattcgggaggctgaggcagagaatcgcttgaactcaggaggcggaggttgcagtgagcccagatcacaccactgcactccagtctgggcgacagagtgagactcggtctcagaaaataaataaattaataaataaataaattaaattagtaggatgggcacggtggctcactcctgtaatcccagcactttgggaggccgaggcgggtagatcacccaaggtcagaagtttgagaccagcctggccaacatggtaaaagcccgtctctactaaaaatacaagattagccaggcatggtgacgtatgcctgtaatcccagctacttgggaggctgaggcaggagaattgcttgagctccagaggcggaggttgcagtgagctgagatcctgccattgcactccagcctgggtgacaagagtgaaactccgtctccaataataataataataataataataaagtaaatttttaattaaaaaataaaatttttatttatttatttattgagacagagtctcactctgtcatccaggctggagtgcagtggcatcatctcagcttgctgcaacctctgcctcccaggttcaagcaattctctgcctcagcctcctgagtagctgggattacaggcgcccaccaccacacccagctaatttttgtatttctagtacagacggggtttcaccatcttggcaaggctggtctggacctcttgacctcatgatctacccgcgttggcctcccaaagtgctgggattacaggcgtgagccactgcgcccagccaaaaataatttaaaaaaaaaaaaaaaagaagaggccaggtgcagtggctcacgcctgtaatcccagcactttggaagactgaggcaggaggatcacttgaggtcaggagttcgataccagcctggccaacatggtgaaaccccatctctactaaaaatacacacaaaaatattagccaggcatggtggcacacccctgtagtcccagctactcgggggactgaggcaggaggatcacttgaacccaggaggtggacgtttcagtgaaccaaaatcacaccactgcacactccagcctggtcaacagagctagaccctgtcttaaaaaaaattgtattttttgtacaaaaaaattagccgggcctggtggcagatgcctgtagtcccagctactcaggaggctgaggcaggagaatggcgtgaaaacctgggaggcggagcttgcagtgagccaagattacgccactgcactccagcctgggcgacagagcgagattccgcctcaaaaaaaaatttttttttaattgcattttttaaatgcatgcaaaaatattgatatatggaaaagcaactgaagaaaataaatcaaaaatatttacggaggttctctctggaagttgggaattttttttctacacatgtatactttagcgtgtgtgttatttttattttatgaaagtaacatttctaatcggaacaattctagagatgctgaagcacattttatttttattttattatttatttttgagacagagtctagctctgttgcccaggctggagcacagtggcgtgattatggcccactgcagcctccacttcctaggctcaagtgattctcccagctgggactacaggcatgcaccaccacacccggctaattttttattttctgtagagacagggtctcactatgcttcccaggctgaactcaaactcccagactcaagcaattctcccacctcagcctcccaaagtgctgggattacaagcatgagacaccatgcccggtaattttttttttttttttgtgcagatggagtctcgcgctgtcacccaggctggagtgcagaggcgcgatctccgttcattgcaacctccgactcccgggttcaagcgattctcctgcctcggcctcccaagtagctgggattacaagtgagcaccgccacaccaagctaatttttgtagttttagtagagatggggtttcaccatgttgccagggttgtctcgatctattgacctcgtgatctgcccacctcggcctcccaaagtgctgggattaccggcgtgggccaccgtgcccagcccatgcccagcaattttttaaagttaaattctccctcctcctccaccctaatcagtcctttctgaagtaacattaacagtttaactctcttctctgacatcaatatgtatctactcaccttacaaaaaagatcctactattttgaaatcatagacatttttctagttcatttccataattcattcttttttttttttttcatgtcagacgggtaatgtgcctatgtcgtaacaagatttgaaggtggcggccgggcgcggtggctcacgcctgtaatcgcagcactttgggaggccaaggcgggcggatcacgagttcaggagattgagaccatcctggctaacacagcgaaaccccatctctactgaaaatacaaaaaaattagccgggcgtggtggcgggtgcctgtagtcccagctactcaggaggctgaggcaggagaatggcatgaacccgggaggcggagcttgcagtgagccaagatcgcgccactgcactccagcctgggtgacggagcaagactccctcttaaaaaaaaaaaaaaaaatatttgaaggtggcacatcttacatgggaacgtgtgtgaacacataatcatcatgcttatgaactacaaaaggatcataattcattctttaagagctgacaaatgttccagagtatggagcttctgtaatttattcacacttcgttaaccatggttgttcagtttatttacagtgtggtgctttttgttttcttttttctttgttctttttttttttttttttttttgagatggagtcttgctcctgtcacccaggctagagcgcaatggcacaatctttgctcactgcaacctccacctcccgggttcaagcaattctcctgcctcggcctcctaagtagctgggattacaggtatctgccaccatgcctggctaatttttgtatttttcgtagagacggggtttcaccatgttggccaggctggtcttgaactcctgacctcaagtgatccacccgcctcagcctccctaaatgctgggattacaggtgtgagccaccgcacccagcctacactgtggtgctattaaaaaatatttttaggctgggcacagtggctcacacctctaatcccagcactttgggaggccgaggcaggtggatcacttgaggccaggagtttgagaccagcctggtgatcatgaagaaaccctgtctctactaaaatattagccaggcatggtgtcacatacggataatcccagctactcgggagtctgaggtgggagaatcacttgaactagggaggcagacgttgcagtgagttgagatcatgccactgcaccccaggctggacaacagagcgagacctcgtcttaaagtaattaattaattaattaattaattaattaatataaataaaatagcagatttcaaaaatttgttctccctggcagcaacccagtaaagctagatctgggcggaaggtaatatggaaatataaaaactacagattagcagggatgggaagacccgccagaaatgggttcattttgtgtcctcactccctccggattctctgtgtgtctagtccaagatctaaccactatgatctgctttcctcatccatttgggaatcagggcaccacccccttgggaggcttgaatgacatgaggttgagcaggcagagcacggaactcaggctctggtgagccctggtacagtgactatgattgttgtgtcatgtaggaagggtctgttattttaccattatctgttttcaataaaaaacagaaagaaaacaaatatacaaaatacccccaaacagtaaatttcagcttcttactatgacagctagatttagcatttaacagtatgcccaaatttgaatttcggataaacaaccaataatgcttaatataagtatgtcccggccgggcgcggtggctcacgcctgtaatcccagccctttgggaggccgaggcgggcggatcacgaggtcaggagatcaagaccatcctggctaacacggtgaaaccccgtctctactaaaaatacaaaaaattagccgggcgcggtggcgggcgcctgtagtcccagctactcgggaggctgaggcaggagaatggcgtgaaccccaggaggcggagcctgcagtgagctgagatcgtgccactgcactccagcctgggtgacagcgagactccgtctcaaaaaaaaaaaaaaaagtatgtcccatacaatatcacttctcaccttcccatatcccaagctcaagacaccttatatacgccatgatttctcctgccatctctgggcattcacaccagggctcctcctgtccaggccagccttctcccttctcccacctgtgcctggtgaacaactcagttcagacatcatctcttgtaggaagtctcctgtgatcccaggctaatcaccctgatacagtcctgaaatactgctgagcagttggcatgagggcaggaaggcttggtcttgttcactcttgtatccagcttatacatggcacaaagtaggttctcaattaaaagtcaaatgaggggccaggtgcagtggctcacgcctgtaatcccagcactttaggaggccaaggcgggtagatcacctgaggttgggagttcgagaccagcctggccagcatggtgaaaccccatctctactaaaagtacaaaaattagccagacgtggtggcaggcacctgtaattccagctactcgggaagctgaggcaggagaatcacttgaacccgggagggagaggttgcagtgagccaagattgcgccattgcactccagcctgggcaacagagcaagactccatctcaaaaaaaaaaaaaaagtcaaatgaagtcgggcacagtggttcgcgcctgtaatcccagcactttgggagactgaggcaggaggatcacctgaggtcaggagttcgagaccagcctggccagcatatgaaatcctgtctccactaaaaatacaaaaaaaaaaaaaaaaaaaatagctgggtgtggtaatgcacgcctgtaatcccagctatttgggaagccgaggcaggagaattgcttgaacccgggacacagaggtaacagtgaggtgagatcatgcaactgcactccagcctgggctacagagcaagactctgtctcaaaaaaaaaaaaaaaaagtcaaatgagaccactcatggtagctggcgcctataatcccagcactctgggaagccaaggcgggaggattgcttgagtccaggagtttgataccagcctgggcaaaacagtgacatctcatctctacaaaaaatttttaaaattagccgggcatggtggcactcgtctatagtactagctacttgggaggctgaggtgggaggattgcttgagcccaagaattcgaggttgcagtgagctatacttgcgccattgtactatagctgggcaacagccagacgcggcctcaaaaaaaaaaaaattttagccgggcttggtggcatgtacctatagtcccagctactcagaagctaagacaggaggatcatttgagcccaggaatttgacgctgcagtaagccaaggtcacaccactgcactcccgcctgggagactgagtgagaccctgagtctaaaacaaataataataaaaacgaaaatgaaagtcaaatgaatgaggccaggggtggtggctcatgcctgtaatcctagcactttggaaggctgaggtgggtgggtcagctgagccctggagttacagaccagcctgggcaacatggcgaaaccctgtctctacaaatacaaaaaagaaaaaagccaggcccatggtggtgagtgcttgaagtcccagctactcaggagggtgaggtgggagaatagcttgagctcaggaggtcaaggctgcagtgagctgagattgcatcactgcagcctagccatgatgacagggcaagacccagtagaaaaccaaggttagagaggttaagtcacctgcccaaggtccgtagctaacctcagactccagcccctcagactgacatgagctcagttcaccctcttaggaacaccatctgaagaatgcatccccagcaagcctattccctatagcaaaggccaggcctgtgatgggtgccccgctcctcaccacacacctccctgtcaagtcaccactccttcacccctagcagagccaggcaccttgagcccaagggaggccactcatggaactgtcattcaaccaacagatgctgacagcaatgatgaggtgggcactgggctagtgaacagcacagatgtgttccctggcctcagaagcccacagactaaggagaagacgacagaatactcacaagggtgctggggctgggcaaaaaggtgcaggctgctttgtctggtcataagaggggaactgacttccctggtctgaggagccaaggaaggggccgtgcccttgccatgccctctgcctgccatgccttgctgttcttcagtgcctgctctaaggtcactcctagtgtggttttctctggctgctctttttttttttttttttttttgagacagagtctcgctttgtcacccaggctggagtgcagtggcaccatcttggctcacagcaacctccgcctcctgagttcaagtaattctcctgtctcagcctcctgagtagctgggactacaggtgtgcaccactacgcccagctaatttgtgtatttttagtagagacggggtttcaccatattggttggccaggatggtctcaatctcttgacctccagatcaactccccttggcctcccaaagtgctgggattacaggcgtgagccaccgcgcccggccactttttttttggagtctcgctctgtcccccaggctggagtgcagtggcgcgatttcggctgactgccagctccgcctcccgggttcacgccattctcccacctcagcctcccgagtagctgggactacaggcgcccgccaccacgcctggctaattttttgtatttttagtagagacggggtttcaccctgttagccaggatggtcttgatctcctgaccttgtgatccgcccgcctcggccttccaaagtgctgggattacaggcttgagccaccacgcctggcctctttttcttttttgttgagacagattctcactctgtcgcccccaggctggagtgcaatggcgcaatcttggctcattgcaaccttggcctcctgggttcaagcaattctctgcctcaagcctcccgagtagctgagattacaggcgcccaccaccacacccggctcatttttgtgtttttagtagagacagggtttcaccatcttggccagactggtcttaaactcctgacttcgtgatctaccagcctcggcctcccaaagcgctgggattacaggcttgagccaccgcacctggccatgctctttcttttttatttgtatttttatctgtttcttagagacagggtctcactctgtcatccaggctggagtgcagtagtgtaatcataacccactgcagcctcaaactcatgggctcaagggatcctcctgcctcagtctcccaagcagctgggactacaggtgtgcaccactatgcccagctattttttttttttttgagacagagtctcgctctgtcgcccaggctggagtgcagtggtgccatctcggctcactgcaacctctgcctcctgggttcaagtgattctctgcctcaacctcctcagtagctggattacaggtacctaccaccatgccaagctaatttttgtatttttttttttttttgagatggagtcttgctctgtcacccaggctggagtgcagtggcgcaatctcggctcactgcaagctccacctctcaggttcacgccattctcctgcctcagcctcccgagtagctgggactacaggtgtccgccaccatgcccggctaatattttgtatttttagtagagacggggtttcaccgtgttagccaggatggtctcaatctcctgacctcgtgatccgctggcctcggcctcccaaagtgctgagattacaggcgtgagccaccgtgctcggcctaatttttgtattttcagtagagacacggtttcaccatcttggccaggccggtcctgaactcttgacctcatgatccaccggcctcggcctcccaaagtgttggggttatagacgtgagccaccgtgtctggcctggctccactttcttagggagctttgcttgccctctgcttggggtagtttgtgaattcagtgctctctctctcccaggtcctgggtctcctgctcctgatcaatctgccacgtgccatttgatctcagagttgtctccaccattagactggcagggtctgtcttctggggtctgtgtgtaggatacagtggccccaggatgggtaaaggaggggacccagttgttcttctgtgataggtggagacaagggccagcagggctgtttctcggtgaaacccatggggagatagtcgaaccaggaaccaaatccggccgggcgcggtggctcacgcctgtaatcccagcactttaggaggccgaggtgggcggatcacctgagttcgggagttggagaccagcctgaccaatatggtgaaaccccatctctactaaaaaaaaatatatacatatatatacaaaattagcctggcgtggtggcacatgcctgtaatcccagctactcgggaggctgaggcaagagaatcacttgaaactgggaggcagaggttgcggtgagccaagatcgcaccattacactccagcctgggtgacagagactcagtctccaaaaaaaaaagtccaaaaattaaaaaaaaaaaaaatgccgaactcagtggctcacgcctatgatcctaccactttcagaggccgaggcgggcacggtggcgcgtacctgtaatcccagctactccggaggctgaggcagaagaatcacttgaacccgggaggcagaggttgcagtgcgctgagatcgtgccactacactccagtgtggtgacagagcgagacttggtctcaaaaaaaaaaaaaagtcctggctgtgccactaggccagacgccctagaactgacttctatggacctcagttttcatacctgtgaaatggaactcagagccatatctacttcattgggttgtgtgaatgtgaggtagttacaggatggagcaggcagaaggtcagcacagcctcagtggttggaggagtgggggtcaagtggacagagagggtaccccagggccagaggtagaggcaaggtgaagcaatgcttcatttccctgctgaggttcctctctagcagtttggaggtggggcaggagtggagaaaacacatcccctcctcaatatgggctgaggaacagggttcttgaggcaccaagaacctctttggggctctggcttgcctcctgtagtgaaagggatgggctgtgtgcaatgaactcacacctgtaatcccaacactttgggagacagagtcaggaggtccagaacagcctaggcaacatagcaagaccttgtttctacaaaaaactttttaaaaaattagccaggcgtggtggtggcacctgtagtcccagctacttgggaggctgaggtgggaggattgcttgagcctggagaggttgaggctgaagtgagctatgatagcaccactgtactccaacctgggcaacagagtgaaaccctgtgtctaaaataaaaagagggcctggcgtggtggctcacgcctgtaatcccagcactttaggaggccgaggcaggcagatcactcgaggtcaggagttcgagaccagcctggccaacatggtgaaactctgtctctacagaagtacaaaaattagtcgggcgtggtggcaggcgcctgtaatcccagctgcttgggaggctgacctgggagaatctctcgaacctgggaggcagaggttgcagtgagctgagatcacaccattgcactgcagcctgggcaacaagagcgaaactccgtctcaaaaaaaaaaacaaacaaataataaaataataataataataataataataataataataataataaagagggtgggagtggaccaaggcctaatggcatggaatttgcaaactttatcttcctagttttctctggggagccttcctccatcaccagggcccagcagggcctcagatggcggggggtggggcgggggctacacatatccctcatggccaagatgctaggaagcccctgagctggggcaacagcctctggtcacagtcatgagggaggctgggtgcagtagcgcttatcttgcctgaccttgtggagactgaccactccctccttctggaaaacgttgccccctgccctctccaaggcctcctccttcttacatcccctggtcctggctagggcctcagcacccaattctactccttgacccaccaccctgtggtgcttttgccgggccccagcccacagccatctgccaaacacctccccctggagtccctgcggcgtctctgactcagcaggtctgtgcctgcccctgctgttccccccacccagtggctctgcagagcaccctgttgcccaagccctgagtactggccactcccagggcctcgccttcccccaccaccagcaccaccaatttgaattcctatctctccctctggcctcctccctagacccaggccctgccccagggtgggggaaggaatcctacagataagggcattggtcaaagggacacacctgggttcgggcccccagctctgcccccaacctgctaaatgaccacacccctctccaaatctgagttattccctatgtaaaagggggaaataattaaactagctgggtatgctgtgctgagcaatatgtgagctcaggaaaggtcagttttccaggggaagtatggccgctgagagcctcagtctagtgcttctcattcacgagctggttggtgcctttcctaagttggaaatgggttagtccacaaatcccgttgcctggtccatgccaggtccaggtacctgcattcagggtgcagggtggagtaagacagtctgaagggtgaggtagcaggatgaatgagtaattcctgggtgcgttttgggattatgcctaagggctgtccgagcacgtgggaggggtagctaaatcctgtaagggaggggagaatggggaaggctgcctgcaagaggtggtggagggtgctttcaaaggatacctgggagtgagctggctgtaggcacagggcagctggaaggccaattttagggaagaggaaattgaggctgaaagtcaaaaaacaaaggaactgcctgaggtctctcaactgagaagtgagtgggccagggttcacattcagcccccactccattctcaggctgggcaggaaggtactttgccctcaggagggcaccttcgacccaaagcaccctgaccaagaggctgtgcaccgtggcaaccctaagactgaggcccaggtcctggagttccaccaaggtaggtacaaccagccaggccgtcagtgacaggaggatttactggggcttctagggaccccgtgaaagggcaaaaagacggcacagaagcctgtggatatcagatatagatagtgagggctagggctttatggggagggtggatgggccctgtgggcgggggatgtttaggagatcttccaaacagagcattccagcctgggggaacaacccattatagaccccacccagcaccgaagacagggacaggtggggctgagcctggaggctggcaggacctgtgcggccggctgcggtgtcagcaatgccaccgtgtgtggaaccctctgtgcctaggttcctggagccagctccacctggcaatgtgctttgtttcacaagactagagttggcccatcttgttccgcctcagatggaacacctgacctcctgcacaccccacccagcctccaaattcaaccaccccagtagtgagacagggagagtagggtgtgaccagaaggtggaatgagcttaaaataggctgcagagatatctctgagcttttaaaaagtcgtatctttcatatcgtgttcttgtgaaatcttctccagattttttacaatgactctgaaattgatcagttagcctcatgctttcaaaatccatagccgcagtgagcgagagggggcaggtcagctagaggtggagggggcagatgggccagaggcgcctgggcaggggtggatggggcctggacaggcttagtgacccttgcaccagaactctccggacaccgccccttcgcccactcgttaggctcctctgccttcgggccggctgggctgcccatcccccctcgttcccctcctgggcaggtctggactggacaggttttgggcctccaggtcgtgcagtcagtcagggaaggggcctggtgcaggccacagccaggcatccacctccttcccagcccacccctaccccccagcagcctgccaacttgctagacctgtgcggccttcccttctgctgaaagtctccagattctcagggctctgcacggggagccaagctggggcttagaactgtgctcccttgcccccacccccgacctgtgccctcatcagctttctttttttttcttttttctttttttttttgagacacagtctcgctctgtcgcccaggctggagtgcagtggtgcgatctcagctcactgcaacctctgcttcccgggttcaagcaattctcctgcctcagcctcctgagtagctgggagtataggtgcgtgccaccacaccccgctaattttttgtatttttagtagagacggggtttcaccgtgttggccaggatggtctccatctcctgacttggtgatccacccgcctcggcctcccaaagtgccgggattacaggcgtgagccaccgcgcccggcctattttaaattttttttgtagagacagagtctcaccatgttgcctaggcttgtctcgaactcctggtcgcaagtgatcctcccctctctgcctccgccgtagctgggattgcaggcacaagccatgacgccccccttctcatcagctgtctgggtctttctcggggtcctgacaccaggccaagtgttctgcacacctgacctgctcaaaacaaaaccagttctgccacagtctgggaaaatgaggctcagagaggccttgcagctgtctgtgagcaggctggcatttggatccagtgactgggttctggagcccagtggctctgtggccctgcctctccagccttatgcttctttaaaactgcccatggcctctgaagttgaggatttaggggagcagggctgccagaggggtgaagaaggagatctttctgtgggtgggtgtcagaatgaccaggcctgacactggtccctgctcccctggaaggacagcccctctcggttatgtggggggtgggctgcctagggtgctctggggagaagggagggagagaatggggctggtcgggtggggtgtggattccaggcctgcttggtcaaaaagatacagtatttcctattcccccttacactgggcaggcaggtgtggcccaggcagctctgccaggtgtgcagcccctggagaatgaccctaaagtgcacctaggctgccccctggcggcagcatgaggtcctcctccctggacttgtaaccctcccagggggaggaggtccacaccagctgatgggttggcacctgtccccagtccctttcttctttcctgtgccactgctcccagagttgcccaaaacacacgatcaggtgcagtggcttgaacgaaaccctgtctctacggaaaatacaaaaattagccaggcatgttggctcatgcctacagtcccagctacttgggaggtttaggtgggaggatcgacagcccaggaagtcaaggccgcagtgagcagtgagctgtggttgcgccactgtactccatactgtagcctgggtgacagagtgagaccttgtcttttttttttttttttttttgagacggagtctcactgtgtcatccaggctggagtgcagtggcgcgatcggctcactgcaagctccgcctcccggattcatgctattctcctgcctcagcctcccgagtagctgggactataggcgcccctcagcctcctgagtagctgggactacaggcgcccgctaccacgcctggctaatttttttgtatttttagtagagacggggtttcactgtgttagccaggatggtctcgatctgctgacctcgtgatccacccgcctcggcttcccaaagtgctaggattacaggcgtgagccactgagcctggccgagaccttgtcttaattaaaaaaaaaaaaaaaaagataaaaacctaggtaacatgctggggggtgatgagggttatggaggaaaataaaacaggtgggggctggagtgaagagtgggggtgcccctcataactctgacaaagactacaacgcagctgtcagaaaaaaagctgatttgaggcaatggtcagggaaagttgtgaaattaagtaaaaagtgatggaacaggctaggtgggaagtggtggctcacaccaataatccaagtgctttgaaaggccaagcaggaggatctcttgaggccaggtgtttgagatcagcctgggcaacatagcaagaccctgtctttacaaaaaatgtaaaaattagctggaggctaggctcagtggctcatgcctgtagggaggccaaggtaggtgaattgcttgagcccaggaatttgagaccagcttgggcaacatggcaaaattccatctgtacaaaaaaattgccaggcatggtggctcatgcctgtaatcctaacacttagggaggccaaagtgggcagattacccgaggtcaggagtttgagaccaccctggccaacatggtgaaacctcgtctctactaaaaatacaaaaattagctgggcgtggtggcgcatgcctgtaatcccagctactcgggaggctgaagcaagagaattgcttgagcctgggagacagaggttgcagtgagcctagatcgtgctactgcactccagcctgtgtgacagagcaagactatgtttcaaaaaaaaaagaaaaattagctaggtgtggtgacatgcacctgtagtcccagttactcaggaggctgaggtgagaggatcacttgagcccaggaagttgaggctatgatcgtgctactgcattccagcctgggtgacagccagattctgtctcaaaaatcaaaacacaacagggcacagtggctcactttggccttccaaagtgctgggattacaggtctgcaccaccatgcctggcctgagagtgcatgaattaaagtttctattctcttgctagtctgtcattgcttccctagtgtgtgggaaccatacttgtccccacttctcagtcagagagcagcctgccaacctccaagtctcttgcccctgacccaaaaggtcccaggctgtcctctcggcagaagcagctgtcttgtggcttactgtgctcagactccatttctaggctgtgggctcatcagggatctagtgctttgaaaaagtgtaaaggagagcagcagtattattcacaatagctaaaaggtagaaacgaccaaagtatccattgacagatgaatggataaacaaaatgcattacatacacacaatggactattattcagccttaaaaaggaaggaggccaggtgtggtggctcacacctataatcccagcgctttgggagactgaggcaggcgaatcacttgaagccaggagttggaaaccagcacagacagcatggggaaaccccctctctactgaaaatacaaaagttagccaggtgtggtggcacatgcctataatcccagctactctggaggccaaggcatgagaatcgcttgaacctaggaggtggaggttgcagtgagccaagatcatgccactgcactccagcccgggtgacagagtgagacactgtctcaaacaaacaaacaaaaaaaaagaaacgtgtggtggaagaagggaagaaaattggccaggcacactctggtaggggatggttggatgatgaaatacagacaatagaaaaacctagataaagacctggcgtaatggctcatgcttgtaatcccagcactttgggaggctgaggcggaaggatctcttgaggccaggagtttgagaccatcctggtaaatatagtgagaccccagtctcttaaaaaataataattggctaggcgcgatggctcacgcctataatcccagcactttgggaggccaaggcgggcggatcacctgaggtcgggagttcgataccagtctggccaacatggagaaaccccatctctgctaaaaatacaaaattagctgggcgcggtggtgtgtgcctgtaatcccagctactcgggaggctaaggcaggagaatcgcttgaacctgcaaggtgaggttgcagtaagctgagattgtgccgttgcactccagcccaggcaacaagagtgaaactccatctccaaaaaataaaaataaaaataaaaataaaaaagaaataggccgggtgcagtggctcacgcctataatcctagcactttgggaggccaaggtgggggcggggtggatcacttgaggtcagaagttcgagaccagcctggccaacatggtgaaacccaatctccactaaaaacacaaaaaattagccgagcatggtggtgggcacctgtaatcccagctactcgagaggctgaggcaggagaatggcttgaacctgggaggcggaggttgcagtgagccaagatcaccccactgtactccagcctgggtgacagagtgaaactgtctcaaaaaataaataaataaataaataaaacttttaaaaagtaagaagaagaagaaaaaaaatatatggaaattaaaaaacaagaaaaaaataataggccaggtgcagtggctcatgcctgtaatcccagcactttgagaggccgaggtgggcggatcatgatgtcaggagttcaagaccagcctggccaacatagtgagacctcgtcgctactaaaaatagaaaaaaattagccaggcgtggtggcgggcacctgtaatcccagctacttgggaggctgaggcaggagaatcacttgaacccatgaggcggaggttgcagtgagccgagattacgccattgcactccagcccgggtgacagtgcgagactccatcaaaaaaaaaaataaataaaataaataaatattaataataattttaaacaattaaaaaatatgggatttttttgagacagagtctcactctgtcgcccaggctggagtgcagtggcatgatgtcagctcactgcaacctccgcctcctgggttcaagtgattcttctgcctcagcctcccaagtagctgggactacaggcacgcgccaccacgcccagctaatttttgtatttttagtagagacagggtttcaccatattggccaagctggtctggaactcctaaccttgtgatccacccgcctcggcctcccaaagtgctggaactataggtgtgagccactgcacccggccaaaaaatatgttttttaaaataatagagatgaggccgggtgtggtggctcacacctgtaatctcagcactttgggaggccaaggtgggtggatcacttgaggtcaggagttcgagaccagtctgggcaacatggtgaaaccctgcctctactaaaaatacaaacctgagctgggcatggtgacgcatgcctctagttccagctactcgagaggctgaagcaagagaatcgcttgaacccgggaggcggagactgcagtgagccaagatagcaccactgcactccagcctgggagacagagcaagaccctgtctcaaaaaataaaataaataaaataaaataaaataaaataaaataaaataaaataaaataaaataaaataaaaaataaaataaaataaaataaaataaaataaataaaatagatgaaggccaggtgcagtggctcacgcctgtaatcccaacactttgggaggccaaggcaggcagatcacctgagttcaggagttagagagcatcctggccaacatggtgaaaccctgtctgtactaaaaatacaaaaaaattagccaggcattgtggcgggcggccaataatcctggctacttgggaggctgaggcaggagaatcacttgaacctgggaggcggaggttgcagtgagccaagatggtactactgcactccagcctgggtgacagagcaagactctgtctcaaaataataataataggccgggcacggtggctcacacctgtaatcccagcactttgggaggccgaggcgggcagatcacaaggtcaggagatcgagaccatactggctaacatggtgaaaccctgtctctactaaaaatacaaaaaattagccgggtgtgctggtgggcgcctgtagtcccagctacttgggaggctgaggcaggacaatggcgtgaacccggtaggcggagcttgcagtgagccaagatcgtgccattgcactccagcctgggcgacagagcgaaactccacctcaaaaaataataataaaataaaataaaaataaaaataataataatagagatgaggttttgccatgttacccatgctggtctccaactccttggctcaagtgatccatccaccttggccttccaaagtgctggaactacaggcttgtgccaccaccctggccttaaacaattattcatgaaaggaaggaaattctgacacatgctgcaacatggatgaagctcaaggacattatgctaagggaaggaagccaaagacctgccagccgaggtcccagtccgtcaagggctccagtgagcgagcaggattgagcaggtccctgggctgagcagtgggaactctgctttgctgtgagtgtggcacgggtggcggcagactgtggagtgcaggctctgtggagcaactggacactctgttgaacgaagtgcaaggtggtaggtttttgcttttttttttttttctgagacagagtctcactctgtctcctaggctggagtgcagtggcatgatctcgactcattgcaacctctgcctcccgggttcaagcaattctctgcctcagcctcctgagtagctgggattacaggcgcgagccaccacacccagataatttttaaaatatttttggaagagacggggttttaccatcttggccaggctggtctcgaactcctgacctcgtgatccacctgcttcagcctcccaaagtgctgggattacaggcatgagccaccgcgcccggccacaaggtggtagtctttctcaaggacgctggggcaaccccattgcgtcttcaccaacaccctggtacagatcctgcagctgcagtctaccccgcatacaacatgttcaatgatccctagctagacaaggcattgaaaactattccataggccgggtgcagtggctcctacctgaaatcccagcagttttggagcaaggcgggtagatcatctgaggtcaggagttcgagaccagtctggccaacatagcgaaacaccgtctcttctaaaatacaaaaaattagctgggtatggtggtgcatgcctgtaatcccagctacttgggaggctgagacatgagaatcacttgcaccaggaggcggaggttgcaatgagccgagatcacactactgtactccagcttgggtgacagagtgagactctgtctcaaaaaaaaagaaaaaaaaaattagctgggcatggtggcatgcacctgcaggcccagctactcaggaggctgaggcaggagaatcgcttgaacccaggaggctgcagtgagccaagatcgaaccactgcaccacagcctgagtgacagagtgagactccatctcaaaacaacaacaacaacaaaaatcaactattccttgggaggcagaggcaggaggatggcttcaggccaggagttggagccaagctaggcaacatagcgagaattcctcatctctacacacacacacacacacacacacacacacacacacacattaattagctgggtgtggtggcacatgcctccagatactcaggaggctgagcgggaaggatggtttgagccctggaggttgaggctgcagtgagccatgatcacgccatgacagaatgaggaccaggtggaagaactgaaaacgctggggatccacacatccgctccatcctttcagatggaaagaaataccaagactcaaaaaaatgagggtgcccaggtcctcactgagcagagactcactgctaaaaaaaagccttacctatttgggttttcactagtaagcagttggtttgtaagcagttggtgattttagtttgtctgggtttcagccatgaatattctattgtaaacttaattataacaactgcactgtaataattcaatgtcctattatgatgttgttatagacaaaatttgcctttacattgtcatttattttattttatttttcttttgagacagggtctcactctgtcacccaggctggagtgcagtagctcaatcttggctcactgaaaccactgcttcccaggctcaagcgattctcccacctcaccttctcgagtagttgggaccataggtgtgaaccaccatatcaggccaatttttgtatttttagtagatacggggtttcaacatgttgcccaggctggtcttgaattcctgtgctcaagcgatccacttgcctcgcctcccaaagtgctgagattacaagtatgagccattgacatttaatcttccttccttccttctttccttccttccttccttccttccttttctttttttgagatggagtctcgctctgtcgcccaggctggagtgcagtggcacgatctcggctcactgcaagctccacctcctgggttcaagcatttctcctgcctcagcctccggagtagctgggactataggcgcaggccaccatgcccagtgattttttatttttattttttttgagacggagtctcactctgtcaccagcctggagtgcagtggcgcattcttggctcactgcaacctccacctccagggttcaagcaattctctgtttcagcctcccgagtagctgggattacaggcacccaccaccacacccagctaatttttgtatttttagtagggatggggtttcaccatgttggtcaggctggtcttgaactcctgacctcgtgatccaccaacctcggcctcccaaagttctgggattacaggcgtgagccaccgcacctggcctacttttttaaacttaaattttaaaaaaaattaagtttatttttaatgtgatttatttatttatttattttttagatggagtctttctctgtcgcccaggctggggtgcagtggcactatcttggctcactgcaacctctgcctcccgggttcaagtgattcttctgcttagcctcccaagtagctggggctacaggtgcatgtcaccacgtccagctaatttttttgtatttttagtagagacagtgtttcactgtattggtcaggctggtcttgaactcctgaccttgtgatccgcctgcctcagcctcccaaagtgctgggattacaggtgtgagccatggcacccggcctatttatttatttattttttaattttttttgagacggagtctcgctctgtcacccaggctggagtgcagtggtgcagtctcggctcactgcaagctccacctcccgggttcatgccattctcctgcctcagcctcccgagtagctgggactacaggcgcccgccaccacgcccagctaatttttttgtatttttagtagagatggggtttcaccgtgttagccaggatggtctcgatctcctgacctcgtgatctgcccaccttggcctcccaaagtgctgggattacaggcgtgagccaccgcgcccggcctctttcaatcatttctgatgacaccggagaaggcagtgtcctttccttattgtctctttttttttttttacctgggtattctggaagtgtctttcctctgacagtgttgttggacgtggggaaacaaaagggtatcaaagagagggagagaaggataaagaccacccctcattcccgccctcccagaggggcagcctggggagtctatggaggaggtgactttgagccatgatgtgaccttagatgaggggcctctctgagcctcaggaagctcttctgcaaaatggggcaaataaagaaatgccctctgtgtgcagtggctcaggcctgtaatcccagcacttcgggaggccaaggcaggagaatcacttgagcgcaggagttccagaccagcctgggcaacatagtgggaccccatctctaccaaaaaatttaaaaattagccaggcatcaggtgtggtggctcaggcctgtaatcccagcactttgggaggttgaggcaggcagattgcttgagcccaggagtttgagaccagcctgggcaacacagtgagacccctgcttctacacacacaccaaattagccaggtgtggtggtgcacatctgtagtcccagctacttgggaggctgaggtgagagaatcatttgagccctgaagctcaagactacagtgagctgtgattgtgccactgccctccagcctgggcaacagaccaagactctgtctcaaaaaaaggaaaggtccaggcgcggtggctcatgcttgtaatcccagcactttgggaggctgaggtgggcggatcatgaggtcaggagattgagaccatcctagctaacacagtgaaaccccgtctctagtaaaaatacaaaaaattagccaggcgtggtggcgggcgcctgtagtcccagctactcaggaggctgaggcaggagaatggcgtgaacccgggaggcagagcttgcagtgaactgagattgcaccactgcactccagcctgggcaacagagcaagactccatctcaaaaaaaaaaaaaaaaaaaagtggaaaagaaggccggacgcagtggctcacgcctgtaatcccagcactttgggaggctgaggcgggcagatcacgaggtcaggagtttgagactagtctggccaacatagtgaaacactgtctctactaaaaatacaaaaaattagccaggtgtagtggtgtgcacctgtaatcccagctactcgggaggctaaggcaggataattgtgtgaacccgggagacagaggttgtggtgagccgagattgtgccattgcactccagcctgggtgacagtgcgagactctgtctccaaataaaaaaaaaaaaggaaaagaaattccatcccaaggtgatccctcacaggaagtgactcagaaaagcagtgagctacgaaagctatctgaatgaagcaagatcgtcatgtgggagacactgactacccactcctagcaaagggctcagcagcacacggcctccctgcggggatgccctcggggaagatgtggcccagaggagttttttgggccttgctcctcagtcctggctcttagtaggaccctctgcagccaaactagcatatcctgagccaggctgaccttaaaaagtaagcattcagggcctagggaccttgggcaaagcagagaagctggtgtcagatgaggtgcagcaggtacagtaggataaggtgttctcaggtcgccagtgcagccccaagatgagcctgcagtattttccttacatgatctggtcctactgtgggcagcgctgctgcccagagcctgagaggattatgaaaacatggcaacggaagtgaggccaggggacacagcatgggggcatgaggagcaggggacagcgggtggggctagaggagagggaggtttagggaggcctctgctgctgtgactgtgagccccagccaatgatgacgtggccaccgcacaatctgagttctgggaaccatgtgatggaatgtgttctgggaatagactgcagccaggaaaaaaaaagcagaagggtgcaccctcccttcctcagccaggaaaacatttctgtagcccttgcggacccaatgcgcagaagtgagagggaggaaagccaggctcatgtttccttggttgtgcttcaacttctaaaatatgttttttctatgaacattttaatgaggggttggacataagacagaaaaataacattctgagagctcgtttggaggttctagcaggggagcgcagctactcttatactcttgactgaagaccgatcgtcctctatcggggatggtcatcctcttccattgagcacacagcttctggagggacgcacatggagtggtgagggaggaaggggatacccgcctagtcagccagatcagccgaatcaaccctgatgatcaatggggtgacacatgtcgcagccagatcaccctcacatcccaaaaataacactcagattgctttttcttttttaagatgtagacttttcttgagactttcgtacaaggcaatggacagataaccttaacctcccagagaaaacacacattggccacagaaaaaggcgcttctccgtatacctgccatagttatcagcaactttgaaatggcttctcagactctcaggggttggcttgttgtgtttgcttttgcaaataactcaggcttaagtcctgctactttcagagcctaggggacgcttaaggactaccatcagtttaacacagtggcacttggagcacatgctacttatggtggtgaggaggggtgctggtgtgagggtctgaacgcttgcttctcctctggcagggtgtgagcagccagaggccactacctgggcaaggatgcttgctcagtgtccatggagggacatgtgatccagcaggtgggcaggaaccaggcccctgtggccgcccaactctccataatagaatccttggtcatccatgggcccgtaaaccatgaccacgtctcctgccctcagcgccagcctgcccttcccctggccccccatttgcccatccccaggatcatagtccagagctgctatcatgatctttggagtccacagtgggagtctcttggagttcccctggagcaccagggaggaaccctgggggatggtgagcccctgaaagtcctcgaggtgggccacagaaggcaggttcccttgggccggagaacgccacctcctatcagtctgctctgtccccacctccatctcagccactaggcgcccggggatattgcccacttgcctgttgcactcgctgaggtagaaatcatgggtgtcctgagagccccacactcttagcaactgccttttctggaagaccagctcctcctctgcagccttgaggttggcagacatcaccagggggttgtaatcagagagggccacaaagaccctggctggagtgttggcccccgtccccagctgttgggggccacccctgggcatcttgatgactttggcggatggagctggacacagtgccgagctgggctcatggagctggcaccctctcttcacccccagagcttgtccttgcctgctgtggggctcaggctccctcctctcctctcgcctctctgtgccccacagatccaagcacagtgcctcctgctcctccttcaaaacgttatggaagtcagatgcatactgttggctggcgcccagctggggaggtgtgaacccttgggcatcttgcttttgccgaagtaccctctcaagggcagccttttcctgacacggttctttcctgggcccacactcggtgcgtagatggatgaatcctggagcagggcttttgctggtgcccatgtgctgggagcaattttccttctccccaggctggtcactgactgaaggtggcctgtggttctggggactcttctgaaagagcaggtcctttctacagccctcccaggcctctgcaagctcctgggcttggctgccagcccctgaactcggacattctccttctgagcccaggttggacactggggattgcctccttgggggttcttcaaagaatgcttctaggaacttggcctggggctccccgcagcttccagggttgtgggggctggccttggcactcggaggagccagtgacagcttctgggggcagacggggaaggtgactctgtaggtggatgggtcgccacaagtgtagctaaagggtggagtctctggccatcggtgacacatgaagaagtcctcggggatctgagcaggcactgaatccagggactcaccacagagtgacatggttctcactgagaccttctgccacgtgaggggcacctgtagctgggagaattccaatagggtgctcccagcagtggcatcggcgacctcacaaaccttaagcccatctgcatacacagcataaccggtgacctggactccattggaggacccagctgagtcaatggtcacagggagccagctgaccaccaggacacctggcgaggcatggcgctccaccagcacatccagcggtgggtagggaggtcctgccaagagtgtgtcgaaggtgacggtggaggacatagttccccaatacacctgcagcaagtcccgtggcagccgcacctccacccgcgcccggtagtgcgtgccggggcacaggccctggaaggtgtagcagctcacgcccgctggggtcagggcatgctctcggtcatcaagatataccacatgggggtggcggtggctgctgtagacccaggtgatgttggctgatgtggctgtgacattctgcaggtgtagctgcatgggagccatacggagcacccctttggtccccagaaggggtctggagaggccctgcttccccatgctctgcagcaagcccagctggcaggcttccgtcttggtatccaggatctctgttgctacttctgtcttggagcccaccctgaccatctggcacagccctctgtccaccactccctgggctttcccagataataagctgtcttcctccagagcttcatcctgccccgctgggagttgactggggccaagatcaggggatttggcaggcaggcagcctgggatgtagctgtccggaatctgctccacgaagttggagggcaccagcccccgccggccatcctcaagctccccctcatagaagccatcctcatccatgtccccgaagatatatatgtagtccccagctgtgaggggcagctcaccctcagggtgatcattgggcccctcaaatgggttgtagttatactgagccatgaagatcttgagcttgggggcagcaggagccgccgagccccccatttccagggccagggacacgctgtcaggctccaggtcatccacctcactggctgtgtccctgtccagagtaggggaggacggcacggtggcccacatcgacccctcagaggaggagtttgactgggagctggttttcttggacagaggttggctggcagggactgtctctgaaacttgggggacactggctgactccccaagggcaactgggctctcctcgagggaggcttcccttttctcctgtatgtctctgttgggctgtgacactgcgtagtcttcaggccgtgcgtggaacttgggccttctgctacctttaacttgggactccggcatttgactggtctcccagggctgttcaggagggtgaccaggccgacactggagcgcctgtatctccttccaggaaggatggaggtcacacagggccttctgcgggtcgcgttgcagctgctgctgcctgtcctgcccgcgcgccgcctgctgcagcagctgttcggcgatcaagccggaggcatcgcgctcttgacacgcgcggcccaggtggccgcgcacttcgctattctcagcctccaccttccgcacccagtcggtcttggcctgcagccgcccattctcctccgccagccaggcgtttttgagcagcgccgcctgcagctgtgtctcggcctcctcgccacgtcgccgcgccggggccgcctgcgcgcccagctcctggcactcgcgccgccgctggtccagctcgcgctccagcgccagcatctgccgtcgcacctcctcgcaggttgcgctctggccgcccgcctcgggccaagcgccaccgttgccctgctgaagcatcaactgcctctgcaggcgcagcacttcccgctgggactcgcgctgcaggcggtctaagtctctgacgttgagccactgggtgcaggggccgccccttccagtatgcaggtcgctgcagggacccgaggcgacacgcgcctgcaggaggtggcactcctgccgcagctcttcgatctgcttgtccttggccagcggcgcgctcgcctgctccgacaggtcccgagcgcgctggcgggcaaagacttggcacagctccaggccggcgcaactctcgccgggtataggcgcgctcacggcccggaggttggtctcctgcagcttgcgggcgcggtcagctaggcgccgcgcgagcccggtcagctccgcgcgctttaccttgagccgcttcaccttctcgtctgcctggtaggggcagcctgcacgccgcagctgcttgttctccgcttgcagggtataacagcggcgcgccagcacccacaacgccttggccagcagccagttcagctttatcagctcgtggtggcccaggcccgggggtgagggagtcaggacttcgcagggctggctctcagagccttctcctccccgcgggttgctgagtttcctgtgggctgacggtggtggtggcggcgggagtggcgatggtggcggcgagagcctccgggagccaggggtggaggtgtctggtgaggagggccgctcctcggatttggaggccttggggaggctccgggtgctgtcaagcgagcgggaacacgcaggtgcgaagcaatcaagggagctggcgtgcgtggagagcaggccgtctggggagctggagcacgcagaggacaccaggcctagcgagcgggagcgcacaccgacttcagcactcaggctgtctagagatccgagttggcaggcgggtttgggggcgtggcaagagccgctggaggtctggggcagcggttcttccaaggaatgcacagcttgggggtccggtgatcccgacaaagccgggtgcccgcggaagtgcgccaggatgtacttgaggaagagctggcgctccacctccagcgccgcctgcagatagcggatgcgcgccgcctgctcgccgtcagtctgccagcgaagctgcgccaacacttcctgcaggcgacagcggcactgcgccgcggaaacctcggacgcccccgggcggctacagtggccgcggttcaccagctcctcggccagctggcgctgcagctcccgggcttggcgcaccacgccatcgcgctcccggtgcagcagctgctgcagctgccgctgctcggcctccttccagcgcagcagctgccggatctcggcctcgcgttcccgctgcatctcctcttgcagctgccgcaactcccggctgcgctgtgcctcccacttggagcgcagacggtcagccagctgtcgccgctcccgctcggcctcctcacgcagctggcgctcccgggcagcgaagcgccgccgttccgcccgccagcctgcccgctccgcctccagctccgcccgtagcttctccagctcccgcctctggttctccagcactgccgccgccgggctggagcagcccggcttcttgggcgacgcgcccaaggggctgggcgagtccttggccattgcggccgcggcccggctggtctccagacttcgcctggcaggcctcagctcgccaacggccgccgccgaccgcccggcgcgccccttccggcgccccctgggggtctccgcgtgccccttccgcctcttggcatgttcccccgcctcctgccgcggatgtctggcccaggcgcctctccacctggcaaggccagggctggactcccacacccctgctcaaactggcccatgtcccttccaggatgcacgggggcttttccggtccctacacttttcctgcttctagcaccaagtcccttgtgaccctccccaggcaccctcccaggcactgtgcagtcccaagcaggccgcggtgccccgagggaagtctgggctgctgctcctgtacttggagaaaggggcagggtgtgtgtgttaaggccacccatggggtgtgggcatacctggtcgtgggttcaggtggtgtatttgggtcaggtggctggaaaatgcagcaggataggcctcaacttggctagacctggactccccaggacccttcagccccctaacagccctgatcacccaactggtcatccaccttttgaggaaaggatgtgcctgatacacatttgtgttactgcgcagagtcggctcagaggaggtgtaagcgaaaagaccctccccagcaaggtggcatagggacccagggccagataggcatgaggggcactgcccaaactggccatctggcctgtctacctcccacatccaggtaccacctggtgacaaacactggagccccagtgtctgggctactcattggcatcttaggtagaggcctcaggatgggccaggagtgagggtgaggcttcagcagaaatgttggaggcatcctgagctgcagaagaaacacacacacacacacacacacacacacacacacacacacagctgcagaagaaacatacacacacacacatactgagctgaaggaatacacacatacactgagctgcagaagaaacatacatacacacactgaactgaagaaatacacacacacacacacacacacacacacactgcctctctgactggtggccacctgtgtggcttgggagctaagaagccctgcttcagtctggctcctctttgcccttcctgtctgctcctggtgccaagtggcttttgggagacatggatggacacctgatacctggcagtctgcatcgagacattgatttttttttttttgagatggggccccactctgtcgccaggctggagtgcagtggcgcaatcttggctcattgcaacctctaccttccacgttcaagagattctcctgcctcagcctcccaagtagctgggattacaggcttgagccaccatgcccagctaattttttgtactttttagtagagacagggtttcagtatgttggccaggatggtcttgaacttctgacctcaagtgatccacccgcctcggcctcttaaagtgctgcgattacaggcatgagccactgtgcccgacaagaccttgatattgaagtcacatcagaggcccctttgcttcttggtctgtcgtgtctccctgtccccaggaagcacctgggacctctcacaactgctgtgttcactcagcttatggccctcctttacaacactcaagtttttcaaatcagtttccccggaacccacagaacatgcctttaggcagtgtcaagtaacaagaacatcgggaattatggctccagatgttcttttttttttttttttttttgagatggagtctcgctctgtcgcccaggctggaatgcagtggcgcaatctctgctcactgcaagctccgcctcctgagttcacgccattctcctgcctcagcctctcaagtagctgggactacaggtgcccgccaccatgcctggctaattttttttgtattttcagtagagatggtctcgatctcctgaccttgtgatctgcccgcctcagcctcacaaagtgctgggattacaggcgtgagtcacggcgcatggccctttattttattttattttattttattttattttattttattttatttgtgagacagagttttgctctgtcaccaggctggcatgcagtggcacgatttcggctcactgcaacctccaactccctcgttcaagtgattctcctgcctcagcctcctgagtagctgggattacaggcatgcgccaccacgcccagctaatttttgtatttttaatagagacagggtttcatcatgttggccaggatgatttcgatctcctgaccttgtgatccgcccactttggcctcccaaaatggtgggattacaggcgtgagccaccgtgcccagcccagatgttctttatgagaggtgaggcagatgtagtgtgtatgtgagaggaaggggaggtgagatgcagggatggccttagccttgaactggtgctgggctcctgggcatggtagccacagggaggactatcttgagagaatcttcatcacagccctgttttacggaagagaacctgaggctcagtgagagccactggcttgccagggcacatgggcaactgaggcagagctggtgggtggggtttcacagcctggatgccctgctgcagtctccagtagggcctcaactgtcaggtcaggagggcaggctgggccgggcatggtggcacagacctgtaatcccagccctttgggtgaccagggtgggaggatcacttgagcccaggaactcaagacctgcctgagcatcatagagagaccctgtctctacaaaaaaaattttagctgggcgtgctggtgcatgcctgtagtgccagctacccaggaggctgagatgggagggtcacttaagcccgggagtttgagactagcctgggcaacagagtgagcgagacccagtctgcatttccagctgagatgaaatgattgcttgagcctgcaaggtgaggtcaaagtcgcagtgagctgtgatggcaccactgcactccagcctgggcaacagagcaagactgtctcaaaaaaaaaaaaaaaaaaaaaaagcctggtgcggtggctcactcctgtaatcccagcactttgggaggccaaggcaggcgtatcacgaggtcaggagatagagtccatcctggctaacatggtgaaaccccgtctctactaaaaatacaaaaaattagccattagccaggcgtggtggcgggcacctgtagtctcacttatttgggaggccgaggcaggagaatgacatgaactcaggaggtggagcttgcagtgggccgagatcccgccactgcactccagcctgggcgacagagcgagactccatctcaaaaataaaaattaaaattaaaattaaaaaaagagagtaggctgtcaccaagaaaaaggacactggggtggatgggtctctgggaaccccacagttaccatccagcagctgccccaaagtatgtcaaaagcattcgggaatgttggttgagtggatgagcaaagccaggcttccccagggctgggtttctgccatccctgttctcatcatgttgtgcagtgattgtccagtgacctgcctgtcacccccatcaactctgatcttggggagagcagaagccatgttttcccttgtccctattgcatccgtgcatgtgacttagcacatcactggtgcccaagacatatgagaatgagttgcagggaggcaggagtccctgcatgagctcaccatgctgctgccttctccaggttcaactttctcacctattaaatgaaagagatggtttcttttttttttctttgagatggagtctcactctgtcacccaggctggagtgcagtggcatgatctcggctcactgcaatcttcacctcctgggttcacgtgattctcctgcctcagcctctcaaatagctgggattacaaacacctgccaccatgcctagctgattttcatagttttagtagagacaaggtttcgccatgttggccaggctggtcttgaactcctgacctcaagtgatccacaggcctcagcctcccaaagtgctgggattacaggcatgagccaccatgcccagcctgaaagtggtggtttcaaactgggttctttagggctccagggttccttggaaatatagaactgctgggcacacacctatactcccagctacttgggaggctgaggcaggaggcttgcttggatccaggacttctggattgtaatgtactatactgatggggtgtctgcactaaacttggcataaattggtgacttcctgggagcaggaaaccaccagcttgtctaaggagaggtgaactggcccaggttagaaaaggagcaggttggccgggctcggtggctcatgcctgtaatcccagcactttgggaggccaaggtgggcaggtcacctgaggtcaggagttcgggacccgcctggctaacatggtgaaaacccgtctctactaaaaatgcaaaaattagctaggcattgtggcgcatgcatgcctaatcccagctacgcggcaggctgaggcaggagaattgcttgaatctgggaggtggaggttgcagcaagctgagattgcaccactgcactccagcctgggcgatagagtgagattccatctcaaaaaaaaaaaaaaaaaaaaaagaaagaaagaaaaaggaaaacgaaaaggagcaggtcaaaactcctgtgctggctgggcgcagtggctcacgcctgtaatcccagcactttgggcagttcaagaccagcctgaccaatatagtgaaaccccatctctactaaaaatacaaaaaattagctgggtgtggtggcaggcgcctgtagactcagcttctcgggaggctgaggcaggagaatcgcttgaacccgcgaggcagaggttgcagtgagccaagatcatgccattgcactctagcctgggtgacagtgcaagactccatctcaaaaaaaaaaaaaatttttttttttgtaggctgggcgccgtgactcatgcctgtaatcccagcactttaggaggccaaggtgggtggatcacttgagatcaggagttcaagaccagcctggccaacatggtgaaaccctgtctctactaaaaatacaaaaattagctgggcatggtggcaggtgcctgtaatcccagctactcgggaggccgaggcaggagaattgcttgaacccaggaggtggaggttgcagtgagctgagatcacgccattgtactccagcctgggcaacagagtgagagtctgagtcaaaaaaaaaagaaaaaaaattaacaacaggccagatgtgacggctcatgcctgtaatcccaccactatgggaggctgagacgggcagatcacttgagctcaggagttcaagaccagcctagacaacacggcaaggctgcatctctataaaaaaattacaaaatttagcctggcatggtggtgcacgcctgtagtcccagctatttgggaggctgagatggaaggataccttgagcctgggaggcagaggttacagtggactgagattgtgccactccacttccacctggacgagagagccagtccctgtttcaaacaaccaaaaaaacaaaaaacccacccccccaaaataaaaacaataataataataaaaataaataaaacagaaataccataggccttttgggaggaggtatgcaggaagcggatggggagagacagtgcccctacttgcttcaatgggcagatctactctttttttttgagacggagtctcgctctgtcacccaggctggagtgcagtggtgcaatcttggctcactgcaacctccgcctcacgggtttatgccattctcctgcctcagcctcccgagtagctgggactacaggcgcccgccaccgagcccggctaatttttgtattttttagtagagatggggtttcaccatgccagccaagatggtctcgatctcctgacctcgtgatccaccctcttcggccttccaaagtgctgggattacaggtgtgagccacagcacccggccggcagatctactcttaagtgtcacttatcagattcgaagaagggttttggtttaataaagcgttatgctccttgaaacaagtttcagaacccctgggttagaggacctcttgcccattgtgtgctcacacacacacgacacacacataccccatcccagtacgtaatgacttccctgacccggagagaaggcgatatgtcccccttacatctcagttggctccacatcgccagctctgtattccactttccctctctctacaaccccagtctatgacttttgggccatggagtctgggttcctgggcaacctggttcacatccttctcctgccggcatggcctggctccatttctgttcggctaccaaagccccaagctttgtggagcctgcctggccttgaggaggggaatgggctccatcctgagagcctgcaggagggtttaagcttcccatcccccattgctacagtagctcccccagcttttcattccatatcctttatttttatttattaaaaacttaatttttggccgggcgcggtggctcacgcctgtaatcccagcactttgggaggccgaggcaggcggatcacgaggtcaggagatcgagaccatcctggctaacacggtgaaaccccgtctctactaaaaatacaaaaaatagccaggcgtggtggcgggcgcctgtagtcccagctacttgggaggctgagggaggagaatggcgtgaacccgggaggcagagcttgcagtgagccaagatagcaccactgcactccagcctggcgacaaagtgagactccgtctcaaaaaaaaaaaaaaacaaaaaacacttaatttttttttttgtagagacagggtctccctatgttgcctgggctggtctcaaactcttaatctcgagtgatcctcccacctcagcctcccagagggatgggattacaggcatgagccaccatacccagccacatattttttatttttgtttctatgtgttttctgtctgttctttgctgtctcctccatgtctagaacagtgcctggcacatgataggtgctcagtaaatacaggactgaagaagacagaggcagacaggccagatgtggctgctgtccttagggaattgacagtccatgatctatgagaatgagctgcagactgggaggcaggtgtcccagcatgggctcaccaagctcctaccctctcccggtccagctttctcacctatgaaataaaagtgaagctggacatggtggcccacgcctctaatctcagcagtttgggaggccaaggtgggtggatcacttgagatcaggagattgagaccagcctggctaacatggtgaaaccccatctctactaaaaaacacaaaaattagccgggcgtggtggcagttgcctgtaatcccagctactcgggaggctgaggcaggagaattgctttaacctaggaagtggaggttacagtgagctgaggttgtgccactgcactccagcctgggtgacagagcaagactctgtctcaaaataaataaataaataaacaaacaaacaataaatgaaagtgatggattacatgaatggttttcaaactgggttcctcagggctcagtttgggggagaatgcaaaggttaaatacaaacaacaatggaatgtagtaacattggcgcttgggcgagtgctctgggtgaggaatgtggtgctcatggggagaagagccgcatcagagcaggcttcctgcatgaggcaaggaggaaacacaagagctgagagctgaaggagagggagtgagggctgccagaggagctgggaggcgatttcaggcagtgggaactggagctgcaaacccccagcctcctgcagtctggctatctgtaccagccctcacccatgcccaccaccctcagggcactcacatcccttcttgcactgatattttcccgtcctatcatgaccctcgtttgagggtgcagggaggactggagctcagagagggagggtcacctggccagaccctaacccgctgagttccagtggagttccttccatcccccagcactggatggggctggatacctggagagggaccgtgctgctcttcctgggccctgcagcctgcctggctggtccacatcttcctgggccaggagggcagtatggtgcgagcttctagctctctggctggggccccctggcctactgggctggcttcctgccctggtggccctggcccagctccccagctcatgtgcctctgcagcgagtggtcagccccttcccatctgcactttacaagcctcatcgctgaatcctccccatagccagagagcctggcactctcctctccagagaaggaaactgtccagggtcacacagggacttatgggcaggtctgtgtgacctgagtctgggctctgaactggtgcttgcagggtcttgccctctggctctggcagcctgagtgttactgtaatccctgagcctttgaacaagcaggcactgcttcctgagatccccattgctgctgtcagcgtctctgtttcccagctccacactgctgccaggacagacgtatcttctgtcttgtagcatctccatttctcttccctttagatctatttttttttttttgagatggagtctcgttctatcatccaggctggagtgcagtggcacaatcttggctcactgtaacttctgtctcctggattcaagcgattcttctgcctcagccttccaagtagctgggattacaggtgcatgccaccacgcctggctaatttttgtatttttagcagagacgaggtttcaccacgttggccaggctggtctcaaactcctgacctcaggtgatctgcccacctcagcctcccaaagtgctgagattacaggcatgagccaccgctcccgggctggatctatttcaatcaccctccttcctctgcagcctgaaacttgaggctttgcccacttcccaaaggcacgagtagcaatgaccatttgttctgtcatttggccatagctctaggtcagaggacagtccttcatcaaatgtttgttaagcatgcaatctagacaggggaggacaagggccaagtaatgtgttaatttcttcattcactaagcacagagaatggagtagaaggaaggtggaaaggagaaggaaggaaaagagagaagaaggaggatagaaaggaaggaaggtgggagggagaaaggaaagaaagagggagtcctttaggttatctaagtcccctcaggacttggtctggccctcacagttcaagaacagacttgggcttgagcctctgaccagccagatgactgagaagctgaggaacagcttgagcctcagttttttcctctgtaaatggggttgatagcagttctgacccagcgggctgttgggggagtcacagagatgctgggtgctgcctttgcactcagaagggtccaggctaggtgtggtggctaacacctgtaatcccagtactttgggaggctgaggtgggagaatttcttgagtccatgagttacagaccagcctgggtaatatagagacaaactgtctctataaatttttttcccaaaaattagccaggcatggaggtgtgcacctgtagttctagctgcttgagagtctgaagtgggaggataacttgagtacaggaggttgaggctgcactgagccatgatcacaccactatactccagcctgggtgacagagccagaccctatctcaaaaaaaaaaaaaaaaaaaaaatcaaaggggtccagcagcatcttcctgtcagcttacctaagggagcatgataaattgagtccctgccacgatggacatggggagtgtagtgggagggaatggcaaaggcaccacaggcagagggaacagcctgggcatagtggggggtgtgatgtggcacagcactgattgtgggaagcgagggatgtgggagatgaggcttcaggtagtcagagggaggttgaggcaaagcctcacctgcatgctctagatgaggtccaattcctggtacccagctcctagcctagtaatgggccacttctcccagggccacagttttctctcctatcaaatggaacatgttagcactgctctatggtgccaatgaagggtataagtgtccagtgcccatttcctgccccagcaaaggcactttcttttccttgtcctcttgcctactggggaactccttccatccctggttcctcccccagcttctgcgaggcccctcctctgagcccccacacctcatcaaaccctcaacaccgtctggtgttttccttggtgcctcttcaagatgctgtgagctccttgggggcaggtggtgcctgtgtacctcttttttttttcttttttttttttttttgagacggagtctcgctctgtcacccaggctggaatgcagtggcgcgatctcggctcactgaaagctccacctcccgggttcacgccattctcctgcctcagtctcctgagtagctggtactacaggggcccgccactgcgcccggctaattttttctttttttctttttttttttttttgagacggagtctcgctctgtctcccaggctggagtgcagtggcacaatctccgctcactgcaaactccgcctcccgggttcacgccattctcctgcctcagcctcccgagtagctgggaccacaagcacccgccaccacgcccagctaattttttgtgtttttagtagagacggggtttcaccgtgttagccaggatggtctcgatctcctgacctcatgatctgcctgcctcggcctcccaaagtgctaggattacaggcgtgagccaccacgcctggccttttttttttttttgtatttttagtagagatgggctttccctgtggtcttgatctcctgacctcgtgatccacctgcctcggcctcccaaggtgctgggattacaggcgtgagccactgcgcctggccctgtgtatctgtttttctggaccgccatcatgttcaggaaggcatcgaatattttgtccgcgactgcaatcacacactgcatcatccctgaaacgaggtttccacggataaggtgcagcaacagagagagaatcctagcaactttcaatcattttcttttgaaatggttttagacttacagagagtggcaaagacagcacagagctcccatatacccttcacctagcttccctggattttaacatctgcagtaaccaggctgatgtgtcaaaactgagtcagatattgatataatcctattacctaaacttcagacttcgtctggatttcccaggtctcccacacatgccccgcttctgttccagcatccaacccaggacaccaggtggcatttaatctctgtgtctcctactcccttccaatatgtggtgactccccagtctgtcaatgtcttttgtgactttgacacttttgaagaacagttattttgttgaatgtcccctaatttaggtttgtctgatgcttgcccatgataagactagggttacaggatttgagggagaactccatagagtggatgtgccctttctttttttctttatcatttttttgagattgaaactcgctctgtcgcccaggctggagtgcggtggcacgatcttggctcactgcaacctctgcctcctgggttcacgccattctcctgcctcagcctcctgagcagctgagactacaggcgcccgccaccacgcccggctaattttttgtatttttagtagagactgggtttcaccacattggccaggatggtcttgatctcctgacatcatcgtgatccgcccgccttggcctcccaaagtgctgggattacaggcgtgagccaccgtaaccagcctgccctgcgtaatttttgttgtcgatgatccaaagtgcacccactcgccatctctggtagctgggaggagcaggtttttgggtgaaggtgaaagagccggagttggggatgtgtgtggctggggggtacaggtgcgaccactttgcagtccactcctgtgagtagggcattcctgagggagagaaggcctggttagccctggggctccttcaaggcctggccccaggccttgatacctagagcagcctgacacatgtgtggatggactgccaggcggtccccttaggaggggctgttctagcagggaccctggcttgggtgaccaccacctcctgccacactccaggatccctgtccctgctggaagccgggcccagggccatgccagccgtgaggggttcctcatgagcctcctccccgggacccaggccccatgcagctgccccctcccacctgcctgacccccctggcctgcacttccctccatccgaatcctcaatctccgcctggaattcccttccctcctcaaccccacctggaaactctcctcctcctcccacacagctgggactccctttctcccacctctgggggcccaaagctctggatgccaccctagccctcagctggcctcacctgtctcctcatagccccacagcttgatggtgtctgtgtgggcagcgcctcaacgtgccaggtcaggctgaggttgcctgaggtgttggcggtgccgtagtattgccaatgcatctcgttcatcaactcactcttctccttcatcaacactttgttggggtgcactgggcaggggaggtgaggggtgagtgagggctgggcccagggaagcagggaggaggccctgaggcttcaagggctgtgggagcctccagggccaatgcatggcagcagctgggtgatggtctctccggccctcatggcagaaaaggacgctgaggccggagaggcaggggcctgccctccctccactgcccacgcctctagcctccacctggcttctcccctgccctggtgtggcggagctcagtggataggcactggcccacctctctagggacccctgcagctcccactcactctgggctgggaccgtggtctggatgccagggagtggaaaggagctgaaggaactctcgcaggcgggcaggcctcccaagggattggttcagccagagaggcaggacacggacgggccaagtctcggtgtgcatagattagcgctggggaaagtccccgtgggggcaggctgtgggcagggaggagggctcaccagccagccaagtgcccgcacgagggaaggagtggccatcgtccagtgagatggtgaaggggacgtggccgctctcatagagcaggggcgacacgaagtgcacttgcccggaggagtccacatggccgagggtctggatgctctcctgtggcatgcaaacctgtgggcctggtggtggtaggaggtgctgggccactgcaggctgagcatctcgacagtctgggcccccaacctccctggggaacccatccaaccagctgtcctgtgccctcctgcctgtcctgggtctgaggggctccattcagcctgccagtgggtctgagccctcagcatgcacagggatgggggcgtggggccccagtgcccggcctcctgggcctcccaacctgcagatcacactggtgtctgtggggctggacatcttgaagtgccgcaccacaaagtccttgccgcccatcatggagactgagtagggcaatatctccaggcagaagtcctggaaatccaagcagcaggtaccaaggccggagcacgtcgggtggcaggaacatggcctgtccagggcgccacagcgcatggagcagctctcttgggcatctggaggagaggatgctgagggcctggcctggcgggtgctggactggctgccccatgtgcagggcctgtctctgtttctcccacagcccattagacagcagcatccccaggaaaatgctggccgggaactgcacaggccaccacgttgatatggtagaaagtcacagggcccgtggggatgggatgaatcttagcatagaccatctggctgttgccctgactgatgggctagaatgcagcgagaagaggcaaaaggctgcacccgctcagccctgcagggtcaggagaagccccctgggcatgactgcccttcagccaccaagtcctctatcccacaggcgggggtcctcagagggccacggtagctggagccctcgacctctcttggctccccagggtgtctgtgaacagtgcgccttctgggggccctgaagactgcagaagaaccccttttgcttgcctggactggggtgggggatacagctgccaagagtcccattcgaggcctggtagggaatggtgcagggtctgaacttgacccttctcactctcccaggggctgcaattgagaccccaaagagagctccgccctcagggcagaaggccagggctgctcccctcctttctggggggaggagggacatttcaagcaggtgtcccagcagtggggaaagggaagtgggggtgcacactgcgaggggctgtgggtgctgggcccaaagcatctcctatgggccatgacacccacggcagggccacatttccagggactggcatggaggaagagttgcagggagggactggggcaggtgcgtgcccagctgggggccctgaagggagacaggtcccatccccgggctccagagatgccaccacccagggaagccttggctgtcccagccacacctaatcctgccgctcagagtttgcataatttaatcagtgttcacctcccttcttgagcagatgaggaaactgaagctcagatgcggacaggcaaggccgagccaggcccttggtggcttctgggagcccctgcagccagggcgggtggtaagggctgtggcctgggactggtcacttgggccctgccacctgggctggacgtccagacaggcgggtggtcctctcccagctgcagcttctcaaggtgtccaaaagggacccttgccacacttgcagggagtcagagctggccccagggcatgagcttaggccatctggtctgtgatctgccccagcgcttgcggccaggccagcccattgttccccagcctgttctctctcttgcctgggtggtgcctgctgggaaccacagggtgttggcagccacccatggctccagagaggtgggcccctactgaaagtgttagaggcatgtgctgggggacttggctcctgagtccccacacagagctgttccagggaagccacacccgcatttgatgtcttcccacctcccaaagacatttggtgagaggcccccaagaccttcagcttctcaggactgtttccagaggggagaaagtcccttaacccacaacggtgctcagggtacctctgcaggtgagtgtcctgtaagtggatgctcaggcgctgagccacggagagcctgtctcctggccccaggctggcgagggcattcatcccaggcccagggctgaggttgctccctacagcactgggtgcaggtgtccatcctcctgtaggtgaggctccgggtggttcgtctgagacagttcccaggaactggaggagggagagctgctgcttcctgtttctggcctgggaacccttgctgtgcgtgtctggagacgatggaagtccggtaggggctaggtgtgcagtctgggaagctccataccacaggccctgccgtcagctgagtaactgaggctggctcatctcagccccccaaaggtgggttcagccagacccatatggggccgccaagcctctggttccaaaagggcagtgcccagccctttaggcctttcttcttgggtggtgggtgtgtccagcccatgaggggcacagggcagtgaggagggtccccatctccatcctggacagagagcctgctccatgggaggtcccaggggccaggagggcccctgtggtgctgggaggggaagagagttgtgaagggtgggtttgggtccctggaacctgtgcatccccaagacagatgggcctggagccttcgggggcggggccagctctaggggcttgtttaatgctctgtggtggctgccttaaaatacttaatcatttttggtcaggcacggtggctcaggcctgtaatcccagcacttcgggaggcctaggtgggcggatcacttgaggtcaggagttcaagaccagcctggctaacatggtgaaactccgtctctactaaaaatacaaaaattagctgggcgtggggacatgtccctgccccctgccccttgtgcccgccctctccctccccctgccccttgtgcacaccctctgtaccccccttcccgccccagcctgtgtttgcagtgctacagggtggctgcagccttcgcctcccacagctcctcaaggtcagagggctgggaacccctgggatgtggctgggatgaggaccctgcccctcgtcaggcatttccaggcaaggggcacagagacacagccagcccagcagctgagcccctcctatcaggccaggtgggaaactgaggcatgaacacaaccccagactggaaataacaaagccatcatgtactgtgtgcctactgaatgccaagccctatgccctattctttaatgtcatctttaatgagatgtcttcactcagttcaccacatgatagtagacaggtatttatgatgcgcctactgcatgctgggcacttttctgggccatgaggactcagggaggtccctgctctggtagaagtcaaacccgacaggagacagagactagggccccacacaccaggaggaagaacccagtgcagagagtgccagcaggaagccacaggggcagggaaggcgctcctgggagggtgggtggctgcgtcctgaggctgagcagggggagccggcctagggacaggatgtgcgcaggcgtggagcaggaagttcctggaatgatgggcaagagggagcaggtcactgggggcaggtctaaatactgggggctgcattgggatagcagaggcctcggacaggcccgctcagcatgtagactcccctccctggccccttccctaggatgacagtggaggtccatccccaggtggtggtgaggacactcctgacacagagaccccagcccagctggcaggggaaggggagccctcaaggacccctgtaggttggggcatgtcccgccaggcggccctccatggtgcccagcagcagccctgcttgcggaccctctttagtccccactgttaaaaaaataattcagtgaaaattgacactagctgggcatggtggtaggtgcctataatcccagctactcgggaggctgagacgggagaatcgcttgaaccagggagtcggaggttgcagtgagccgagatggcaccactgcattccagcctggtgacagagtgagactccgtctcaaaaaaaaaaaaaaaaaaagaaaagaaaaaaagaaaaatgacacttgccaaagcgccgtagggaagactgtccaggaccgtgtcactaggcataagggaccacggcgatgagattctgcagtgggtaagagactgggctcagcctcgaagacagcatgggcaagtgggatcggaccgtcaaggagcagggggaagactatccaggaccgtgtcactaggcataagggaccatggcgatgagattctgcagtgggtaagagactgggctcagcctcgaagacagcatgggcaagtgggatcggacagtcaaggagcagggtggggggcagtgcatggaaagtgactaagaggaagcatcagcagccagggattctggcttaactcccctaacagaattcttgctgaaggccggccaggatggccagaccgcacctgggggacagagggggaacccgatcagatgtcaaggacggggggcttctcgctaaactgactttgcagaattcttgctaaaactagagtttataaggaagtgctcagatgtgcctaggagaaggctcaggagcctaaataaagcttgaccaagcagagaatctttgtcaccagcttggtgagagtgaggcccagagtgggtcagggcttacctgctcaggttgtacaactgggaggggtccgtcaggagcctggagtcttcccactgggggctgagtctgggccctcagggcacatataggtagatgctgtcaggcccgacaccccatgcagtgcagactgggatgctggtgcctgtggcacagactggtcagacccaccccaggctagacattccttgcagggagagctgaggctgttgatgccaggaacagacaaacaaggtcatcaccaggtaatgagctcgttacccacatcaggcaaggccattgctgggtaatcatttggcctcctgcagagccacctgccctgggacggttcccagagatctggctagccagtgccacaggaggccggggcacagttccagggcctagtgggcaaggcaggggtattcagggacaaggtgcacctgagtccccacaggaagccccagaccctgcagtaagacctggaacaagtcattctcctctctaagctctcaaagaagaggtcagctcaggggtcggggaggcaaggtctcctagagtagactaagctggccgctgccatgctaacacacaccctcccagccagccgctggtcctgacagatgaggaaactgaggctaggtgttttcatgaggcctctgaacccagaacccagtacccagtgtcctgagcaaagcccaagccagacctgccagcttatgtgtacagaggccccactatgcagcctgcactcctggggcctaaaaggaccatcacctccccttctaagaggctgggcacaggggctgggtcccagccaggccacccttcctcctcctccaaaggcccagcagcagctgctcccagagcaagcagcacagtcgcagcaaaggctggacaagtgtcctgtgctctgtggtctgagcagagggccaggggccgtgacccacatggcccctccaggagcagctccaagatgagccttcctgtccccaccagtgtgtccgggacctcagggtggatcagccgcacctgccggctgctcctgttccttgctcttcctggggctccccaccacctttgggaggcagctccaagaccctgctgcctcccttgcttaccctcaggcccctgctgggtgtgccccctccccacacagacccctgagccagcttcgaggactctgcctgcatctccacgtccactctgatgactgtgaagctacagtcacactctctgcctccacccccgccctgccgggtccctgcagcagctctcagaggcccccacagcccctcccacacacagagctcgcctggccctgccgtctgagcgctcccctggctcccaaccgcccttgggctctgggacataaaacctccagccaaggtggctgccaagttttatttaatagccatagagcacaaaagggatgacaattaagtcacacggagagactgccccatcgggacccctggccaagctaagcagaggagccctggggtttcctctgaccccccactgtgaatgcattactgacgggcaaggtggccagttgcccacccagcctgcacgtctgcatgcacagagctacagcctgggcccagggacagccccgggagccggtggcttcccacaggcacagccagcctccccacccccaccatgcctggcccccggcccagggcacactgaggggaacaggaggggaaggagcaggccctgcactggagcctcagtcagctcctctgtgccaggggcagctggagctggctgaatttgaggaacttcccggaggaactggagagcagacctgtgtgcgcgccccgctctgccacgttccctgagggacacactgctttgaccagcccccaccccatctcctctccgccagtccccggtgtccaccccagccccgctaccgatgaagctcaagccagggtccccatcacctgcttcacggccatccctgcacttgagctcaggggctcagggttgtgctgacacgcctgcctgtccacccctcaccgacacctctgcagtcctcctcagggcccaacagggtccccaggaccccgctcccattctgcccttgctcctgccaacctgtcttctctatgcccatgactttgggaccctctgccataagtaccagcccccacatctgtagcctctgcaggaacaagccctaatctggactcattgcaatggctcaggttctcttccagcctgtccatagacctccaggcagagatcacaaaactaacagctctttctgcaaatctggactctctcctgcaccttcgccaccatccaggcctccctgtcactcctcctggggacctcagagatctcttcatttcacaggtgaagacttggctcagagagggcagagcccctgggtcacacagcccgtctccagtagggctggggaaaagaacccagggcgctcttgttggcagtgttttaatgactggggggagggagagaatggctaatgaggctctagggatcagcagagccagctgctggaggtcccagaggacgggtgactcagcaggaatgggggagtctgaggggttgacagagtgcccaattctcacctcctcctgcaccttccagggagacgagctgcagggagtgattgagtggatgaacatgactagagggacccagtcttctcctcagcagctgcttgaggacagtattagcggtcccctcaatcccccccccaacacatgcacacatgcactgatctgcaggggccagaccccagtggacccggggacacagcttccaggggctgtcttgccatgtcccttcccagacctgcctggattcatgccaggccaccctccacaatttgctgagggaggccccagggtccagggcacccagagtgctaactagcccctgggggtacagggagaacagcatgctgtgtgggggatactactctgcccatacctagggccctgtggcggccacaggcagcactgcttatgcagaggcactggggtgagaaggagtagggtgcagtagtgagggctccacagagggtggaagggctgcaggggaaggcagaccagcagggatgccatgagggcctcagatgccaggctgcagaggtggaggggctggccagctcctctccccagcctcctactgtaaaatgggagaggatcccagccctgctgattcatccactcactccatggcaagacagccactgacagctgtgtcctggggcccacccgggcctggcctctgtgcaggctagcactcagcatgcttagtgccacactcggcccaggagaaatgacccagccctgggctcagagaccccacagtgggtggatggaaaacagagtcatttaaatacaactgtgaagggtgctgtggaggaggggctcgaggtccccagtgtgggatggggtggtcatggaacatttccctatctaagtgggaaaagtgagagccaccaggaaaatggcaggggttggggggagaggaactgtgcaaagacccagaaggatgaagaagactgttggattagaggaggttaaagacacagacaggcttggacatggtggctcatgcctgtaatcccagcactttgggaggccaagacaggaggatcacttgaggccaggagttcaagaccaacctgggaaacacagtgagaccctatcactacaaaataaataaataaataaaataaaataaataaaaataaaaataaaaaaagccgggcatggtggtgcacgcttgtagtcccatctactcagcagactgaggtgggaggatcgcttgagcccaggagatggaggctgcagtgagctatgattgcaccactgcactccagcctgggcaacacagcaagatcctgtttataaaaacaaaacaaaacaaaaaacccagcttgagatggccagggatttccagaggccctaggcgggccaccttggagagtaagggagaccctgaagagctcgcatggaaggaccagcagcttggggctggagatgccacctggatggattcctccagctgtgtggactaggggacagggtgaggagataatggcctggactacatggaaggacgtcgccctgagccattgaaaagggctgtggggtccatgaccactcctggccttcccttgactatgatggagacagtagcttctagtgtaaaatgtgagctcagttcctgactcgtgtctagcgggtggtgcctggtctttggctggcgatgctccatgtcacctatgcccagaaactgggccatgccctttgtgaggacctgcccacaacgtcgttgttcccgcagggtccccggggaaccgggctgcccgggacccagccctgccagggttccctgcggcccaggccggaacccccagggctttggtcgttcccaaagccgtcccgcgggccccctccacggtgcgtcgcctgggccccagcgatggctaggctgcagcctggggctcccggccatcccgggcgctggcggcggtggaggcagcagggcggatggcgacgcccggccgcccgtgggcccaggcgcgtagtgcgtacagagccagcgaggtgctgcggcgcgtcacgggccgccggcgggacccggggccgcaatccaatgggccgggccgggaagacgcccgagccccgggccggctggctcgcctgctccgccagctccgggccgaagcggcttcgcggtccgaggtgccgcggctgctgaagctggtggagcgtgcgggggccggggcggcgggcgcgggcgagaggaccggcgcgcacagccgcggctccgtgtgctcagtatgcggggagccccgcggcagggccacctacccggcgggggtcctggaggtcagcgagcggcggctgcaggagggactcgcggcagtgcgcgaggagctgggcgccgagattgaggcgctgcgcgcggagcttcgagcggagctggacgctctgcgcgcgctgctgccgccgccgccgccgtccccgcctgcccgccgcgagccccgcgccgtcccccgcgccgcgccccgcggcccgaccctgctgcggacgctcggcaccgtgagcgccctggtcgccgcctccaggcccgcagacgacgccccggacggcccagcagaatgcggagcgcaccgagccccggccaggaagaaccacaagaagatgccagtgccgcctggggccccgcaaggtggcggggactgagggcggccgcacaagggcagcctaggcgaggtgcggaaggcgtcgcgctggctactctggtacccccaggacggggcaagtgagcagatcggtccccctcgtgtagcgtggctctgagtcagaagggtgcccgggtgccgccagttagggctccggtactggagggagggggtgggcgcgggacgggcggagggtgggccacgtgcgtctggggagtgcggatgggagccggggtccttgcgagagactgagtccggctagagaacagggtggagcccctttggaccttagagctgggcctttgggccttgggtctgggtcagcctttgggccagggctgggtcagcctccaggggaacagccgagactcctcttccttggggtgactgcacgttctttttctttcaaggtctcagtgacgaggcagggtctccacgcactggaatagtgtcaaaccacacacaagggcacagaacccagggacacagggcggctgagacacgcagctggtgatggccctcaggacggtgtcaaccagtatgtaatcacattccacacggcaccaattggacagcggcctccggtcagcctcactctgactgcaaccccctctcactggacagcatcacctggacacagagcctcacctagtctgtgtcccgtggacacaactttgctttggacagtgacaccaagaatactcacccctttacttagccagaccacaggcagccaccgggacacaaacatctctccagagtcaccctccacacagactccacagcagaactcccagggaggcactggggcatggcttcagagcaccaggcagcgctccgcggtgcccagcacccgctcagccagggcagcctgcagcggagcctggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcagtgggggaccgcgccgggtcacgcacccaccccctccaggccacattaggctaaggtcactctgtgcattatttcattatttcacacggagggtcgcccacggttgacagaaccacaagctgagccccaggcgcatcagagcgcagtgcacacctgctagggtgggggaagagcggggggctgctgcggggaccgaggctctgggggaggccaagactgtgtgccccttaagaggctgctgtgggccaggcgcggtggctcacgcctgtaatcccagcactttgggaggccgaggcgggcggatcacgaggtcaggagatcgagaccatcctggctaacacggtgaaaccccgtttctactaaaaatacaaaaaattagccgggcgtgatggcgggcacctgtagtcccagctactcaggaggctgaggcaggagaatggcatgaacccgggaggcggagcttgcagtgagctgattccaccactgcactccagcctgggcgacacagcaagaccccgtctcaaaaaaaaaaagaggctgctgtgggcggaagttacccgtgagcggtatggggtgaaagtgggagggtccagcctggggcacggtgtggaacagggtcatctgagggtgcagggcaaagagatcaaaacggggtgggagaggggcagcgcctgcgggaggagccaggcaaggcccggggaggggtgtggggggcgaggggggacggtggctccacctgcacccaccggatgggtatggggtcctcgaagacggtccagagcaccgtgggctcgcagtcaggcggggtcagtgacccagcgaagcgacagtagctcgaggtgttgggccgcatcgacgccagcaggaaggtggacatcagattcactgagagccccaggcggcagagggagggggattggaaccagcctccccgtgccctgctggtgccatccccagcaaaccccccgcccctgagccggaaaacgacccggtggctcctcacctggctcaggcaccttcctcaagcccgacactatggcgcagaagttggtgttgctacagtcctgctcctgggaggggctccaagtgcaaggggttctgagtgggggagtctctgaagagggaactcagctgggatactctaagcaggaggctcccagtggcaggaggcatctggcatctgggaaatggggtggagggttctcgccgccactggccctgccgattcaggcattcccaccgccctatcctcccacagatcctatagaccctagagatccccccatggactccacaggcctagcctgtccacttccaggatccccatggaccccttttttggaaacatacatagaatcacagccctgccttcaccgccagcagcacctccagcagcagggcctgcactcgagcccatcaccgtggcgtggtgcctcctccatgctctggtactttgtgttactgtggaccacatgcatctgggggtaggcacagatgtgggagatacccagctgcccccaccttgctctctctcatctccgtgggagcactccggccaccccaccttgtgcccaagtctacctccatagcctggcgctgcctgtccaggctgtgctctgagtctgctcgcctcgggccccccccccgcccccagctgatgtgcagccgcagtgcgcggtagacaggcaacagcagcccagcctcccaaatctccaggtggttctgaggatcagtgtccattcagagtagcaatgaaggggaggaggcacacgacaccctctctacctcaccacctgcccaccttgtgccattagagcacagggtacgagcagaggcccttcctcaggccaggctgctccccagtggggccccattgcctccatggaatggaacccatggtgtccatggctcctgctggtcagcagagcagagttccacagactgcaggggaaaccctcccccacacacccagcatggcatggaagaaggcagagggcagccctcctggggtggggctctgagcccagctgtgtgtggtcagggatcctggccctgccagagaccctgactcctggtcctcaggggccatggctggttgtgatttgtagggtgggacctggcacctacacagagggcgcatctggactgctgtgtgaggatgctcctttcctgtgaagctagcccctgtggagggtttttggccctgtaggatgtctcagctcccgtgtgtagggggtcctggtccctgtgtacactcaggagctctcatgccctgtgtggggctcctgctcctgcctaggaggggtcctgaccacagggtgctgacctgtgtggctgtcattctccagggtccaagggcctggaggtgctgagtcatagcctcggaagatgaagggccctagggtagagttccgccggaccctgtgaaagtcaatgtcgatgagggactggcctgggcccccacaggcaggggccagcttcttccagtgggtggggactgctggaacaaggactggggcctttggggtgggggtggggtcagggaggcagcctgggggtgcagcagagagtggcccccatacacccagaggatagcccagcctcaggaaacccagctccctgcttcccccacacctgaacaggtcacagcatcccccttctcttgtaccctgcatctggcctatccatctagtctcccggttggctgccccatggtgagatgaaggcaaaagagtctctggcacacagttgcacacccacactgggacctctatcacctgcacacacttgggctggccacagtaacaggcacaccagccttgactgactcgggaccggcgatcacagcaggcccagactcacacacagggggacagtcacgcacttgcacctgatgcccagtcagtctactggggcagacgactacagacagaaacctgcaaaggccacagagtgcagggtgcagactgtctcttggccactcttgcaccactggcacatgctctggtggtcccaggacacagactgatctcactcagcctcacatgacactctgtcctcaccacacttggggtcctgggagtcgtagcaccaggcacctatagagacagtgggcaggaggctgagctgagagaccagtcatctgggtcctctccaagccccatcccatcagctggggtccaagaatgaagtaggccaggggcttaggccaggggaggccagtgaagaaccttctctcctgtcacccctaccccagtattttctctccccagtccctccccactcccagtggcaagacctaaggggtggtggagcatggcaagagggtagattggagaccagacgggaagagtcctggtgctcactctcagagtctgcgccacaccagctgcactgcaaggcgagcatgatgccaggggcgtgcgtggctcagtggcagccgcagctaggaaggactagaaagtggctagacctcggagccaagatgctggcctggctactacatatttattcattagctagctgggctaggggcgtggctattgaggagaggatgggaggggtcggtgcccaggcagggccaccaggaagagcgcgagcgctccaaactcacccaggtgtgctgtggtcccagggctgcactgatgccagcaacaatcgctgaggttaatcctgcaggggaggggtgacctattattatccccacttacagtccaggaaacagaggctggggaccagaatgacacaccaaagccaccagcaagaaaggtcaaatagtgagggcaccttgaaccccagcgctcatgactttcggggcaaggatgggaggaaggtgtaggatgtctcttgccccactgtgggcctggaactgccaccccatcccaagaccacagcctccctcctgcccaggcccccctgcggatccaggccaagacggagccctgcaggaggtcagaggaggggacttctttgcaccctgcgcctctttccaatcgccagagggcagggccctacccacattggggatgggaagtcaaatgcagaagttaggtgaagtcagttcttggatactcctgtactgtcaccctggtcttatctcatgccttagcccaagctgtgcacacaatggggtcctaggtccccctcacctcccagattccaccttcccagggatgggaccccctagaaccctcgggggcctgggcagtggccttgctggctcttgccttcctaggagctgagcaggagctccactctcagcagggcagttcactgcagcctctgcttcctcagctcaagccatcctcccacctcagcctcctgagtagctgggaatgcagacacacaccaccacgcctggcaaatttttgtatttttagtagaaacagggtttcaccatgttgcccaggctggtcttgaatgcttgagctcaagcgatctacccacctcgggctcccaaagtgtgggagccaagatgggaacccaagcatacggccccaatgctgaggctctgaactactgacctgccctcagcactcagccttgggatcatgagtcactgtgcaagggagttccaacatctgcatgtatgtctggaatgatctgagcctgcagagttcctacacactggccacattatagggtggtgtctgtggtcacacagctcaggtcaggtatttattagtacatgaatagcttagctgtgtcatagtctttatgtgaaaggcacataaaaggcactttggcaggctcaaagtgtggggattataggtgtcagccaccgtgcctagcccactggatgacttatgatatcatatgtgacattgtgacatcatgtgagtcagggatgtaccccgttctcagctgctatatgctatgttacagtgacagaatgggaatgaagaatgtgtcccactctctcagctgttgtattatatcatacaaggtgcagtgactaagtgtgtcagctgtgtcctcatcctacatagcatatgagagtgtgtgacgggagataggatgcagacctgagaagcattaaacacctaggcaataaaggtgccagcatcagctgagagcgcaggtagacctcagtcacatttgttactgtgtaactaaaaatacaaaattagctgggtgaggtggtgcacgcctgtggtccccactgctcaggcgcctgaggcaggagaattgcttgaacccaggaggcagaggttgcagtgagctgagattacaccactgcactccagccttggggacagagtgagactgtatctcaaaaaaataaaataaaataatctaggacaaccaagagaaggactcaggctcaccttactctatgtcacatgtgatatataacacttgagggggacacacacttgtcactttgtatcactatgtcctatatgatagccaatgataacccaagagggggaggcagccttgttcacaccatgtcacttatgatattatatgacatcaaggagcccagacctcagttgcattatgtcactatggcacatacagtatcatgcaacaactgacagaagggttgtgggcctgattcacagtgtatgtgagtcacaaatgtcacttatgacaccatacagcaggtgagaggggatagtcattattcacctcgggtcacattgtcacacatgataccatatgatagcagagggggatgcagaactgagttgtattatgtcgctatgtaacctgtgatagatgatagctgatgcgggtgaagaccaaagttacattttgtacctacattatatgaaatatacaacatgcacgagggaggtgcagacacaaatcacactgtgtgctgtatcccatatatgtgtttaatttctgtgtttaagagagctgggttcatgaatgaacgtagtcactgcaccttgtatgatataatacaacagctgagagagtgggacacattcctcattcccattctgtcagtgattgaccacaccttgtgttaactgtatgagccactgtgtttggccgtgtatagcgcacgtggcacattgttcactgatacatatttgctccgtactgaagtgaggcagatgcatgagtgattgagaataatgctaccttggtgaagcattccatttagaagcatgaggttcaggtactaccatcttctgtgatacatatttaaatgttaagtttaacagttaggtctaccatgagtgaatgagccttgcattatctttgagaatcgatgtgtttagcagggtgtggctcatctaagatagccttctttaatgcatgttcactatctgtgtttattagaaataggtttgtgaatgacttagcatagtgttttccctatgaaaccctgtttatttatttatttatttattttgagatggagttttgctcttgcaacccaggctggagtgcaatggtgtggtctcggatcactgcaacctctgcctcccaggttcaagcgattctcctgcctcagcctcctgagtagctgggattacgggcgtctgccaccacacccagctaatttttgtatttttagtagagacggggtttcaccatgttggccaggctggtctcgagctcctgacctcaggtgatcctcctgcctcagcctcccaaagtgctggaattacaggcgtgagccaccacacccggccaaaaccctgttttaagaagtgtgtggtgcaggtactacattctttgttgttccaagttcaaaccctgtgtttaacagagataggtgcaagattgcctaggtgtagcgtagactcttggaaatactgtggttagcattctgtgttttctgtagcatagtttcagtgatgcctgtttagatagtttatcagatctaggtactagtgttatgtcagcgaaacactgtttagctgcacgcggtgcatgtaatactttgttcattgatatttgtttaaatcaatcagtgtttaccagaactagatatgtgagttactgagaatagcctaatctctgaaaatgttttccagcctatggtgcatgtaatatactcttctatggtacctctttccaatgtttttattgtggcaaaatatacataacagattataccatttttaagtgtagaatttagtggtagtaagtatagagagaaccttaaaagcagcaagagaaaagtgacttctcatgtgcaagggagcctctagaagattatcagtggatatttcagcagaaaccctgcaggccagaaggtggtgggatgatacattgaaagtactgaaagagtaaagcctgccaactgagaatactatatttgacaaaactgtccttcaaaagtgaaggagaaattaagacattcccagataaataaaagctgaaggagtttattaccactagacctgaccaataagaaataataaaggggccaggcacagtggctcatgtctgtaatcccagcactttcgggggccgaggcaggtggatcacctgaggtcaggtgttcaagaccagcttgaccaacatggcgaaaccccatctctaataaaaatacaaaaattagctgggtgtggtggcacgcacctgtaatcctagctactcaggaggctgaggcaggagaatcacttgtacccgggaggtagaggttgcagtgagctgagatcacaccactgcactccagtctgggcaacggagcgagacttcatctcaaaaaaaaaaaaagaaacaataaagggagtccttcaagttgatatgaagggatactagacagttgctcagcctgatgaaaatataaaggtaaatacataaagattaaaacctgtattattgtaatttttgctaataactcaatttttaatactttaatggaatttaaaggacaaaagcataataattataaatctatgttaatggatacaaagtatataaagtttaatttgtgacatcagtaacttaatagtggggcaaagatgtaaagagtagaggttttgtatgtgattgaagttatctgtttaaaataataagataactttaagatgttccatgtaattcccatagtaaccacaaagaaaatacctacagaatatatgcaaaaggaaatgagaaggaaatcagagcatagcactacaaaaaatcaactataacacaaaggaagacaataagggaggaaagaaggacaaaaaggctctaaacatacagaaaacaatgaccaaaatggtggtagtaagtccttcctaatcaataatttcattaaatgtgcataggttaaactcccaataaaaagacataaatcggctgattggatttaaaaaaacgggattcaactatatatgctgtctacaagagactcatttgaaatccaatacaaatgggttgaaaaatgagagaatggagaatattccgtgcaaaaagtaaccaaaacagatcaggaatggctgtacaagttatggctgtacaagttgttgggttttatgttactgaagaatgaacagagatgagtaagtggaggtgttatgtaaaggcatactgtactcaaaatctgaagacctgcagcagatttaaattccagctcttattataactttttaaaagattgtgaaaatatcaaaatatagatgaatcaagttttaatatactgtatgatgggtggatgaggctgtccattgtaccatttgtttgaattctcaggcatggtttggcagtgcaagaactctgtaacgttaacaaattcaataaaaagtaaatatatggaaaaaaaagtatagacaaaatagattttaagtaaaaaactattacaagagagggttctgggaagaaagtggagtaggaagcactgggaattcatctccccacctagaaaataatcacactggcagaatctgcctgatataactattttggaactctagactctatcaaaggaggcttgtaacctccaaatgaaggcttaaactataatttttacttaattttggtcaatttcagctcttagctcagcagtggctacccaatccccatgccccagcttcacggcaagaagctttgcatgtgttcctgaagcagcttgtaccaagcttgtgggaacaatcatgggcaataagcactctgtcctccaagtgttagcatctgcgttctggttgttgattgctacttttgattatggaagggcaaacacagaggctggcagccattattgctcacaactccccactccactgctgcaagcccttaccagactgaagcaacttctaggagatagaaaaggccagaaccccatttcccttccccttcattgttctcttttccttttttgggagccaaacattaaagactaggacactcaaaagcaatggcatacccagaggaaattaaagttaccacacatccttggagagaggagtgtgtgcccagggaaaggagcagcttcagacctgagaagacctcaagcttacaactcaggttgatcctcagcatggagacaacctacaacaatgtaaaacataacaaaaccccaaaacagcaaaccctgaggaagaggagagtctcatctccagagttactgcattattatattcaagtgtccagttttcaatacaaaacacaaggcatacaaaaaacaagaaaatatggtatttcaaaggaaaaacaacaacagaaactgttccagagaaagaccagatggtaacctactacacaaatactttaaaacaactttcttaaagatggtcaaagaactgaaggaagatgtggagaaagtcagtaaaattatgtgtaaacaaaatgggaatatcaataaagagatagaaaacctaaaaagaaaaaaaataaataaattctggaactaaaagtgtagtgattgaaataaaagttcaccagagggattcaaaagcagatttgagcaacagaagaaagattcagtgaatttgaagatgggacacttgaaatgatcaagtcagaggaacagaaataaagatgattgttgaatagcaagcagacattgtggaagtcccaaaagaagagagggaaaggggcagagagatcatttgaagaaataatggctgaggctgaacacggtgactcacacctgtaatcccagcactttgggaggccaaggtgggtggatcacaaggttaggagttcgagaccagcctggccaatatggtgaaaccccgtctctactaaaaacacaaaattagccaggtgtggtggtgcatgcctgtaatcccagctacttgggaggatgaggcaagagaatcgcttgaacccaggaggcagatgttgcagtgagccgagattgtgccattgccctccagcctgggcaacaagagtgaaactccgtttaaaaaaaaaaaaattagctgggcgtggtggcacgtacctgtagtcccagctactcaggaggctgaggcagaagaatcgcttgaatccaggaggcagaggttgcagtgagccaagatcacaccactgtactctagcctgggcaacagagcgagactctgtctcaaaaaagaaaaaaaaaaagctgaacacttcccaaatttgatgaaagacatgaaaataaatatccagaaaactcaatggactccaagtaggatgaaaaaaaaaaaaaagactcatactgagacattataattagccagtagggcctcttgaaagcaccaagagagaagcaactagtcacatgctaggaatatataataggattataagtagatttctcatcagacactttggagaacagaagacaatgggatgacatatgtaaagggctaaaagaaaaacaaccactacctctcaaccaagaatcctatatccagcaaaactgtccttcaaaagtgaggaagaaattgggaaatccccaaataaaccaaagttgagaagtttgctaccattagacctgccctgcaagaaatcttaaagagaatcatgcaggttgaaaagaaagaacactagatagtaactcaaagccatatgaagaaataaagatgccagtaaaagtaaatatatgggaaaatattaaatctagtattatcgtaactttggtttaaaactccatgttttgctttctacataatttaatagacaaatgcattaaaaacaattattagtttatgtttatggacacacaatgtacaaaaatgtaattttgtgacattgataactgaaagaggagtggcaaaactgtgaggagagtttttgcatattattgaaatatagctggtatgaattcaagttagagtgctataactttagaatgttaagtgtaatccctatggtaaccacaaataaaacattatataacataaaaaagtaaatgagaagggaattaaaacacttcgctacaaaaaatcaactaaatacaaatgagatcatgcaggaaatggacaaaaatgctgtaaggcatatagaaaatgtatagcaaaatgccagaagtaagtccccccttatcagtaattactttattactttttaaaccattttgttgaggaatgatttacataaaaactgtacatatttaacgtacacatcttgataaatttacaccataaaaccattatcatcaagcctataaacatatccatcaccttttaaaatttccttctgcctctttattattattattgtataaaaaaaagtttttaatggccaggtgcggtggctcacgcctgtaatcccagcactttgggaggctgaggcaggcggatcacctgagatcaggagttggagagcagcctggctaagatggcaaaaccccatctctactataaatacaaaaattagctgggcgtggtggcgggtacctataatctgagcaaagtactgggaggctgaggtgggagaatctcttgaacctgggaggcggaggttgcagtgagccgagacagcaccattgcactccagcctgagcaacaagagtgaaaatctgtctaaaaaaaaataataataataaaagtttttaattaaacaatttaagaatatagtaacattttctgtgggtactatgctgtatagctctccagaacttacttatcttgcataactgaaatttgtacactttaaccatcaacttcccatttccttctcttccccagctcccagcaaccaccattctgttctcttcttctgagtttgacgtctttaggttccacacataagtgagattgtacaatatttcactttctgtgtctggcttattttacttaacataatgccctccagtccatctatgcatagaaatgcaactgatttttggatgttgactctgtatcttgctactttattgaatttattacttctaacagtcttttagtgaagtctttacagttttctatacataaaaatatgtcatctatggagaccattttacttccattcttatttctttacttgcttaattgttctggctaggacttccagtcctattttgaggagaaatggtgagagtaggaattcttgtcttgttcttcatcttcgaggaaaaacgttcagtctttcactgttgagtatgttacatgtggtcttcattatgttgaggtacattccttctgcacctaatttgctcagtttgttgttttttttaatcatgaaaggatgttgaattttatcaagtgctttttaataataaaaataaaggatttttatcgtttattgtgttgatgtggtgtatcacatttagtgactcttgtatgttaaagcatccttgcatgccagagataaatcccacttgatcctggtgaataattctttttttgttttttatttatttattatgtatttatttttttgagatggagtctcgctctgtcatccaggcctgagtgcagtggcgcgatctcggctcactacaagctccgcctcccaagttcacgccattctcctgcctcagcctccctagtagctgggaccacaggcacccgccagcatgctcagctaattttttttttttttggatttttggtagagactggattcatggtgaataattcttttaatgcactgttgaatttggtttactagtatttcattgaggatttttgcatctatgttaaccagggatattgacctatagttttcttattttgtagtgttcttatctggcattgatatcaggataatgctggcctcttagaatgagtttcaatgtgttcccttttcttcaatttttttggaagagtttgagaaggattgttattaattctttaaatgtttgttgaaattgaccagtaaaaccatttggtcctgggattttctttgttgggagatttttcattactggtttaatctctacttattttttctgtttttttttttttttttaattatactttaagttctggggtagccgtgcagaaagtgcaggtttatcacttaggtatacatgtgccatggtggtttgctgcacccatcaacccatcatttacattaggtacttctcctaatactatctctccccttgcccccatcccccaacaggcctcagtgtgtgatattccctgccctgtgtccaagtgttctgattgttcaactcccacttatgagtgagaacatgcggagtttggttttccgttcctgtagttttcagatgtgctctggcctccaaggaccatgaagccaggcggtggtgggggggtgtcctctgtataaaaagtgctgtcccaggaacttcctgacggacactttggggcatgtgagcgattcctggggagggcacctcggccttcctaaggctacccctgcagccagtgctggccattctcaccagcaaccaaccaaaaaacatcagagtccctgtaaacctggttgtgatgataaaaaccaaatgttttctaatctaagacttgtatgcagaacacagaaaactgcagttaaggaacaccctacaaaattgaccaacagtattttccaaaaacatttttcatcacttcaaataatgtacaaaatctacaaaaatcatatttaccaggacacatctgttaaataaaagcattgtttcgtgttggtatacatatacacaagactatgtataacagactgtttcccctccctgcaaccacagaaccatcacacacaggcacagatacacgtcggctatgccgctttccacgaatgcatggaacccaggacgcgaacccacagctcgaggtcttataccttcactactgagctgccgccactgcagcagcaacacctctgcggaggtgtcgctgaagtcactggtgtccctgcccaaggtgtcctggtcctggtcaactctactgattgacccttcgtggatacctcaggtctaaaatcctttcctccgagccagagctcttcctgttgtgcaaactcagccccgtctgtaccttcctgcttggccggtgatcgcagtccttcttcgccagcaagtgtgggcttccaaagacagggctgggcctggcctgggactccctgaaggccgagaaggacaggccctgcagaggcagccccaggtaggggctgaagaggccggtctccctgcccccccaggagacaccctttccaaagtggaagagctgggtggacagcagcggggagaagcccgcaaggggcaggctgggcaggccccgggcggggccctcggaccccttgtctctctctcccaatgccgccccctccacgccgcatctctacctttggagcgcagtgcccatgggctgggcagccgactgtggtgggcaaagtcactccagggcggggcgcggttggcctgggctccagcatccctctcagctcccgggctgggggtcaggaagctccggttcctgcagtccacgtgaaaggtccccctggctcctcctgcctcggtgcccgctgtggcacagctgggccgctgaccaaaagcacttttggcagcaggctcagcccctcgtgggctctggtctttgtaaacgtaaacatttctcttgctcactgagagaccttggcggagacactgccgctggtcctcctgggtggcgcatgatcccctccgccggatcagtggggagccccttcccaccctggctgagcaggcacgctgcgccctgtgctcctgcgctccctgcgcctcgatgccctttagccaaatgtgggaccccccggccctctggctccgtgtgcacatgccaggcagtggggccggctccttcctgcaaggtacctctggcctggctgggccccctgtcccgagagcggtggggccctctgcctgaacttctgaactgctcaccgactccttggccttttccaccaaaaacttcctaatctccagttcgatgctatcgtcgctgtccactgaactgctgttgtcagacaaggagccagggctgggagctgggccctgggactctctggggaatagattctcttcggaggcggaggcagaagcgggtctcctcaccaggaaggccggggcttcgtcctctcggccctgctgccaaagacactggggggtttcttcctggagccctcgcagctgtctctcttggacttaggcagctcttcagcacctgcaggtgcctgtttttccactctctcaggagcctgcccagctgctcctggaagtgcgtctgggaggtgctgaacctgaccttcttcctgcacacagccctgggctccctggacctcttcttgagctttcacttggaccttaacaagtccttgatggctgtgtccaggtccttgtcactgtccagggaactgcttttgtcttcggagctcttcttcttgtctaggtgccttgcctcgtctgtcttaccctggccctgtgacgtgcgagtgtcaccgggcaccctagcggcgccctctcctcccggggcctcgctggctgtgccctggatggaaaggtcccgcccctcatggcccggcccggctctcccctggctgcggtcggcatcctggccaccctctttccccaccacccgcatgttcttgggagtggatggcctcacttggcagccgcctctatgcttccttttgcagccaggagtgggtccagtgttttagagagaggggccttggggctgccggtctggctgctgaggccaggtggtgaaagtgggccctgggcagcctgagggcagctctcacctctggccagcaaacttctagactgcaccttgagggccaaaaacgtccagatttcctgctcaatgctgtcgtcgctgtccacggagctactgtcaccatcagagcgggaaggcacgttgggggagtagaagagtgggcttgcggacagggacccatcgctgccctccatagggccggcaggatcgtcttgaaaatgtccaggactgcttctacacacatcagctcagcggaggtgtctgcctggcaagaggaccattccacaaacttgctcctggaagccgggctcgttggaggtggagctttggtttcctttgggatcttgggggaatggtcagcgtccagatcccctggaccagggtccgtggtcttggtgggcactggcttcttcttgctgggtgttttcctgtgggtctctggcaaggcactttttgtggcgctgcttgtgctgtgtgcgggaggggcaggtgctctttcctcttggagctggaccctctggggcgggtccccgtcggcctccttgcgtgttttctgcacctggtacagctggatggcctcctcaatgccgtcgtcgctgctggagtcggacgcctcgggcgcctgtacggcgctcgtgactcgctttcccctccttgcggtgctggcgttccttttaatcccacttttattctgtactgcttctgaagggcggtgggggttgctggctttgtgctgccctccttctcctgcgtggtcgtgaccttggacctgaggcttctgggctgcacgtttgtctttgctaaccgggggaggtctgcagaaggcgaactccttctggacgcccatcaggccctgccggtgcaccacctttgtagccggctcttggtgggatttcgagagtgacttcgccgaattttcatgtgtgtctggtttcttctccactgacccatcacatttttggttctcatgctgtcttttctcattcagaaactgttcgatttctgccctgatgctctgctcaaaggagtctgctctgctcatgctgactggggaggcagagccctggtccttgctggatcccacctggctgccagggccacaccacctgagccaggtacaagttttggggaacacagggcagttgggcactgctgtgagccagttccggcttacatctactgcctccgcctgcagccctggaaggctgtgcatggctgggccccgctggccccgggctgtgcggctccactctttaccttcaggtactcctggatggcctcctcaatgtcccggtccacggaatcgtcactgtctgaatctagcaccaatgggccaaagtctgcagtttcctcctcccccacggggtcaaagtcagcaacaagaccacaggcagccaacgcaggcagctccttgtgcatggtgggcttggcagcaggcctggcgtcgtggcatccctctgccccctctgcgcagtgcgctcatcgctggtgcccctagcagccctgtcgctctgcagcgtgctgatgagcatctgcacccgggtgctcaccgacatgctctccacgcccttgtcagcctccgagaagcacccggggaacctaaagctccctggtgggacagaggccacccatttgcgctggagagcaaccactggaggagcattcatgagaaacattctggcagatggggagcgacgcgcagaggggcgacactttatttctctgcaggcttcacatcctccaaagattggcaagcagtacccgtgaaataactttaaacctgcaaatgcttctttgcaggtttaaaaggatgactataaactatgacgtcatgcctagattcattcttgacccaaccaacaagctcttgacattctctgagtccaggttgactgtgatgaaaggcagctagtgttcccaaatggcccagggatcaggtcttcatcgctccactcagagggaagcatcctctctctgctttttaaatagacttttgactggggctccagcagcgcggggcgcgcagacctggagttgcatggaggccagagccacgacacccgcctggggaacggagcagccccaggcgctgatccccgtccacctgccccacggagccctcgccgcccgcttgccactgcctgcatggccctcctgtccccggccccccagccctcctttccccagctcccccaccctcctgtccccggcaccccagcttcccagcccccgaaaccgcccccccacctcgacccggcccatgccgcaagtcgcccgctgcgcggacccggcctccgcccgcctcctgcgtcctgggggaggcggctgccgggggtggtgggggagggagagggggaagaggccgccctccgcccgggtgcggggagggggcgcaggggtgtccggccaggccccccgcctccccgcctccccgcagcagctgccccgctcccgggccgcctaatacttttacattttaacttttatactacagtgaaaagtgatttacacaccaccactgcaatattacagtgttatgaatgtgactatatacttacctttccctgtgaacttttttttttgagacagagtctcgctctgtcgcccaggctggagggcagtgtccatgatctcggctcgctgcaagctctgcctcccgggttcaagtcattctcctgcctcggcctcccgagtagctgggactacaggcacccgccaccacgcctggctaattttttgtatttttagtagagacggggtttcaccgtgttagccagcatgatccccctcttctgaccttgtgatccacccgccttggcctcccaaagtgctgggattacaggcgtgagccactgcgcccggcctacctgtgaacttaatatcttaatgttttaatgttgctaatcagaatccttttatttcaacttgaaaaactgccttataaggcaggtgcagtggtgatgaactcccttagaatttttttggtgggagtctgggaaagaccttatcatctctttttcatttctgaaggacagctttacaagttgtggtcttcctgattggcagtttttttcttccaatacattgaatatagcatcctattctctcctggcttataaggttgctgctgagaaatccactgatagccttattgaagtttccttgtatgtgatgaattcctttcttcttgctgcttttgaaagtctctgtctttgacttttgatattttaattataatacatcttggtattatggtctttgggctggccttttttggggcctctgaacttcatgtgtctggaagcccacttgcctctaagaatttggaaagtttttacccattatgtcttcaaatatactttcaggccttttctatcttttttacttctagaaagtccataatatgtttgacccacttcatggtggtgtcctataaatcccaaaggtttttactttataaacttttttttctttctggtcttctgacgggatatttcaaatgtcctgtctttaatttcacagattctttcttctgtttgatcaagtctgcaattgaaattctctattgcattttcatttcattcatttatttatttttatatatttttgagacagagtctgtgtcacccaggcttgaatgcagtggtgccatcttggctcactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgccatcaagtgatctgcctgcctcggcctcccaaagtgctgggattacaggcgtccgccacggcacccagcttgcattttcattttattcattgtattcttcagttctagaatttctgtttggttcttattatttctgtatctttattgaacttttagttttgttcatctactattttcttgatattattgagttgatatatacattctagtaaatttcactgagctatcttaattattttgaattgtcaggcaatttgtagatctctatttttggggggttgattactggagatttatgagtttattttggtagtgtcatatttgctgattcttcatgatctacaaactttcattaatgtctatgaagaagcaaatacctcttcttttcttttttttttttttttgagacagagtcttgctctgtcacccagctggagtgcagtggcgtgatctcagctcactgtaacctccacctcccaggttcaaatgattctcctgcctcagcctcccaagcagctgggatcacaggcatgtgccaccacgcctggccaatttttttgtattttttgtagagacagagtttcaccgtgttgtccaggctggtctcaaactcctggcctcaagtggtctgcccgccttggcctcccaaagtgctgggattacagttgtgagccaccatgcccaatctctttctgtctttatagattggtttcagcaggtacaaaccttttcctgctggatcccttgactggatcacagtcaagtgggcctggagccatatcacatggctgctgcctggtctgcagctgaatctctgattggcaggccgctatcaaggcataggttggtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggcttactaggtaggtccatgggaagacaggactgcctccagaccacagtagagcagggctagagccaagtcacaggacagctttggtgaccacatttgggttcaagattggtggtcctcttattaggagaatggatggtatgtctttcaccaggtcccaggatgggctggactgtgcccagactgtggcaaagcaagactggaatggagtcacagggctactttagtgtccatagctgagactgagatcagcaggcctgttaccaagggcatgtaaaggcatcactgaattcctgggcaggcacgactgactgtggtagagtggggctgaagccaggtcagggctgctttagtttctgcagtcaggaccatggttagaaggcctgttactgggggcataaatggtcatggttcctcctaggtgcttagtggatggggctagttgcaagaccatgatctagtggagctggacccaagtccataggaggacaaagctgctttcagtctgcaactgggaacctgtcactggtgtgtggacctgccttctcaaagcagctctccttggttttgggctttgctagagttttgccacctcctgcctggatattaaaactcttgcaaaggcagttttgtccatgaatggctgccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttccctttcaagggggatgtcttaggattttgtcccttgtcttcatttcacaaatgaataaaacaaccagaccagacataagtaaggaaatacagcacttgaacaacacctgaaaaaacaactagacctaacagacatacacaggatattctacccaacaacataatacacatacttctcaagtatacatgggacattttcaggatagaccacataacacatcacaaattaattctcaataggggctgggtgcagtggctcacatctgtaatcacagagtaatttgggaggctgaggcgggtggattgcttgaagccaggagcttgacatcagcctggccaacatggtgaaaccccatctctactaaaaatacaaaaattagctgggcgtggtggtgtgtgcctgtgatcccagcttcttgggaggctgaagcgtgagaattgcttaggagcccaggaggttgaagctgtagtgagcagagattgtaccactgtactccagcctgtacttcatgacaaagaaaatgtaccattgtaccactgacagaatgagaccctgtcccaaaaaaggaaaaaagctcagtagatttaaaatgatagacatcatacaaagtgtcttctctgaccacaacaggataaagttagaaatcaataacagaagattttaaaaagttcacaaattagtagaatttaaacaacacactctcaaacaaccaatggatcaaagaaatcacaaagaaattataaaattcttaaagacaaatgaaaatgaaagcacactatatccaaacttatgggttgtggccagttgtggtggctcacacctgtaatcccagcactttgggagactgagggaggtggatagctagaagtcaggagttcaagatcagccaggccaacatggcgaaaccctgtctctactaaaaacacaaaaattagctgggagtggtggtacgtgcctgtagtcccagctacccagcaggctgaggcatgagaatttcttgaacccaggaggcagaggttgcaccactgagctaacaccactgcactccagcctgggtgacagaatgagactctgtctcaaaaaacaaagaaacaacaaaaaaacacaacttatgagttgtggtgaaaggagtgctaaggaggaaatttatagctataaacacattaaaaaaagaaacacctcaattcaacaacataagtttacacattaagaaactagaaaaagaagaataaaactaaacccaaagttagcagaaggaaggaaacaatagagatcagggcagagataaatggaaaagagaatagaaaaacaataaaaaacaaaaccaaaagttggttcttcaaaaagattaataaaactgacaagactaaggaaaagggaaacaatctaaattacttaaaacagaaatgtatttgagaatatctttatatatttctgtctgtctgtctgtctgtctgtctgcctgtctatgttttagagacaaggtctagctccattgccctggcaacaatcagatgcaaccacaatcagtggcacaatcggctcactgcagccttgaattcctgggctcgccactatgccagctctttttttttttttttttaagagacaggatcttgccatgttatccaggctgatcttgaactcctggcctcaaggaattttcccacctcggcctcccaaattgttggattacaggcatgacccaccattcccagcctagaaaggattataaaagattactataaataattgtgtgctcataaattggataacccagatgaaatagatgaattccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtctcatgcctgtaatcccaacactttgggagcctgaggtagaagttgaggtcaggaggtccaagacaagcctgggcaacatagtgagtctacaaaaaaaatattgagaatctacataaatatagtgggggtgggggtggggaacaagaaaacaaaaaattcaaagcatagtgaaaagaaatatagcaaaacccagccgggcatggtgcctcacgcctgtaatctcagcactttgagaggccgaggcatgtggatcacggggtcaggagatcgagaccatcctggctaacacagtgaaacctgtctctactaaaaatacagaaaaattagccacatgtggtggcgggtgcctgcagtcccagctacttgggaggctgaggcaggagaatggcgtgaacctgggaggcggagcttgcagtgagccgatatcgcgccactgcactccagcctgggcgatagagcgagactccgtctcacaaaaaaaaaaaaaaaagaaagaaagaaatatagcaaaacacaacaaaaaaattaaaatttgctgggtgtagttgtgcctttagtctcagctactggggagggtctgctggaggatcacttgagcccaggggttcaaggctgtgattaagccactgcactccagcctgggtaacagagcaagatcgtatctctaaaaaaaaaaaagaaaaaagaaaacactctctggccacagatgagagaaggcagacaggaagccagtaagccaagcaggcagagggcaggtggccccagcccagctgtcgggtggtgagcagtgtcagggagacaggagtgccggagctggtgaggttcccaaggaggtgaggttgcctgtggccccctcccagggcacagtcccacccctccagtagtgcactctgtcctccctggtaggtacaggcttttccccaccaccatggtgcagccatgcctgcccccaacaccactggtgcagctccatcctccacgcagtggtgcagccccatcccagcgcccattcgagctgctgtcccattgcagggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaaggtgagtggtcgcaccacagccgtgtggtaggacccatgacactgcctctctctccccacgccccacccctcctgcatctctgctcgccccccatgccacgtctttccatcactgagctcctgaggtgtgtccctgcgtcacagctcaccatgtcctgaaggaggcagtgcagagcaacagggctgaagcgggcaatgctcaagggttggaggaggaacaggagtcatcaggagggagagaggtgcaggagctcagggctgcagggccggtccagagggtaccccggtccagtgggtgaccctgccacttggtcattgaatggccagagctgatgcgtgacgtgaggtccaggctcaggagccctcaccttacttcactctcaccacagccttctgaagcagctgctgctattggttattaaacgctccttgaggtgggcaaagtggctcaggcaggtgttaaccctctgagcccctcagagcctctggggctcagcaacatgcacctggctctgatcaaccagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtaaggggcaggggctggctcactgtgggtgtggggcctgccgtagaggcatcaggtgggctccccagggtggctacagcctcacatatgctttatgaatccattcctgccacagaatttgattgcgggcctactgtgtgctcggatggactcgtgggtgacccccagtcttggcttctgccccacagaactgacagtgtggggaattagtggccaccctcctacctcaggtcctttgcacatgctgtggttcttgagtgctcagtgctgagatgaggaatgcatgggggcattgcagccctcgggcatggtgagatggatgggtgaaagggagagggccaggtgaacagagacctcggccacccactccctgtcactccaaactaacgcttcccagatgccaccctcagccctgcaccacctgacccactcacccagtagttgccccagctccatgctgggtccctataagaccctgtcatatcccttcccgctgaggatcctcacatccctccttacctacttgggtccttggcattcctgggcggatctgcagacccccccacactgaccagtgacctcccaggaggggcgtcagctgcccgggtggtgtcttctctttccctgtgagcattctgcacctctgactcccgctgcagccagtgacctggtgtcttgtctctctaaggggacagagccactgcagcgtgtccctctgccctcctttttggctaaggccaggtccttcatctactcgctggctcggggtgctgttcctacaatgctcctgtctgcctctgatgatttatttctttatcacggattattcccaaaaaaaaggcagctgttattgctctagagacttctatctgctgcctccttctgtcctttgctcctcttagagcaaacatggctgggctatgtcctctctcccttcagggtatcccctcccctgctctatccccatgccaccagatcgccatgtccagcctcagtttccccatcaggccccactcagcagcatctcacacagctcaccacactctcctcgagttttcattttgcaaattttcgcacctacaaaaatgtaaaaaaaacccaaaactgcccaagcatcaatgttcccttttcctggattctgcagtgtggacatttctgccggatttcctaactctctccgtctccacccacatctattgggattcgtgtttttctgagggattccacagtaggttactgatgtcgcacctcagggtgtgtctcaaaagtgagacttgaacatagcacagcaggatgtcggggtgacacaacctgctgtcccttctctttacctacagtaggctcccttggctgttttgtttttgttgtgtttttgtttgtacacagagtctctgtcatccaggttggagtgcagtggtgtgatcttggctcactgcagcctcaacctccagggctcaagcaatcctcccacttcagccccctgagcagctgggaccagaggcacgtgccaccaaacctggataatttttgtattttttttagagacagggtcttgcccagactggtctcaaactcctgggatcaaactgtcttcccacctcagcctcccaaagcgctgggattacaggtgtgttttttctttgagacggagtctcgctctgttgcccaggctggagtgcagtggcgctatctcggctcactgcaagctccgcctcctgggttcacgccattctcctgcctcagcctcccgagtagctgggactacaggcgcccgacactgcgcccagctaattttttgtatttttagtagagacggggtttcaccgtgatcgcgatctcctgacctcgtgatccgcctgcctcggcctcccaaagtgctgggattacaggcatgagccaccgtgcctggcctgttttgttgatttttaaagcccagggcagtagtcttggaaaatgtcccacatcgtggatttgcctttctgtttccttgagggcagattcagacagaacacctttccctgggattggtcagctaatccgtggggtgttgctgaaactttattttattttattttattttattttattttatttttgagacggagtctcgctctgtcccccaggctgtcccccaggctggagtgcagtggcgggatctcggctcactgcaagctccgcctcccaggttcacgccattctcctgcctcagccccccaagtagctgggactacaggtgcccaccaccgcgcccagctaattttttgtatttttagtagagacggggtttcactgtgttagccaggatggtctcgatctcctgacgtcatgatccgccctcccaaagtgctgggattacaggcctcggcctcccaaagtgctgggattacaagcgtgagccaccgcgcccggtgttgaaactctcttgaggcattttcttcggccttcgggtccatcctctctgtctcctctttgacctcctcatctcctcctcgccactgccttggggaccttggccaggctcatggcatccagcagccactcaatgtcaatacctccatgttcatctctcagcccgcccttgcccgtgaacccatgcttatttatttattttttttatacgtgcacccatgctctttgggtctgatgaagtatccaaaatcaagctcctgaccatccccaaaccggccccttctgccggcctcgctagtcggcaccatgcttgattcttctctttctcccacccaggccatcatctcttgcctggttgatacccacagcctcccctttgggctttatccttatccccgtcatagctgccagagggaccctgtgaaaacactccccagcctcctcattcttctgccctaagcctgcatggcacagagcaaaagccagttgttatgggacctaggaggtcctgtgggatgggccccagcctgcatcttcatcctcttctccccaccccactccattcactctctgcctatcgctcaccagcctataccacctgcctcagggcctttgcactgaccatttaggcaacattccaggctcttttcacacgttgcctcctctgagaagccctccctgaccactctgcccatacctcatgcctcttgattccccttacctggcctgtggtttcagcactttccctgtgtgtgtttgtttttcttggcatgagggcaggacttaagtgtctgttccctgttgattccccagtgccaggcatgcagtgcaaattctagaaatattttttgcatgaaagaatgagtgattgaatgcggcaagggtctggaggctgaggaccaggcagacagacattcagagttgctggaacgcgacagagacagggagtcagactggtcatgcaaggtcctgggcctgcccttgggtcctggggagccacggaaggttgtgggtgccagagggttgcggtcagagtcacagtcaagggccttctgagacctgtgccccctccccacctcctcaggccagctctggggtctcagcaggtggtccgcaacatgacctctgagttcttcgctgcccagctccggtcccagatctctgaccacaccactcacccgatctcctacgacaagcccgagttctacacgccggatgacgggggcactgctcacctgtctgtcgtcgcagaggacggcagtgctgtgtccgccaccagcaccatcaacctctagtaggggctgctgggccgcctgggtgggaaagggccaggggcgggtggcccagggactgcccacttatccagtaaggtggctccatcacctcttttcctggtgggaaactgaggcccaaccttggtagcttatcctgggcctctcagtgagtatgtttgagcctcagtgggtggatagggaccaggctgggccaggcaaggtcgggtgctgtctgacctggctgggcggtagctttggctccaaggtctgctccccggtcagtgggatcctgttcaataatgaatggacgacttcagctctcccagcatcaccaatgagtttggggcacccccctcacctgccaatttcatccagccaggtatggggtggaggtccggggggtgggggactggggtggagaggggcgggtgtcctgggcaggcagctgacgggcatccctgtcttctcccatcggccgcagggaagcagccgctcttgtccatgtgcccgacgatcatggtgggccaggacggccaggtccggatggtggtgggagctgctgggggcacgcagatcaccacagacactgcactggtatgtgtcaccccttttctccctggccctgcccactctgcacagcccccaagccacgctgatcacactcccatgccccaggccatcatctacaacctctggttcggctatgacgtgaagagggccgtggaggagccccggctgcacaacaagcttctgcccaacgtcacgacagtggagagaaacattgaccaggtgggccgggggttggagaaactgagtcacggtgtggggtcccagggcatcctgggctggaggcctggatcatcacagagtggacaatggttggtgtcctctctctagtgcctgggccatctggagcccctgtgacatgagggccaagccccctgctccagtgagacccagcaggccccaacctgctcttcctgatgacctggcctgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactgagtgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgtctccccactctctgggcctcagtgttttgtgtgtgaaatggagccatctggctggggaggaacagagaggtgggattcggagatcttcacaatgcggacactggaactagcctcagcatcttcagcatggggagagccaggcacatggctgggggccaggggaaggttcacaccaaaccctgccccttcccaccctgatccctcagactttggggccaggccctcccttactggggctgggcagtgacactacctaggatcagccaccagggggtgtcacgaccctggcgctttcttaggcagagggtggccagccgatgctgggaacccgggcgccttctcagacccgtaggcgtccagctcaccctgccgatgacactggaggtgaagctgagggtccgaggaatggggactgggcaacaggctggaggaaaacatctcggtcagagccatgcccctggggggttcccaagagcaagcccagagtgaaacccaagcttgtgatcctctccagagggaggcctggttctcagggaacagcaaacgggaagatgtccccagatcccagggatcagggcttggaccagccggggacgcagcccagagggagtgggtccggaaggaaacagctcgacacagcagccttcaccatcggcagcccctccaggcctccctcggggcctgctccctcctctgtgcacagttccaacacctggagcagggttctgggaagggctggtggaggtgggctggtgggaggcggtgatcacagcccagcacctggatatcaccaggggcactggggccaggggccaggtgaggccaggtcggggctatccttcaggagccccgaaaacctggtgattccaaagggcccatagacaaacagggttttatgcctgtggagtcaagtcccactgggtctgagctctggagggctgtgtctctggggctctgcaagggtgagatggaggtgggctcaactggtgtacaagtcactcttcaatccttattttatttatttaatttttttaaaaaaaatttaaaccaatagagatggggtctcactatgttgaccaggctggtcttaactcctgacttcaagcagtccccccatctcagtctcccaaagtgctaggattacaggggtagccactgcacccggcctcaatccttatattggcctgagaggaaaggccgtggccccatttgcaggggagaagactgaagctggaggggcaggccttgctctgggttgcacagcaggaagagaagtgggagctggccacgaggcttcctggacccgaaatgctggtggggtacaccctggttctctaggtcccatggggctcagcccaggactacctcggggggtgagggacttaaatcgtctccttcattctcatcgccccttcccccatcatttcctgaggaaggacattcagggacctgaaggggtggcctgcccctccccacctgtgggtgtttctcatcagctgggacaagagactgagaaaagaaagagacacagagacaaagtatagagaaagaaaagtgggcccaggggacctgcactcagcatacggaggccccacgctggcaccagtctctgagttccctagtatttattgatcattatctctaccatctcagagagggggatgtggcaggacaatagggtaatagtggggagagggtcagcaggaaaacacgtgaacaaatgtctctgtgtcataaacaaggttaagaaaaaggtgctgtgctttgatgtgcatatacataaacatctcaatgcattaaagagcagtattgccaccagcatgtcccacctccagccctaaggcagttttctcctatctcagcagatggaatatacaatcaacactgagacattcctttgcccagggacgatcaggagagagatgccttcctcttatctcaactgcaaagaggccttcctcttttactaatcctcctcagcacagaccctttacaggtgtcgggctgggggacggtcaggtctttcccttcccacgaggccatatttcagactgtcacctggggagaaaccttggacaatacctggctttcctaggcagaggtccctgcggccttctgcagtgttttgtgtccctgcttacttgagattagggagtggtgatgactcttaacaagcatgctgccttcaagcatttgtttaacaaagcacatcctgcacagccctgaatccattaaaccttgagtcgacacagtacatgtttctgtgagcacagggttggggctagggttacagattaacggcatctcaaggcaaaagaatttttcttactacacaacaaaatggagcctcttacgtctacttctttctacatagacacagtaacagtctgatatctctttcttttccccacagggaccttcctggctgtgcctcgggtcaggaccagaatgacacccattcatttccctgggcctttgctcgggcggtccctgcaccctggcctctgcctgacgaggatggtggggagaggagggggacgtcccccacactgctgtctccactgttcctgctgcccaggcctctgggcttccaggactgcagcgggtcggtgggtgggctggcctgagcccaggaatgcacttcagctcctggttgagcaatgtcactgaggcttgggagtcgggtgggggcgggaggaggcgtccgcaggcccccctaccgtgagaggcagccgtgggaacagcctacctctaaacaatcactgcagcccaggctggccaggggctctggccggacataggggcctggcaggctgtgtgccctgtaaggacacagtctgtctctgtgcctcagtttctctgctgcccagatggaggggcccagactccaggtgtagacatctggagcaggcagtgttcagttggggaggaagcggggaggactgtgggggccatgtgggaaggattccaccccacatcacctgcacccctgctgagcctggtcaacggagcccctcagtgggtcctcactcccctggttgcctcccatttaggcaccctgaggcctggggagaacagagccaggccagtgtccccagagaggctgcgctgccagcacagtagtagcggatttggattcagggaagcagacctgcagccagggtgggaaagagctgcaggtggggtggggcccccacatggcacagcccccctccctggaggaccatgctgcatttccaggacagcaagtcccagggatggatggtgcctggtgccaagggctagaggcatggtctgtctgcatttcccacgtaagtgtctcgtagtcactagcatttgatgctgtcaagaccccctgtcctctgtgcagactgggaagcccttggtcaccctgggggagttgggggacccaggccaggctgcagaagcataaggacttgaacccgggtcctgagtgacaccaccttgggtcctcctccttctgcctctgttcagctccaccttgatgctgactaggctgggccatgcggagagggttaggggatagagatgggagctggggagcagggctccactctgggaggggggcagccttgccggatccagggcagagttaagcggccccagctctgctttcccagagctgctgagaacctggggaatggtgtggaggttccagggagccctgcccctacctggcaaccgcagtgcagcacgcaccaagttctcctgcacattgcgacagtgtgaccatgggctctggtgggcggtaggtcgggcctttggacctaccagcagtgagggagttaacacagcagctgacttctctaggcaaagaaaactcccctcagacgctttgctgcctggcctcctgccaggaacaagcaggagctgaaaactagaagttgaggcatgagtttggccactccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctgtctgtcgatccatcttcgtgtctgtcttcagcccccacctgtttgtccatctgtccaattacctgtgagtctatctatgcatcttcttgtccattcatctgcccacccatctgtccctccatctgcccaccggcctcccctctccttctgggccgcagagccatggcccaggactacggagccatgggtgacctggtcctgctggggctggggctggggctggcgctggctgtcattgtgctggctgtggtcctctctcgacaccaggccccatttgacccccggcctttgcccacaccgctgttgctgctgactccaaggtcttctcaaatattgtacggtgagtgagacgtgggaggaagctgggtggcctttggcagccagcccctcctggagaaggcgtgtgtgtgtgagcatgtgtgtgtgtgagagattatgtgtgagtgtgtgtgggtatatgtgtgagtgtgtttgtggggtgtgggtgtgtgtgaatgtgtgtgatcgtgtttgggtgtgtgtatgtgtgagtgtgggtgtgtgtgaatgtgtgtgattgtgtttgtgtatgtgtgtgtgggtgtgtgtgagtatatgtgagtgtgagtgtgtgggggtgtgggtgggtgtgaatgtgtgtgattgtgtttcgctgtgtgagggtgtgtgtgactgtgagtgtgtgagtgtgggtgtgtgggtgtgtgtaaatgtgtgagtgtgagtatggggggtgggtatgtgtgaatgtgtgtgattgtgtgtgggtatatttgtgggtgtgtgtgtgtgtgcacgtgtgtgtgtgtgcacgtgcactggcccaggaagcaggagccgtgtgtgtgggcttcagcacctgcagggcttgagcgcaaggagacagcctcagggcccttgcacagaacaggcggcagggtgtgcccgtggggcagatggggacttggggacaatggtggtgtgtgagtccatacctggctccaggattcaggaggcccatttgcatatcccaggtgggaacctgtctggccccgcctgaccctgctggccggtgcaggccccttcagtgaggccaattctccaaggctgcggtcttctcccagggtcatgggtgaaggggtttggaggctccctgcgtgggtactggcctgctggggtacacacaatgctgccatagccagtctgcccctacacccagcccggggccacatctcaggtctctcagtcctgaggagcccggtgccccacccctcacatcctctctccctgagtcagggcctgggtctcgtgagctgagtgactgatacttggtgtcctggatgagggcgtggtggagaggggccacagcgggtgtttcctgaccctcttccaggaaggtgctgctgccgctgcagggaggacacacacaggatgccccttcttgccccctgcctcccattgggcccacaaaagccagggcaagcctcccctccctgccagccacctggtctgcttcccagaaattctgtcttgcaggctgttgggaggatcccagtactttgtaaactaaagcaagggaggagtggccgttctctctctttgttcattcattcaccttttcattcattccttcttccctccattcccccatctgtccatccttccctgccctgattgctcatgccacccccccagcccctcctgacctggtcctttggtttctcttcagggctttctgtctcctcccacagggctgagaatggcagctcagggacaagtgggggctggggactgcttagtctccccagtggctctcaggggatttgagggtttgacgtcagctgccaccccaggctgtgcccctcctctgctcgggaggacatacagagatgcgacacccacttaaactcgaagttgcaaagatgcaaatgagactggggtctcaggcaccagagaccacccgtgggcacgtggcttttgggagtggggacctgctgccacagatctctgaagagtctggacctgctgggtctccccgagtgactgtctgggggtctccatagcatgccctgctgtgtgcgtgacggtcactggttgggtaggggtctctactctaaagctccctctgccggcatcccctcgaactctcccttggtgaagagaggatgtggtttgccccagtgttttatcaaacaactctctccacttccagttttaagaagctgggagtggaagagagcctggggctggccccagctgctgctgtgaaacaggggtcactggacgctgggaccctggccgggctggctggaggcctcaggaagaggcctgctacagcgtcatcctggccaagattcctccctgcagaggaccctggccacgctgccacagggtctgctggggccaccagaagcccatgctcctgcctccatctctcccctctgtgctcacctctcaccaggaggccctcccagagttcagtgtcctgcttttttttttttttttttttttttttgtgacggtgtctcactctgtcaccaggctggagtgcagtggcgcgatctcagcttactgcaacctctgcttcctcggttcaaatgattctcctgcctcagcctcctgagtagctgggactacaggtgccagccaccacgccccgctaatttctgtatttttagtagagacagggtttcaccatgttggcccaggatggtctctatctcttgattcacccgccttggccacccaaagtgctggcattacaggagtgagtcatggcacccggcctcatctcctactctttcagcaccaggttttattcttgggattctgctacagccggagcccctgggtgcgagttcctaaggtttctgtgagtgtggacccagcaccgtgcctagtagacatacaaaaggagcatggtgacagtgaggtctgtcatctccagcataatgactgttttgatccttgtaaaaaaggtgatttttggctgggtgtggtggctcacacctgtaatcccagcactttgggaggccgaggggggtggctcacttgaggtcaggagttggagaccagcctgggcaacatggtgaaaccatgtctctactaaaaatacaaaaattagctgggcatggtagcaggtgcctgtaatcccagatacttgggaggctgagacaggagaatcacttgaacgcaggaggcaaaggttgcagtaagccaagattgcaccactgcactccagcctgggtgacagagcaagacttggtctcaaaaaaaaaaaaaaaaaagaaagaaaagtttatatttttgttctaatgcttatcttaatatcgtcattctataattatatgttttatataattataatagctatataagatataatacccctagtatgttgttttttggatattctacttgctcctgatggttaatttatgtgtcaacttggctaagctatggtgtcctgttgtttggtcaaatacttgtcaatatcttgctgggaggttatttcatagatgtgattaacactgacagtcaattgactttaagtaaaacagattacccaccataatatgggtgggccacctccaatcagttgaaggccttaagaacaaaaactgaggtttcccagagaagcaggaattctgcttcaagactgtaacacacaaaccctacctgagtttctggcctgctgactgctctacagattttaggttccagacttcgagatcaactcttacctgaatttatagcctgctggcttgccctacagattttaaaacttgctagtccccacaatcatgtgagccaattcctaaataagtctctctctatgtataatctattggtttagtttctctgaaaaactttcacattccagtttcctggatgttaagaattaccgaaactagctagtaacttctttttttttttttttttgagacagagttttgctcttgttgcccaggctggaatgcaatggcacaatctcagctcaccgcaacctccacttcctgggtccaagcaattctcctccctcagcctcctgagtagctgggattacaggcatgtgccaccatgcttggctaatttttgtatttttagtagagacagggcttctccatgttggtcaggctggtcttgaactcccaacctcaggtgatccgccgccttggcctcacaaagtgctggaattacaggcacgagccattgcgcctggctcctagtaaattcttcttttctgtgatgtgtcccttacctctaataatacttttcttcttaaagtctacttcattaaaaatagttatgctgggcatggtggctcatggctgtaatcttggcactttgctggaggtcgaggtgggtggatcactgaagcccaggagttcaagaccaacctgggcaacatggcgagaccctgcctctacaaaaaatacaaaaattagctgggtgtggctagtataattctaagttggcacacttgtagtcccagctacttgggatgctgaggtgggagaatcgcttgagcctagaagggagagattgctgtaagccaagatcacatcactgcactccagcctgggagacagagtgaggctctatctccaaaaaaaaaaaaaaaaaaaaaaaaaaaaagttatacagctttcttggttagtacatgcatgacatatttttcatgatcttccacctctctgtacccttatataaaaggcattagttgggttttactttattttcaattattttaatttttattgtccttttaaatgtaactaatgatttatttgggttgaaacccaccaccaatttgttttccatgcctattctatttcttcttatctcctctcacatcttgttttggatttattatttttattatttaatttcctccttctctattagtttcataactgtgcagtcttagagttcttttaaaagatgactggattattttagagcttacaacatgcatccttcccttatcaaagtctaacatgagctagtactttttgttgtggttgagatagagagagtcttcctctgctgcccaggctggagtgcagtggagcaatcttggttcactgcaacctccacttcttgggttcaagcaattctcctgcctcagtcacctgagtagctgggaccacaggtgtgcaccactatgcccggccaatttttgtattctttttcagtagagacagggtttcaccatgttggccaggctggtcttgaactccggaccttaagagatctgcctacctcggcatcctaaagtgttgggattacaggcgtgagccaccgcacccagcctatgagttagtacttctatcctcttcctagtcagtacaagaaccttggaacaggaactaaatttacccccagtgacttatatgctaatatttttgtgtattttaaatatgtgtgtgtgcatagatgtatctgtgtgttttttgtgtttttattcttatttatgttgagagtgtagagctatgtaagagtaaagagaattgtgtaatgaagccccgagtatccattcaatttcaacaacaatcttatggccaagctcatttcatgtatactctttcctgcttccctctaccccacattatttccgtgcaaatcccagatatataactgtacccatacatatttcagtatgttttatttcttttaaaccccacaagatatcattttctatactactgtaattttataccaataacattcatttagatttacccacacgtttaccctaccctccgggtcctgtttgaaaatcaagcccatgctcacaggccaatttttttttcttttagagacagggtctcactttgtcacccaagctggagtgcagtggtgcgattatagctcaatgcagcctccaattcctggactcaagggaccctcctgcctcagcctgccaagtagcttggactatagctgtatgttttattattattttgtagacatggggtctggctatgttgtccaggctattctcaaaattcccggcctcgagcaatcctcctgcctcggcctctcaaaggttgggattacaggtgtgaggcaaggcacccagctcagccacagagccctgttgcatctctcttactaggagcaagagctgactgccccctcatccccattccagagtgttggggctgtgttgagccgaggccaggccactggcatggcccaaggaacgggatcattcactgctgccccaaatctgacatcattccaccttgacaagacttcctcatccaatccctttacttgacagctggggaaaccaacgcgcacagagcacccccagctcactcggggtctcagagctgatccatgagcagaggctgagatcctgggatcttgtcccccagccgccctgcaagcttactccctttctgctggaagagatggggccggacctcaaccagcagccctggcctggacatgactgtgctcacccaggtattgaggccgagatgccccggcatcatatgtttttctcttattttttctttttttttgagacagtatctcactctgtcacccaagctggagtgcagtggcatgatattggctcactgcaacctctgcctcccgcttaaagtgattctcctgcctcagtcttccaagtagctgggcctacaggcttgtaccaccacgcctgactaatttttgtatttttactagagacagggtttccccatgttggccaggctcgtgtcgaactcctgacctcaggtgatccacctgccttggcctcccaaagtgctaggattacaggcatgagccatggcatcacttaaacgtagtgagaggccgggcaaggggctcatgcctgtaatcccagtgctttgagaggacgaggctgtcagatcacctaaggtcaggagttcgagaccagcctggccaacatggtgaaactgtgtctctacaaaaaaatagaaaaaaaaaatccctgcgtggtggcaagtatctgtagtcccagttactcaggagtctgaggcatgagaattgcttaaacctcggaggcggaggctgcagtgagctgagatggcgccactgcactccagcctgggtgacagagcaagactttgtctctaaataattaaataaataaatatggccgagcatggtgccttaggcctgtaatcccaacattttgggaggctgaggcaggtggttcatgaggtcaggagcccgagaccagcctggccaagatggtgaaacactgtctctactaaaaatacaaaaattagccagctgtggtggcaggcacctgtaatcccagctacttgggacactgaggcaggagaatcgcttgaacctggaaggcagaggttgcaatgagccgagattgcaccgctgcactctagcctgggcgatggagcaagactccatctcaactaaataaattaataaatacagagcaagattccatctcaaataaataaataaatgtacacctgtaatcctagcactttgggaggctaagacaggtcgatcacctgacgtcaggagttcgagaccagcctgaccaatatggcaaaactccatctctactaaaaatacaaaaattagctgggcgttttgacgtgtgcctgtagtcccagctacttgggaggctgagacaagagaattgcttgaacccaagaggtggaggttgcagtgagccgagatctcggctgcacttcagcctgggtgacagagtgagactctgtctcaaaaggaataaataaaatacaaagtaaaaaaaaatgtagtaagattgcagagtcgtgccgcagaagcgtgctggtcctatccatgtagtgaaggctgatttcatacacaaatgtcacaagaacttttcttttctttttctttttttttttttttgagacggagtctcactctgtcacccaggctggagtgcagtggtgcgatctaggctcactgcaagctctgcctcccgggtttatgccattctcctgcctcagcctcctgagtagctgggactacaggcgcctgccacctagcccagctaatttttttgtacttttagaggagatggggtttcaccgcgttagccaggatagtctcaatctcctgacctcgtgatccgcccgtctcggcctcccaaagtgctgggattacaggcatgagccaccacacccggccttcttatatgcttttattgcatttgagcgtacctcttttacagcgaagatctttttttttaattttattttatttttagagatggagtcttgctttgttgcccaggctggagcactgtggtgtgatcatagctcactgcagccttgaactcccgggcacaggtgatcctcccacctcagcctcctgaatagctgggactacaggcatgcaccaccatgcctggcatattttaaagatgtttgtagacatgaggtctcgctatgttgccaggcttgtctcaaactactgggctcaagccatccatccatttcagcctcccaaagtgcttggattataggcatgagcactgcgcctggccatcacactgtttttttggttgtttgtttgtttgtttgttttgagatggagtcttgctctgtcgctcaggctggagtgcagtagtgggatctcacctcattgcaagctccgccttgtgggttcacgccattctcctgcctcagcctcctgagtagctgggattacaggcgcccgccaccacgcctggctaattttttgtatttttagtagagacgggatttcaccgtgttagccaggatggtctcgatctcctgacctcgtgatctgcccgcctcggcctctcaaagtgctgggattacaggcatgagccaataaatatttttataatcattaactaccgaggagaagctggagagaaaaaaggtggatgaagttaaggcagagagactttgtaagtttcttggctgagcttttggagactgtatatcagagatcctatttgaggtgattttcagctacagagataggcctggtcatttgaaaaataacggattaggtgaagcttgcgtttgaaatcctccttctacttttcatctttctctcttgtttattctgagcatccatcttagacacccaatctttgtcactttgtggttgtcattgatttccctgttattgagattagaggttggcagactttctctgtaaagggctggagagaaagtacttcagactttgtggtctgtgcggtgtctgttgcaaccacttaactctgccctgtagagcaaaagcagccgcagacagtacatgggcagatgagcatggctggggtccagttacatttacttgcaaaaagagggttggagactgggtgcgatctcccacctttaatcccggcactttgggaggccgaggcaggaggatcacttcaagccaggagttcaagaccagcctgggcaacaaagcaagactccatctctacaaaaaaataaaaattattatagctaggcatggtggtacacacccgtagtcctagctactcaggaagctaaaactgaggcaggagggtcagttgagcccaggagcacgaggctgtggtgagctattattgtgccagtgcactccagcctggtgacagagcaagaacggtctcgtcaaaaaataaacaaaaggctgggcacggtggctcccgcctgtaatccctgcactttgggagactgaggtgggcagatcatgaggtcaggagattgagaccatcctggctaacacggtgaaaccctgtctctactaaaaatacaaaaagttagccgggcgtggtggcgggcgcctgtagtcccagccactcgggaggctgaggagggagaatcgtttgaacctgggaggcggaggttgcagtgagccaagattgtgccactgcactctagcctgggctacagggcaagactccattaaaaaaaaaaaaaaaaaaccagcaaaaaccaaacaaaacataatgcatgttctctcttataaatgggagctaaacatggggactcattgacttaaagatggcaacaactgggaactgctggatggggagggaggggaggggtgaaaggccaactgttggggagtatgctcatatccacgtgacaaacctgcacatgtgcccgctgaatctaaaataaaagttgaaagtagatttaaaaaaccccaagagggctgggtttggcttgtgtgtccatagcttgttaacctccgctttagatattaacgaatagaaacatagtgcttaacttcccaggccacctattttgttcctctccaaggtgatggatagatgaaggccttatccagccgcctggaagtttgctgacgcttgtcctgtcacggattaatgaagcattgttttctgatgaaggtttcatgccgctgtgctgatgtgtcttctcttctctctaggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcgagacattagccctttagttatgagcctgtgggaacttcaggggttcccagtggggagagcagtggcagtgggaggcatctgggggccaaaggtcagtggcggggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaaggactttgcagttttaacggggggcagtagggcttgtgctatagaaattcaaaggcaagggaagtcacttctgttgtggggccctgggaggagcctccaggctggaaaggcttaaggtggaggtctccgataggggcagcgtacacagtggactggctgcaaaaggccgtgctcagcattcagacagcatcacacactccgcttttctctaccagggaggcaggtggggaaggatagcgatgggaaggcaggcggagctcagaatgtggaaggggatccagtaaggcttggaagtttgcacctgatctggtgggtggtgaggagcccttgaaggggcaaggaggcgaggagcactcagctgtgttcttacactgatctgccactggggttagagacaaacgtggtgggaatggaaagccacgcacagtcactagcgcctctggggggagaatggatgtggctggtgagagaacaggggggcccagggagagtccggcaccaacctgggcgggggagcccagtgggtgtgagcacccccactttagagatgaagtgatggagacattcagatgtttaaccccttgttcaagattccatacttgataaatggcagatcaaactcccaacataaaatgtgggtcatttctttattattttatttgtattggttaacaatgatcagccatgcaagaataaatgattattgtaaaatctgcaaacaatgtagatatgtagagagtcccttccttggagcttgaccttgtcagacaggtatagatgagtgttccggggcagccgtaaaaactgccagagactgggctgcttataacagaaacgcatggtctcccagaagcccacattcaaggtgtccaaaggcctggctcctggaggctctggaggagagcctgttccctgtctctcagcttctgccggttgccagcaagtgttgccgttcattcactccagccactgcctccatctgcacacagcaaaacagcgtatcctgaagtgctcaaccttatagccattattttaaaatatccggaacacacaggaccgtgggagtggctgttggagaaattttcatgaaggaagaaagattacaactaagttttaaaatgctagttttgtttgttttgtcttggagaggaggtaaaagtgggagtaaaaatagggagtttggtgtaaggtgggaaaagcaaaggaaccccgcatggatgggctgaagggtgtgatgggagaacagtgagaagtacgtttggggaagcaattggaaatagtagctaagcttaatcacaatctatcaaaagggacttgttgaagaattaatgtgtgactaggaacagggaggttatgggcttgtcagctcgacagcgggcactcagttccactaacgaatgatgcccgtgtggacagacagaatgatggacaggcagatgaatgcgtgggctttatgtgaaacaggtcctcttggttgttgacaagatactgttttaaagttccattttgccatacttcgaacagcttgtcattagctcaatttagccacatgtaaaatcactaaggcggacttccagagttcccacatgaaaatcaaatgtaaaccagcagtgacctgcttcaacaccatcatcggaagtcagaagttgaactcttttttgatgtttaaagcctgcataatattcgctgtattattattcagcatattactatttccttcgtgatggaaatttggtttatcccaattttctattccatcaaaacaccgctacatagaaaatccccatgcacatatttctcctaattgtggaaatattttacataaaagactctagacatgggatgaaattcccaggttattggaattttaaaatagataggtacttccaaattgacctcttacaaattatatgaattcgtaagcttccaactgttatggagttacccattttgagaaatctgtgctaaaaggacccaaacaatgctgatgacaatgatcaggataataagtacgctgggaagacaacaaaatgatttagatcttagacaagtcattctaggtgtctccactgtttcagttcttgcgttcgttcattcttgtgctttttcgttttaccaaataaaatagctccttgatgtcataggaatccacgctatgcttaatgagtattggttagtaaaatgcctataactagtaatcttcatctatgcaattaaatattaattcataaaacacttcaaatgtaaacaataattagtaaatgaaaagtacataatacctcaattagaaaaaaatcactccattaaaaagacattatttgtgtgataaaagagattgctatttttgtatttttctacaaggttaaagaaaactaagtcaacttatacaagtgaattttaaaagactttagggcaggcgtggtggctcacacctgtaatcccagcactttaagaggccgaggagggcagatcacctgaggtcaggagttcgaaaccagcctgaccaacatggtgaaatctcatttctactaaaaatacaaaaaaattagcccagtgtggtggcatgtgcctataatctcagctacttgggaggctgagacaggagaatagtttgaacctgggaggcggaggttgcaatgaaccaggatcgcaccattgcactccagcttgggcaacaagagtgaaactccatctcaaaaataaataaataaataaataaataaaataaataaaagcctttaacccagaatgctgagtaaattggccaaaaatgctaacctatgcatttcaatactataggagtcgcatgggtagaaataaccagatgaaatacttctggtatttcaccttcccaacccacacgagccagtgtttttctgtgaataacaaaaacagcagaatttacttgcctcaccataagaggttaccacttctgtgtgttcccccgaaacaggtggtggctgggtgagaaggtggacagcactagggcaggagatgggggctccagtatcgtgggtgagcttcctaaacctctgcaactttcagcccctaaatgggatgagccatcagaatttttagcacaatgcccagaacaaagtaaggatttgacaaatgacgcctctctccacattgttctgtcatcagccaccgcatcctgtacctccaagtccactgggctccggctgtttccatcacatggagaatgactcagagcctggcctccagccaccctcctggcctttctgcttctcactctgccactggctcctcatggaccaccagcctgggtgtcctcagacataccacacacttcactgtgggagtcacgcagccctcactgctccttcgccagggagccacggggctttcctcctcaggaggactctgcaagcagctggatgaagggccctcccgtctctcatccttccttaatttttgtcacagttctccttccttccactcagtgcagcgcacactgattgatcctccatcttccccaaaagacaggaacagcatgagcagtggagagtagattccaatgatagaaaaaatagtcagtgatttctcatttccattgatcatcaatgaagaaaatgtatcctgaaggtcatgtacctcctatgggactgctgcatcctcagcctcctgaatttcagcccagcaccttcctccccagcacagcaacaggtcagcccttaccagcatccctctcttattgcctttgtgcagagccagcaccagggccaggggaggccttgggattgtccctccccaacaatctgtgaaacaatcctttatgtcaccaacaaagcacagccttctgcactggtggtcagtccctctcaacacctctgtcactgtaaagctggcaggcaaccctccaaggttggccttcccaagcactgcacctctaggtgacagagcacgtccttaccttgaagcctgggcgcccagtctatcctgtccaatgagcgagctgtggagaaggggggattccgggttaaggggagactagcagggctcctgcttttatgttgccctgttgggaaggctattaaagaaacacaaagtgctaagcagtgaggatagaacatgttttcattatttcaaccaatacattccacagatggaataataagaaatgctacaaccaagctaactgaatccaacagcatatcaaaaagataatccaccatgattcaagtgggtttcatactagggatgcagggatggtttaacatacgcaagtcaataaatgtgatacatcacatcaataaaactaaaaacaaaaatcacatgataatctgaatagatgcagaaaaagcctttgacaaaatccagcatttctttatgattaaaaccgttcgtcacaatcagcatagaacggacataccttaaggtaataaaagctatctatgacaaacccacagccaacattttcctgaatgggggagagttgaaagcattccccctgaggaagggaacaagacaaagatgcccacgttcaccgcttctcaacacagtgctgttcactacagcattggttataagagcaagactggaaacagaacaaatggatacccatagcggggtgcttaagtaattttgggaatagtcatggggtgcagtactttatagctctgaaacaatacaatggatttacatttgaaatgtggaatgataactaaggtgcattgcccagtgatatatgcagaggtgcagaggactttgtgtaaacacgatcacacatcagcctgcattccaggtgcatgcttctatttgcacatagattgcagggatgatatgcaaacaaaaatgttgacttggtgtttggaagttcagagtggaagggaaacttccttgctaaccttttatgatatttagagtttctaaatgtgaatacgtaatacatttagaaatcttagttaataagaaaagcctctgttcctggcctcttgctggcacatgtcaggtggaaatggggctgtcatgctaatgtgtgcaaactgagaaaaatccaagaatgggagtctgcttttttcatcatacaaataattgttaatagaaacagtatgataattgctcattgatataccatgcatattctattagataataataaatttctgaaatttgaactatacttacacatggaaattgaaatatatggatgaaacattgtggcttatataggcaattgttttattggcattttacaaactgatcatcattcctcatggcacgggtccatgtgatattaagtagcttgttatgcttgggaaaggcagtgatgaccacaagaatgacttcaactactaaagtacaatggagatttcaacaatgttttgtttaatatttaaatatttcattgtgctcccaggctttttctcaccctaatagctctcatccatatcatgtgggtcccattaatacagatacctccgaatgcaccactcttccattatatccagtcaattgctggttaccttgggcctacaactgggggagggcaggggctgctggccacctcctcatctacagtaagagtcaatgagcagttaagtggatactgaaaaccatttatcctgctggagtgagaaataaatggtttctttcaatagcgtagtaaaatgcatcttttccaaactatttatatgactcaaggcccatctcaatttcagatgtggttagcctcaattcctgattctcaccaaggtgtgtaatgtcatccacggcccagtgcagaggaacacaggtgctgccgtcagactgccagggtccaatcccgcctcctcactcaccccgggagatccctttaagccaggagtcaacagtgaggatggaaacatgagtgctttttaaagtcctgaaagttcagaggcagactgtcaatttctcctccacccctgggcacacaccaggagaactctgtctccaggttgaaggaagtgcctgtgagagagttgtgtccctcagattctgttcaccacaggtgacactcgatgcaaccccaaacctcttctgcacaatcccaaggggtgctgactaatccaacccaaaggctgtgatgtttggcagaggcagaaaagaaaaggccaggtgttctgggaaagaccacctttaaatatcacagcaccctcatagcccagagagacagttctaactattatgccaataaacccggaaaagaccaaatccaatatgacacatatttcctgtttccttttgatttcatgccccctcccttaacctcccaagcagcatggataccccgaaggcccctgggaactctctccaattggatcttacgtggaaagtagttacctacctacaaatccccatcatcagatatgctctccacaatcaaatctttagaaacacaaacaccaggataagtcattagagagaggcccacccactcctcccaccctagctgaagccatggtgcttcgcacaggatcccctggtgtttcctctgggctcacagatatccctacagcctctctggacattgttttatacttgcaaaatcatttgctctcaccagactccaaatcctccttcccaaaaggagcccagaatcaggtttctgtaccctagagatggcgttttttcctcaggaagtgagttatttcagggtaggtatcattctccagtgtcaatggctcctgcaattatagaaaagaaaacattaggagggtgaaatgatgccatacacgtcacacagatctgatagtctctcgacaacttgagagagaaaataagaaggggtatagtgattgagtcaaaggtcaaagtcccccaaaactggcacggaagacacctgtggaaaagacaagaccttttcccacagaatttatctttaaagtgtatctagattggcagtttcacaactcttaatccatgggggaaaactgctgtggagggaaacacctctgcattgcagtggatcgtggatgctgccatctaccacaccccagtgtgcctggcatgggttggtgagaggctgccaatcaatagcaccacaccaagggaattgcagatgtcataaatagtccacattggcagatgttcatgtctacatttgattaaactgcagatgacatccataatgcacactggcagatgttcatgtctacatctgattggaaagaagccaggaaagtaacatttctgttcaagacaaagaaaagtgtcttacattggcagcatcttcttttttacagatgtcttgtacagtgtcctcattagcaatgtcatatacagcgtccttattagcgaattcgtatacagcatcctcattagcgatgccatatacagcgtcctcattagcgatgttgtatacagcgtcctcattagtgatgtcgtatagagcgtcctcattagcgatgtcatatacaatgtcctcattagcgatgtcatatacagcaacctcattcgctatgtcttgtaaagcatcctcattagcgatgtcatatacaacgtcctcattagcgatgtcgtatacagcgtcctcgttagtgatgtcttgtacggtgtccttataagcaatgtcgtctacagcgtcctcgttagcatgccttgtgggtgtcattagcgatgtcatatacagcatcctcattggtgatgtcttatatggtgtcattagcgatgttgtgtacagcgtcctcgttagcaatgccttgtacagtgtcctcgttagcaatgtcatatacagtgtcctcattagcgatggcttatacactgtcctcattagcgatgttgtgtacagcatccttgttagtgtgcctcgtacggtgtcattagcgatgtcgtatacagcgtcataattagcgatgtcttatacggtgtcatcattagtgatgttgtgtacagcgtcatcgttagcgatgccttgtatggtgtcctcattagcgatgtcgtatacagcgtgctcactagcgatgtctttttttttttatatatactttaagttttagggtacatgtgcacattgtgcaggttagttacatatgtatacatgtgccacgctggtgcgctgcacccactaactcatcatctagcattaggtatatctcccgatgctatccctcccccccccaccccacaagagtccccagagtgtgatattccccttcctgtgtccatgtgatctcattgttcaattcccacctatgagtgagaatatgcggtgtttggttttttgttcttgcgatagttactagcgatgtcttatacggtgtcctcattagcaatgtcgtgtacagcgtccacgttagcgtgccttgtcggtatcattagcaatgtcgtataaagcgccctcattggtgatgtcttgtacggtgccgtcattagcgatgttgtgtacagtgtccttgttagtgacggcttgtatggtgtcctcgttagcgatgtcgtatacagcgtcctcattaccgatgccttgtatggtgtcctcattagcgatgtcgtgtacagcgtcctcgttagcgtgccttgtacggtgtcattagcgatgtcatatacggcaccctcattagcgatgtcgtatacggagtcctcattagcgatgtcgtgtacagcgtccacgatagcgtgccttgtcggtatcattagcaatgtcgtataaagcgccctcattggtgatgtcttgtacggtgccatcattagcgatgttgtgtacagtgtccttgttagcgacggcttgtatggtgtcctcgttagcgatgtcgtatacagcgtcctcattaccgatgccttgtatggtgtcctcattagcgatgtcgtgtacagcgtcctcgttagcgtgccttgtacggtgtcattagcgatgtcatatacggcaccctcattagcgatgtcgtatacggagtcctcattagcaatgtcgtgtacagtgtccacgttagcgtgccttgtcggtgccattagcaatgtcgtataaagcgccctcattggtgatgtcttgtatggtgccgtcattagcgatgttgtgtacagtgtccttgttagcgacggcttgtagagtgtccttgttagcgatgtcatatacaacgtcctcattaccaatgccttgtatggtgtcctcattagcgatgtcgtgtacagcgtcctcgttagtgtgccttgtacggtgtcattagcgatgtcatatatggcatcctcattagcgatgtcgtatacggagtcctcattagcgatgccgtgcacggcatcctcgttagcaatgccgtgggcagcatcctcgttggcgatgccgtgggcggcgtcctccttggcgatgccctgggcggcgtcctcgttggcgatgccctgggcggcgacctcgttggcgatgccctgggcggcgtcctcgctggcgattccgtgggcggcgtcctcgttggcgatgccctgggcggcgtcctcgttggcgatgcccttgtcggcggcctcgttagcgatgccgtggacagcgtcctcgttagtgatatcgtgtgaggcatcctcgttagtgatgttgtgtacggtgtcctcatggggagctagaagaacacagagttaaggtcagtgccctggtagtggagactgtgaatcacccaggggcttgcttggtgtggtgcatggaggtggctgatcacagcatgggccaagctgatgctgggacatcctcccaggtggacctgcactagtgaagctaagggatgtggctcagaacactttctgcagtgggcatcagtttccaggttcaggtatgcattatccagtgaagtggggaaatataaaaaataaaaattgacaaattcatgaaaagccttccatgagtgcaagtgtgagttttttatccactttacattcagtatgcattcacacatacaaaatatttttacaagaaatcagaaattttaatttttgtcagttatgcgaaatctaacttagctgccaacataaagattctatctcatttacttggtctcgagaaaatctagcacatagtaagtagaccaaaatgttcattaaatgaaaacacagagcagagataggggggctgctaggcagactgggttgcacctgattacctggatgataattaactgcacaaaacctcggtcaaattaatattgaaactgccttttgcttgggctcgtttcccttgcggaagaaggatgaccaaggagatgaacaggaaagaaatgagaaacagaggcctttgcctagtagctaaaggccaccttctataacacgaaatagccttgaactctgccgtgatttagtgacagagttccctcgtgtcttctacccaggttgaagtccagcaaaattgcgactgtcctctttacaacttgcgagaccacactgcttctgcatttgcctgttgtatgtatgagatttacacttgttttaaagcaacattttgtttcagttgggctggtggccatacccggcactagccagtcaatagtgagatggctcctcatggaggaggcttggcttgaggctgagggtctttaacccacatatacaagagagttgccactaagggatggaagccaggctaataaccaagtgccacacagagttcctatctgtccctcctcaccatttttggctggcaggatttgagcattttagggcttgggaagatagtattactaaatctactaaaatacatcacccatccttatagactttggccagttgctgagcaaattaacttcacaactgaagtgggccacactggcctttgtggtcccccactcctcttagaatttgtgagcgtggggcctactggagggtgggaggtgggaggagggggtggatcaggaaaaataactgatattaggctcaatatatgggtgatgcaataatctgtacaacaaactctcatgacacacatttatatatgtagcaaacctgcacatcctgcacatgtacccctgaactgaaaagttaaataaaaaaaaaaaaaggatcggtgagctgagccaaacacctggggatctttgtgcttttgacacactgatgactatgcctgtccgtggggagatgaacccataactgccctgggttgtgtgaccacggaggccactttatgatgatgggcagtgtctggggccttttgggctcggtgccttagggtttatacatgaatgctggactccctgtgtggtggtgaacaccccatgactaagtgcatgtcagcgtcagcactggcccacactcctgggttcgtgttttcactttttcattcaggaactcgggagctggggccactcccttggcccttcaggttctccacctgagcagtggggataataaggcagacccggggatggctctggtgagggtggaggagtcactgtacagagagagtagagcgggggtggattttattgttagaagtggacactggtgattgggttgtataaatgggaaatctctcctgagaaaacacacagcctcacctgtacagaaacacacacattcacaccacacgatgcagcctcacacaagacaccaccaatcctcaagcacccaactcagcaccacccaaaagggagcacagctgcttcctcaaaatttggccataatttttccctggggaattcaggttttaaaaaaacacttcccctatacttattcctatcacaatcccaggatcagggtggctcttcacattgaaaccaggcaaggatgccacacctttcttggcatccagattgttttcttggtaagtgattccagaatacttactagattcacgcctcagaggggccacctgcaccacctgcaatacagaaacaaagctttttgaggggtatgtcatgttgtggattgtttgcacaaggctgtgtttctctcaatgaatattgaaaacttgatcagaaagtgtagtcaacttcaaggcctccaaaacaagggtaggatacacactggaaaagacatcagcttctggatggcggatctctcaggtccacgtaggttggcaagtgcaaaatactgaatccaaggagaagacattgcttccaaggacaaggaccccaaggatacagtctacaacctgaagccatcatagctaaatgccattttggattacatatcagttgctaagagtcacttcttcctccccctcagaaaactgcatttaatacctgtcatggacattgtcatcttttcacatgtaaagtcagttgaaaaagaaagacaacaagaaaggaacatttctatttcagagaaagcaaggcaaccttaccttcacgttgactggcctctctccatctcctctgtccttgtgaactagagactcctcagaggctaggaggacacagagcaacagttagtcatagatgcttttgttcatgagctattcagggagctctgcttaatgtggacaacaggacagtgtgtgtggatgtgtttcattaaaagcacagcttgagctcctgctagaaaatcctccctcgtggaaagacaggcaagaacgaggagctaaggagcaagaaatagagtccctggcattttgctgatggcaacttaaggcaatgggaatgagtcagtctacaaatggtactgaagcacatgctatagtttgatgagagtcccactgctcacactgtgaggtttgaaacccagctaaatggttttctaaacctgtaaaaacaatattacttgcaggatttatgtcccaagactacttttacctctgaggatccacagtggctgtcactgcagttattatgtgttttagcattttgcacttgaataaaagcaaagtttaatagacagattggattcaattctaggcaaaacagtctatggtatttattcactaatcctttgttataactgctgatgggagaattagaagtactgaaattatatcctttaaaattaattaaagcataattattaatcacacaatattttttcatccaggcctccttttctttgtcatgcatgcatattaattgaggatggagaatatctacgcttgttcaggccagccaacatacgacagtttacttcaagacaggagacatgggttgaatgctggtatgttttaactctgcagcgcaaacagttgcaacaagtgtggtgaactaatcaccagatggccctttgctgccttatttgtcattgtgccttacatgtagcttgcaggatttgattacgcttatgttttgtggtgatcatactttcaactattcctaaaatactgcttcagtcttatctgtttggggtcaactgctgaggatttcatacaaattaatgaagtttgtgaatctaaagttctacacaaagggggaaatatttgcaaatcatttatcttgtaagagactaaaatttagaatatttttaaatatatttaagatatattcaaaaatctacagcaacaaactaactaaataaaaatcagacaactctttaaaaatgggcaaaagacttcaacatatatttccctaaagaagatatagccacaaatagtagcacaggaaaagctgctcaggatcattagtcattagggaaatgcaaatgaaaaacacaagcagccaccaatatacacctactaggatgatttaaaggaaaataagtgtgaacaaggatgtaaagaaattgtaaccctgatacattgatggtagaaatggataaagttgcagccactgtgaaaaacagtctgcagtggctcagaaggttaaatatagaacccctgttggacccaggaactctactcttaggcaccccaaagaatagagaacagaaatcaaacagatgtttgtatactaatgtttgtagcatcacttttcacaggagccaaaaggtggaaataatccaaccatcagtgaacaaatgaatgtaataaaagcaaggtggtctgcatgcaatgctacatcatccatctgtaaaaaacgaacatcattttgatagatgatacaacatgggtggacattgagaacattatgcttagtgaaataagccagacacaaaaggaatatattgtataattgtaattacatgaagtgcctagaatagtcaaattcatacaagagaaagtcggataggaatcaccatgggctggaaatagggggaaggcgctatattgcttattgtggacaaggttttgtaagaaatcatcaaaattgtgggtgtagatagtggtgttggttatgcaaccctgtgaatatattgaatgccacggagtgcacactttggttaaaaggttcaaatgataaataatgtgttatatatatttccccacgatagaaaacatgcacagccaagcccagatgccagtcttgttagctgccttcctttaccttcaagagtgggctgaagcttgtccaatctttcaaggttgctgaagactgtatgatggaagtcatctgcattgggaaagaaattaatggagagaggagaaaacttgagaatccacactactcaccctgcagggccaagaactctgtctcccatgcattgctgacccatctcagtatttcctgtgaccacctcctttttcaactgaagactttgcacctgaaggggttcccaggtttttcacctcggcccttgtcaggactgatcctctcaactactgaccatttcacctccattcatgtccatgccacatcaggctgtgttgtctagatggcatgaatctaccccaaatgtccctttctggaggaagccaccattatgctgtacctccaagcataatgatacgtccacacacaccaaggcacctcactcatgcaaggtgtgtgtcctctaacaaagtttcacgctctaaacccagataacttttgaaacccaagttctgttgattcccctactttgggtgctccatagatgctcatttgtctactaaacactgccccaggcaattaaatattccaaagtgaccagcagaatttttatgttaattctgacattgcattgttagtacaagtgtttttcccccttcaaatttatgtctttgttactgataaatgtaactgataatgcttttttcagctatgttgccaagcatatttatataaaaatatactcagattgttttcagaatttgacaaagatgatagcaacaacgataatctcatttgtcttatactaatctttatgtgttactttcatcatttcttacatattggggcctaccatacattgtacggtgaaattagtgctatgcatcatggtaggaatataaattggcaaaagtaatttagaaaatagttcccttctttcttaaaaaaattaggctgggtgtggtggctcatgcctataatcccagcactttgggaggcagaggtgggtggatcacctgaggctaggagtttgagactagcctgaccaacacagcaaaatcctgtctctactgaaaatacaaaaattatccaggtgtggtggtgtgtgccagttgtcccagctactcgggaggttgaggcacgagaattgcttaaacctgggagatggaggttccagtgagccgagattgtgccactgcactccagcctgggtctcagaaaaaaaaaaattttttttgaccaaaatgtcattatgcattacatgactgtatatgaatgctcaaagctacattactcatcaaagaaaataacaaaacaattaaatgtccattaactgataaatgaataaacactatctgtatgaataaacacagcagactatgaaggaaaacacatgaccagcacgtgctaacacgtcaattaacttcaaacatagtatgctaaatgagggaagtcagattccaaatatatatatatgtccatttctataaagcaagtgggaaatttatggagatggaatgtcacagcagtattgcttagggctggagatgggagtggggattaactgccagtgcgcaagagagaacttgggtgagggaaacatatttaaattagatcgtggtgttgggtgcacacagtatcaatttaataaagcatcaaattctagaccttttcagtgggcaaactttatggtgggttcacacccaatataggtgttaaaaataatgttacggaaattcttgtcgggtttttaacaagccaagagatatgctgtgaaagcagcattaattcaagtggttgtcacaggtcacttaaagttaatcagatagttgtcctacaaatatagggtgaatgttattcatgaatttcctgaatctattgcaataatcacatttttttccattaaactcttgaggtagctaattttatttattgcattttcaatgttaatctactatttcatatgttgagattaactcacattagtcagaatttaaagtattttaaaatatcacagaatttaatttaccttatctggttttggtttcaagactatagtagccatttcatttaattgtacatgtagggtattctaatttatggaaaactattacattttccttgatttttttttttttagaaattacttctagggatctatatggtagagtccatggagaattgttttaattcttcattcatgtcttcagtgggtataggattggtcatattggtcatagttttctgctcggatttcaataagaaacttgtggaagaacctgaagggtgggatctttgagggagcctaagacagagcaagacaagctaagaaggagggcagtgccacagcagaactgccattgatgccccctcgcctagattgcggaagagacatccagctgtagacactgaggtgcaggaaaacaatggagcaccatcagagaaagcagtgcccaggaacaaggaggcactgatggtggcaaggggcaaagacagctgccacgaggctgttcacatgagggtctcaggctgcatagacacccacaccagctgaggggtcctggttttcataaagtgtgtggctcagccaggccaccaacaagcagttcacaaacagtagtaatacgacactttccaaagaccttacttgagtaacacggtgatcctcacaaatttccaatcaggatggtcgcacagttcctcctgctttaggactcagagcctgcccgtggtcacagtgggtaggtgcagactctgaagatgcactttggtcagagaccctgctgaactctgtctaatgaggacctctgtcctgtctgctgaccaccggtcagaggtgcaggctgcagtggggagtaagaatgccaccttctcaatgttgggaaaactccctgccagaactgagaatggccctttctaagcagaaggcaagctcagactaaagaaggaggccgaacacatcaggttggcagattgccaaagattcactcagggagagcccacatcctgggccatcttgggtggtggcaagatgaggtagacgactgcttttgcaacacacacctgacaacaaaaaatcaacaactgtaaaagagccacaaaatccccaaatatttgcaaattagcaatgcacttttaaataactgttgggttaaagaagaagtctcaatagaaaattaaaagtacttttaactacattaaaagaaaatgtgacttggcaagatttctggatgtagcaaaagcagtccttagagggaaatctatagcattggatgcaatatactaaaaatcacaagacctaaaatcagtaatatcatgtttcaattagggaactatagaaaatagaggaatgcaatggaaagcaagtaaaagtaataaacaacatcacagaaatcaataaaattaaaacactgaaatcatcagaaaatcaataaaaccaaaagctggttctttgatatgctcattacaatgaatgaattgatatgcaggctaaccaagaaaaagaagataacacaaatgaccaatttcagaaataaaagaggagccatctctactgaactgttaggcattaaaaggaatatcatgaacagttctatgagcgcagtttgataacctcagtgaaatgtatcaattccttgaaaggcaatcttcccaaggtcatgctaggatcctaatttgaataaacttatgtctattaaataagttgaattcacattaagagcattccgaaaaagaaagcaccaggcccagatggtttctctcatgaaatctaccgaattcttcaacaggtgaataaaaagacaaaaattcatttaatgcaatattatttggtgatttaatgtgccattttttgccattaaggcataaaaaagacatgaaagcagctaaagcgtacatcaatttagtgcaataaattcatctgaaaaaactacataatatatgattccaactatatgacattctggaaaaggcaaagctgaagcgatagtaaaaatattaatagttgccaaggtttctggagaaagaggacagagattaatgagaagagaggatttttagggaagtgaacattttctttatgagaccataagggtgaacataatgttttaaatatttcaaaattcatatatatgtataacagaaagaatgaacattatgcaaatgcagacttcagataataatgtgtcaatattttctcattattctagcaaatgtaccacagtaatgtaagatgttactaataggtgaaattaggaagtgagggtgaggagacagaataatatgggaacttcgtgtattatatactcaatttttatttatttatttatttatttatttatttatttattttgagatggagtttcactcttgtcacccaggctggagtgcaatggcatgatcttggctcactgcaacctctgcctcccgggttcaagcgattctcctgcctcagccttctgagtagctgggattacaggcgcctgccaccacacccggctaatttttttggatttttagtagagatggggtttcaccatgttggccaggctggtctccaactcctgacctcagatgatccgcctgccttggcctcctaaagtgctgggattataagtgtgagccaccacacacggccatatgctcagtttttatgtcaatttaaaactctctaaagaaatatattaattgaaaaataataatatagcaccactctttcagggagatctatgcttatgtttaacaaccaggtaagttctagacattagcttgaagcattgtctatcattaaacatgaaccaaaattgacttttaagtagatatttacttttgtggtggtagcaatatttactgaccaggcaaattagaatcctgacacattaaaaaatatggcttagtctcttcatagtttcctcttacatatgggacactgaatactccccgcaactgcaattcttgaatcaacttaattaatgaacttccacagtaccttcttgtgggtacctcttcttctttacccgggagccatgaggtctcctacactggttggtgtgcacagcatatcttcttgtattctctatcagagaagatgctggttaatgcattgacaatagatagggctgttgacatcttgctgacagaagaccagagggaaaatagtgataatctgttctaagtttaaacttatgatcctttttttacaggcttccaagcagagcccactgaatcaaagttgggtttcaggaagatcacggagttcagtgagcactcaacacctctatcagacagactgcgtgggcagtgccttcctggagaggggaacacagccggatgactgtgagtgcagggctggtgcagagtgggggcccggattcaaattccactaagccatgtggacctggcaagctcatgtcctccctctgccctcagttctctgcactgtcataatgtaattttagcaatactttttaggccctatttaagccctacttcttagtatcacagtacagggctaaaaaatcactaaatacaggaaaaccttagagaggactggtacttcagtaatgttctctaagtgtttactacatgccaggaggaataagctggacacttagcagtggcggaatatggagggggaacttggatggctccggggcagtggagcatgctttcctgttcggcttttccgtgggcatgacgccttatggtttatggagaacatcagccctgcagggggtgcagaggaggggctgtggctgagattttacacttgagggtgctgacattcagagatgataagtgacgagcagaacctcaaccccgctgagtgaaggacctgagatgggaaatgtatttggttccctagagagagagattcctgaaaaactgccacctcttcatcacgccctgtgccacagacccaagagacccctcactgtctttctccagtcctcctagcccaaggtgtgtgggtggacaaaggtggtgctctggaggaaatgcctgagataaggacaggtccttaatgataaagaattctccttcctctttcagatccttgacctcccagtatgacagcttaaaggctgtcatctctgtggcctgcctccccttgcccttcaccctgccagctgcctctcagtgactgtctcctccagtgactacactgagggaccagggactgcttgcctcccgaggctgctcacaccttctgacaccgcaaaatgattgtcaaaaatgggtctgcaaagagtaacttcccttccactgatcaaacctgaatatgcaagctactgtcaattaactggaaaagtggccgtgtgggctggtgctttggtgatttaatgaattaagtctgcaagccccactgcctccttgactattgatcagagctgcctgcaataaggtctggctaagaatgggcagtggctgcaccagctctgggtaaaatttgacctaaaatgaccaatctcattcactaacctcaccatagtcttatgggttcaatggacctgtccaatcctttgctctgttctctccatcaccttcctgtgtaattttcctccaccacgcacataatagaaacatggcacaggggagctaatcgcctcttttatcccccacttcaggctcacacataagtttatagtaaaagccttttcaaatgactgctttaactgctgctacagcatgtgtcatcagttgaatggaatctgtcacgtgactttaagcaaccctttgctgagagacaagattcaatactagggacagtattctagtgtactacatcattgattttatgttatgaagatcatcatttattgaaaatgtataaataatgaagcccagccttactcttcaacgctgtgtgtgtaaatccactgagtgtgctgacccccacgcttgtacccacctgctaacacagaaagggtccactcagaagggaggcacagctccagcactgaggctgtccacaccagcttcacaagagggttgccacaaggacgacggatacccggataacaaccaaatggtaatttgagtacttaatggtcatgatccctaaagtgtgtagctcagagggcttgtggtgataactccatcaagactctaaagcatctccccaattcttactggacttgatccatgtcttgaggagacccagctatgacacgcaggcaccacgttgtcctacttagtgcctcccttagtgtttcagaacctgtgatttgatcagaaacatgggctttctatgttggtttcacactaaggactatgtgacacctgcaggaagatgtctacatagctacctggattatgagatcatgaggctgtcttatgtgagggatggcgtttgggatctctgcaggcgtgggtaattccaggcatagagggtgctggaactcccttgcatggtgaatagtgatctcttcactggctgataaatagaggttgtagttcaggccttcaacattagcaccgtatgaggaaacattttgactcttcactatgcagcaagtgaaccagagcacatttatttatgtggcttagtttctccatctggcatgtgggctcaataaacaagctcacaacatatgggcatgatgatgatgaggtgtgaactaatgtaagtaaagtatgtggtctgatttgttaaattaagaaaaatggcactgagagttgtgctgggtaaacacaacatttttttcctgggggaaacacagatagacacacattcacaagcaaatcatgcagacttgcacacagaccacctcaccccacccccgccctaatacacacatacccacacacaacctaatgtgaacatgttcccagaaactatacatagataaaaagagtatgtcaccaggaaaaccagtttcttttactataccctacatcctcattcccaccagatgtcttggatcatggaggctctccggacaaaagccagcagttaagctccagatttcctgtagaatccttttctaacaaccagtgagtgattccagaatacgtaccattgaatgtgctccctgaagtcacctgtaattagagaaggaaaacactctgagaatcaggctatgctatggatggctcacacaggtcttttgttcacttggaaactctgggtaaccaagattggaaataaggttcaagtcaaaagccccaactctagagtagagttcccttaggaaagcacaggagcttttcttgaagaatgtttctgtctaggtaatttttgagtagcaattgcagaattcttatctaaagtggaaagcttgttcctgaagaaaacatcccttaacacccagtgtactatctgacactgccaattttgcacgtcctctggaatcaggtgtcagttggtaaaatacacctcctccatccccaaggaaatattatctaacacctataatgtagtggagaattttcccatagctgatatcaactgaaaaataaaggatccaagaaaacaacatttacatcttaggcaaagacaggctactttaccttggtagtagagtagggcttccttttcacacgctttttggaaggcttcttcgagtcacctaggggatgtggagggacacagcatggctgtcagttcattggcagtgctactcatgaatgactcagggactggaacttaggggcgtgcctggttaacaagcatggaatgagcttctcctggaccatcttcttcacggaccaaggaaggcaaagaaagagcagcaaggaaatgagagtagagcccttggctttccaggtaatggcaaatgaaagcaacgtgaaataatcaactccaaatgaacaaatgctaaaacacatgctacgattcaaccacagcatcctgtcacttcttcagaccctttaaaagcccagcaggactgccactaccttcttgacatcgaccaagtccctttcaacctccacagacccacatacactgctactgcatttatcatggagggtatagggttctgccctgtttatgtgtgaattttttaaaaactagatttaataccatgcaccagcattaattgtatttatttcttttcttggttatgaaaataatcagtcaggcatagtggctcacacctgtaatcccagcagtttggaaggtggaggtgggtggatcatttgaggtcaggagttcgagaccagcctgaccaacatggtaaaaccccatcattgaagataaatgttttatatccatggttaacagatgagatgaccatgaaatgaacaccagtgtactgggtggagcagcttatctattcagtcttcggcactaaaacctgtgaaacaatatcatcttgccttatttactaacaaatacaagtgcctctaaacttagacagtttccaagtcatggaactgatgagcacttagctcctgcagagagctctggatgatgggtcgggagaacaaagacacaatacatcaaaacagcattcacaagtaaacaggttttcaaagccctctacatgcaaatttacacaattatccttttaatttttatcttcatatatatgtacataatctacttgcttctgagtataaatcaaactgtatgttcttagttaatagtctctataaattcactctatttatctttctgagttgaaatactgcatctcattggataacaaaaaaaaaaatttgactaagattacactggaaaggtgagtaggttgggtgattgactgtgattgacaattccatgattctggataacttccaaagcataaaaataaatgtgtgttttctttcacacgtagacaatacacatgcttattactttaaaaaattaatatgtgcatggaagtgacttactacaaatatattaaagtaaatacacatttcacaaaaaaagaagagaggaagggaaaaacatgttaaaaacaaagagagttacattttattgtgtgaaaagcctccaacggatccttactactgtggctttgttccaaagttttggaaagtaatgatttcataggttcttaattgggttaaaaacagcattaaaatagactctgccatattctcccctggggaataacttaatctgtggggtggggaatggaacgttgaaggatgcaggatgtaaaaggaaattatatatatattatatatattatatattatatgatatatataatatatatattatttattatatatattatatgttatatataatatatataaataatatataatgtacataatatataattatataatatatattatatattatatattatatacataatatataattatataatgtataatatatattatatataatataatatatattatctataatatatataatatattatatatattatatattatatttaatatattatatatattatatatataatatattatatataatatatataatatattatatataatatattaaatacattatatatatattttatatatatatatattttttatatatatatatataatatatatatataatttgggaatttgggaataaactgaatcccaattcacactgggactacaccagctgccaccatgcctggctaattttttgtatttgtagtagagacagggtttcactgtattggccaggatggtcttgatctcctcaccttgtgatcctcttgccttggcctcccaaagtgctgggattataggcctgagtcaagatacatattttttaaatgaagaaaaatttgaaagatactctgcttggtacaataatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaatggttcaatctgctctgacctttgaaaaactcagcacaggtagtggcacttacgaccaagggcaggagatccctaatcccatcaccatggcgatagggcataaacattccagggtgaaggcacaatccacactgtgaggtccaactgctgccatgcagacaggtgggcttttacaagtacaggaaggtcatcaaaggctcagtgttttgtttcaaaaactgaatcccaagcccacacattattatgctggcttcttaaaataagttgtgagatgggaagtagggcacccacaaatatatatatatataattatatataatataatatatagtatatatataatatatttaatatattatatatatatataatttgggaatttgggaataaactgaatcccaattcacactgggactacaccagctgccaccatgcctggctaattgtttgtatttgtagtagagacagggtttcactgtattggccaggatggtcttgatctcctctccttgtgatcctcttgccttggcctcccaaagtgctgggattacaggcctgagtcaagatacatattttttaaatgaagaaaaatttcaaagttactctgcttggtacaataatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcagaatcagggaaaatgaaaccacaatggttcaatctgctctgacctttgaaaaactcagcacagatactggcacttaggagcaagggcaggagatccctaatcccatcaccatggcgatagggcataaacattccagggtgaaggcacaatccacactgtgaggtccaactgctgccgtgcagacaggagggcttttacaagtacaggaaggtcatcaaaggctcagtgttttctttcaaaaactgaatcccaagcccacacattattatgctggcttcttaaaataagttatgagatgggaaatagggcacccacaaatatatatatatataattatatacaatataatatatataatatatataacatatatataatttccttttacatcctgcatccttatattatatataatattatgtataatataatatgtattattatatataatataatatatatgaatatatataattatataatataatatgtaattctatataattctatataatataatatatattatatataaatatatataatatactatattatatataagtatacataatatattatatatacgtatacataatatagtatattatataaacatatatataatatattatatatacgtatatataatatattatatatacgtatatataatatattatattatatatacgtatatataatattatatatacgtatatataatatattatattatatatacgtatatataatattatatatatattatatataagtatatataataatgtaatatattatatataagtgtatataatgtaatatataatataatataataatatattataatatattatatattataacataatataatataatatacattataatataatatataatattatatataatataatatataatataaaataatataatatataatataatatataaaataataattaatattttaaattaattattattaattaatattaattaatattaaaaataatataaaatataattactataatataatctataattattatatataatataatatacaattatatataatattatatataataaaatatatataattatgtgtatttattacatataatataatacataaattatatataattattacatataatataatatataattatatataattattacatataatataatatataattagatataattattacatatgatataatatataattatatataattattacatatgatataatatatataattatatataattatataattatatatacaagataataatatataatatataatatatattacataatattttatataatatattatactatatatattatataatattttatataaaatattatatattatatataatataatattttatataaaatattatatattatatataatataatattttatacaatataatatataatatatattatattatcatatgttatacaataatatgttatagtataatatatattataatctaatatattatatattattatatattatattatatataacattatatagtattatatattttataataataatataatatataatattatatattatatataatatataatatattatgacatattatatataatatataatatattatgaatatattatatataatatataatatattgtgatatatattatatattatataatatattatgatatatattatatataatataatataattatatgtaatataatattatatatcttatatatcacatattatatattttatatcatatactatatattatatcatacattacatataatgtatgtcacatattatatgtaatatatgtcacatatatgtaatatatgtcatatattatatataatatatatcatatattatatatgtcatttattctgtaatatgtatcatacatattacataatatgtattatggtgtctggtggtcccaggacacagactgatgtcactcagcctcacatgacactctgtcctcaccacacttggggtcctgggagtcgtagcaccaggcacctatagagacagtgggcaggaggctgagctgagagaccagtcatctgggtcctctccaagccccatcccatcaactggggtccaagaatgaagtaggccaggggcttaggccaggggaggccagtgaagaaccttctctcatgtcacccctaccccagtattttctctccccagtccctccccactcccagtggcaagacctaaggggtggtggagcatggcaagagggtagattggagaccagacgggaagagtcctggtgctcactctcagagtctgcaccacaccagctgcaccgcaaggcgagcatgatgccaggggcgtgcgtggctcagtggcagccgcagctaggaaggactagaaagtggctagaccgcggagccaagatgctggcctggctactacatatttattcattagctagctgggctaggggcgtggctattgaggagaggatgggaggggtcggtgcccaggcagggccaccaggaagagcgggagcgctccaaactcacccaggtgtgctctggtcccagggctgcactgatgccagcaacaatcgctgaggttaatcctgcaggggaggggtgacctattattatccccacttacagtccaggaaacagaggctggggaccagaatgacacaccaaagccaccagcaagaaaggtcaaatagtgagggcaccttgaaccccagcgcccatgactttcggggcaaggatgggaggaaggtgtaggatgtctcttgccccgctgtgggcctggaactgccaccccatcccaagaccatagcctccctcctgcccaggcccccctgcggatccaggccaagacggagccctgcaggaggtcagaggaggggacttctttgcaccctgcgcctctttccaatcgccagagggcagggccctacccacattggggatgggaagtcaaatgcagaagttaggtgaagtcagttcttggatactcctgtactgtcaccctggtcttatctcatgccttagcccaagctgtgcacacaatggggtcctaggtccccctcacctcccagattccaccttcccagggatgggaccccctggaaccctcgggggcctgggcagtggccttgctggctcttgccttcctaggagctgagcaggagctccactctcagcagggcagttcactgcagcctctgcttcctcagctcaagccatcctcccacctcagcctcctgagtagctgggaatgcagacacacaccaccacgcctggcaaatttttgtatttttagtagaaacagggtttcaccatgttgcccaggctggtctcgaatgcctgagctcaagcgatctacccacctcgggctcccaaagtgtgggagccaagatgggaacccaagcatacggccccaatgctgaggctctgaactactgacctgccctcagcactcagccttgggatcatgagtcactgtgcaagggagttccaacatctgcatgtatgtctggaatgatctgagcctgcagagttcctacacactggccacattatagggtggtgtccgtggtcacacagctcagggcaggtatttattagtacatgaatagcttagctgtgtcatagtctttatgtgaaaggcacaaaaaaaggcactttggcaggctgaaagtgtggggattataggtgtcagccaccgtgcctagcccactggatgacttatgatatcatatgtgacattgtgacatcatgtgagtcagggatgtaccccgttctcagctgctatatgctatgttacactgacagaatgggaatgaagaatgtgtcccactctctcagctgttgtattatatcatacaaggtgcagtgactaagtgtgtcagctgtgtcctcatcctacatagcatatgagagtgtgtgacgggagataggatgcagacctgagaagcattaaacacctaggcaataaaggtgccagcatcagctgagagcgcaggtagacctcagtcacatttgttactgtgtaactaaaaatacaaaattagctgggtgaggtggtgcacgcctgtggtccccactgctcaggcacctgaggcaggagaattgcttgaacccaggaggcagaggttgcagtgagctgagattgcaccactgcactccagccttggggacagagtgagactgtatctcaaaaaaataaaataaaataatctaggacaaccaagagaaggactcaggctcaccttactccatgtcacatgtgatatataacacttgagggggacacacacttgtcactttgtatcactatgtcctatatgatagccaatgataacccaagagggggaggcagccttgttcacaccatgtcacttatgatattatatgacatcaaggagcccagacctcagttgcattatgtcactatggcacatacagtatcatgcaacaactgacagaagggttgcaggcctgattcacagtgtatgtgagtcacaaatgtcacttatgacaccatacagcaggtgagaggggatagtcattactcacctcgggtcacattgtcacacatgataccatatgatagcagagggggatgcagaactgagttgtattatgtcgctatgtaacctgtgatagatgatagctgatgcgggtgaagaccaaagttacattttgtacctacattatatgaaatatacaacatgcacgagggagatgcagacacaaatcacactgtgtgctgtatcccatatatgtgtttaatttctgtgtttaagagagctgggttcatgaatgaacttagtcactgcaccttgtatgatataatacaacagctgagagagtgggacacattcctcattcccattctgtcagtgattgaccacaccttgtgttaactgtatgagccactgtgtttggccgtgtatagcgcacgtggcacattgctcactgatacatatttgctccgtactgaagtgaggcagatgcatgagtgattgagaataatgctgccttggtgaagcattccatttagaagcatgaggttcaggtactaccatcttctgtgatacatatttaaatgttaagtttaacagttaggtctaccatgagtgaatgagccttgcattatctttgagaatcgatgtgtttagcagggtgtggctcatctaagatagccttctttaatgcatgttcactatctgtgtttattagaaataggtttgtgaatgacttagcatagtgttttccctatgaaaccctgtttatttatttatttatttattttgagatggagttttgctcttgcaacccaggctggagtgcaatggtgtggtctcggatcactgcaacctctgcctcccaggttcaagcgattctcctgcctcagcctcctgagtagctgggattacgggcgtctgccaccacacccagctaatttttgtatttttagtagagacggggtttcaccatgttggccaggctggtctcgagctcctgacctcaggtgatcctcctgcctcagcctcccaaagtgctggaattacaggcgtgagccaccacacccggccaaaaccctgttttaagaagtgtgtggtgcaggtactacattctttgttgttccaagttcaaaccctgtgtttaacagagataggtgcaagattgcctaggtgtagcgtagactcttggaaatactgtggttagcattctgtgttttctgtagtatagtttcagtgatgcctgtttagatagtttatcagatctaggtactagtgttatgtcagcgaaacactgtttagctgcacgcggtgcatgtaatactttgttcattgatatttgtttaaatcaatcagtgtttaccagaactagatatgtgagttactgagaatagcctaatctctgaaaatgttttccagcctatggtgcatgtaatatactcttctatggtacctctttccgatgtttttattgtggcaaaatatacataacagattataccatttttaagtgtagaatttagtggtagtaagtatagagagaaccttaaaagcagcaagagaaaagtgacttctcatgtgcaagggagcctctagaagattatcagtggatatttcagcagaaaccctgcaggccagaaggtggtgggatgatacattgaaagtactgaaagagtaaagcctgccaactgagaatactatatttgacaaaactgtccttcaaaagtgaaggagaaattaagacattcccagataaataaaagctgaaggagtttattaccactagacctgaccaataagaaataataaaggggccgggcacagtggctcatgtctgtaatcccagcactttcgggagccgaggcaggtggatcacctgaggtcaggtgttcaagaccagcttgaccaacatggcgaaaccccatctctaataaaaatacaaaaattagctgggtgtggtggcacgcacctgtaatcctagctactcaggaggctgaggcaggagaatcacttgtacccgggaggtagaggttgcagtgagctgagatcacaccactgcactccagtctgggcaacggagcgagacttcatctcaaaaaaaaaaaaaagaaacaataaagggagtccttcaagttgatatgaagggatactagacagttgctcagcctgatgaaaatataaaggtaaatacataaagattaaaacctgtattattgtaatttttgctaataactcaatttttaatactttaatggaatttaaaggacaaaagcataataattataaatctatgttaatggatacaaagtatataaagtttaatttgtgacatcagtaacttaatagtggggcaaagatgtaaagagtagaggttttgtatgtgattgaagttatctgtttaaaataataagataactttaagatgttccatgtaattcccatagtaaccacaaagaaaatacctacagaatatatgcaaaaggaaatgagaaggaaatcagagcatagcactacaaaaaatcaactataacacaaaggaagacaataagggaggaaagaaggacaaaaaggctctaaacatacagaaaacaatgaccaaaatggtggtagtaagtccttcctaatcaataatttcattaaatgtgcataggttaaactcccaataaaaagacataaattggctgattggatttaaaaaaacgggattcaactatatatgctgtctacaagagactcatttgaaatccaatacaaatgggttgaaaaatgagagaatggagaatattccgtgcaaaaagtaaccaaaacagatcaggaatggctgtacaagttatggctgtacaagttgttggggtttatgttactgaagaatgaacagagatgagtaagtggaggtgttatgtaaaggcatactgtactcaaaatctgaagacctgcagcagatttaaattccagctcttattataactttttaaaagattgtgaaaatatcaaaatatagatgaatcaagttttaatatactgtatgatgggtggatgaggctgtccattgtaccatttgtttgaattctcaggcatggtttggcagtgcaagaactctgtaacgttaacaaattcaataaaaagtaaatatatggaaaaaaaagtatagacaaaatagattttaagtaaaaaactattacaagagagggttctgggaagaaagtggagtaggaagcactgggaattcatctccccacctagaaaataatcacactggcagaatctgcctgatataactattttggaactctagactctatcaaaggaggcttgtaacctccaaatgaaggcttaaactataatttttacttaattttggtcaatttcagctcttagctcagcagtggctacccaatccccatgccccagcttcacggcaagaagctttgcatgtgttcctgaagcagcttgtaccaagcttgtgggaacaatcatgggcaataagcactctgtcctccaagtgttagcatctgcgttctggttgttgattgctacttttgattatggaagggcaaacacagaggccggcagccattattgctcacaactccccactccactgctgcaagcccttaccagactgaagcaacttctaggagatagaaaaggccagaaccccatttcccttccccttcattgttctcttttccttttttgggagccaaacattaaagactaggacactcaaaagcaatggcatacccagaggaaattaaagttaccacacatccttggagagaggagtgtgtgcccagggaaaggagcagcttcagacctgagaagacctcaagcttacaactcaggttgatcctcagcatggagacaacctacaacaatgtaaaacataacaaaaccctaaaacagcaaaccctgaggaagaggagagtctcatctccagagttactgcattattatattcaagtgtccagttttcaatacaaaacacaaggcatacaaaaaacaagaaaatatggtatttcaaaggaaaaacaacaacagaaactgttccagagaaagaccagatggtaacctactacacaaatactttaaaacaactttcttaaagatggtcaaagaactgaaggaagatgtggagaaagtcagtaaaattatgtgtaaacaaaatgggaatatcaataaagagatagaaaacctaaaaagaaaaaaaataaataaattctggaactaaaagtgtagtgattgaaataaaagttcaccagagggattcaaaagcagatttgagcaacagaagaaagattcagtgaatttgaagatgggacacttgaaatgatcaagtcagaggaacagaaataaagacgattgttgaatagcaagcagacattgtggaagtcccaaaagaagagagggaaaggggcagagagatcatttgaagaaataatggctgaggctgaacacggtgactcacacctgtaatcccagcactttgggaggccaaggtgggtggatcacaaggttaggagttcgagaccagcctggccaatatggtgaaaccccgtctctactaaaaacacaaaattagccaggtgtggtggtgcatgcctgtaatcccagctacttgggaggatgaggcaagagaatcgcttgaacccaggaggcagatgttgcagtgagccgagattgtgccattgccctccagcctgggcaacaagagtgaaactccgtttaaaaaaaaaaaaattagctgggcgtggtggcacgtacctgtagtcccagctactcaggaggctgaggcagaagaatcgcttgaatccaggaggcagaggttgcagtgagccaagatcacaccactgtactctagcctgggcaacagagcgagactctgtctcaaaaaagaaaaaaaaaaagctgaacacttcccaaatttgatgaaagacatgaaaataaatatccagaaaactcaatggactccaagtaggatgaaaaaaaaaagactcatactgagacattataattagccagtagggcctcttgaaagcaccaagagagaagcaactagtcacatgctaggaatatataataggattataagtagatttctcatcagacactttggagaacagaagacaatgggatgacatatgtaaagggctaaaagaaaaacaaccactacctctcaaccaagaatcctatatccagcaaaactgtccttcaaaagtgaggaagaaattgggaaatccccaaataaaccaaagttgagaagtttgctaccattagacctgccctgcaagaaatcttaaagagaatcatgcaggttgaaaagaaagaacactagatagtaactcaaagccatatgaagaaataaagatgccagtaaaagtaaatatatgggaaaatattaaatctagtattatcgtaactttggtttaaaactccatgttttgctttctacataatttaatagacaaatgcattaaaaacaattattagtttatgtttatggacacacaatgtacaaaaatgtaattttgtgacattgataactgaaagaggagtggcaaaactgtgaggagaatttttgcatattattgaaatatagctggtatgaattcaagttagagtgctataactttagaatgttaagtgtaatccctatggtaaccacaaataaaacattatataacataaaaaagtaaatgagaagggaattaaaacacttcgctacaaaaaatcaactaaatacaaatgagatcatgcaggaaatggacaaaaatgctgtaaggcatatagaaaatgtatagcaaaatgccagaagtaagtccccccttatcagtaattactttattactttttaaaccattttgttgaggaatgatttacataaaaactgtacatatttaacgtacacatcttgataaatttacaccataaaaccattatcatcaagcctataaacatatccatcaccttttaaaatttccttctgcctctttattattattattgtataaaaaaaatgtttttaatggccaggtgcggtggctcacgcctgtaatcccagcactttgggaggctgaggcaggcggatcacctgagatcaggagttggagagcagcctggctaagatggcaaaaccccatctctactataaatacaaaaattagctgggcgtggtggcgggtacctataatctgagcaaagtactgggaggctgaggtgggagaatctcttgaacctgggaggtggaggttgcagtgagccgagacagcaccattgcactccagccttagcaacaagagtgaaaatctgtctaaaaaaaaataataataataaaagtttttaattaaacaatttaagaatatagtaacattttctgtgggtactatgctgtatagctctccagaacttacttatcttgcataactgaaatttgtacactttaaccatcaacttcccatttccttctcttccccagctcccagcaaccaccattctgttctcttcttctgagtttgacgtctttaggttccacacataagtgagattgtacaacatttcactttctgtgtctggcttattttacttaacataatgccctccagtccatctatgcatagaaatgcaactgatttttggatgttgactctgtatcttgctactttattgaatttattacttctaacagtcttttagtgaagtctttacagttttctatacataaaaatatgtcatctatggagaccattttacttccattcttatttctttacttgcttaattgttctggctaggacttccagtcctattttgaggagaaatggtgagagtaggaattcttgtcttgttcttcatcttcgaggaaaaacgttcagtctttcactgttgagtatgttacatgtggtcttcattatgttgaggtacattccttctgcacctaatttgctcagtttgttgttttttttaatcatgaaaggatgttgaattttatcaagtgctttttaataataaaaataaaggatttttatcgtttattgtgttgatgtggtgtatcacatttagtgactcttgtatgttaaagcatccttgcatgccagagataaatcccacttgatcctggtgaataattctttttttgttttttatttatttattatttatttatttttttgagatggagtctcgctctgtcatccaggcctgagtgcagtggcgcgatctcggctcactacaagctccgcctcccaagttcacgccattctcctgcctcagcctccctagtagctgggaccacaggcacccgccagcatgctcagctaattttttttttttttggatttttggtagagactggattcatggtgaataattcttttaatgcactgttgaatttggtttactagtatttcattgaggatttttgcatctatgttaaccagggatattgacctatagttttcttattttgtagtgttcttatctggcattgatatcaggataatgctggcctcttagaatgagtttcaacgtgttcccttttcttcaatttttttggaagagtttgagaaggattgttattaattctttaaatgtttgttgaaattgaccagtaaaaccatttggtcctgggattttctttgttgggagatttttcattactggtttaatctctacttattttttcctgttttttttttttttttaattatactttaagttctggggtagccgtgcagaaagtgcaggtttattacttaggtatacatgtgccatggtggtttgctgcacccatcaacccatcatttacattaggtacttctcctaatactatctctccccttgcccccatcccccaacaggcctcagtgtgtgatattccctgccctgtgtccaagtgttctcattgttcaactcccacttatgagtgagaacatgcggagtttggttttccgttcctgtagttttcagatgtgctctggcctccaaggaccatgaagccaggcggtggtgggggggtgtcctctgtataaaaagtgctgtcccaggaacttcctgacggacactttggggcatgtgagcgattcctggggagggcacctcggccttcctaaggctacccctgcagccagcgctggccattctcaccagcaaccaaccaaaaaacatcagagtccctgtaaacctggttgtgatgataaaaaccaaatgttttctaatctaagacttgtatgcagaacacagaaaactgcagttaaggaacaccctacaaaattgaccaacagtattttccaaaaacatttttcatcactttaaataatgtacaaaatctacaaaaatcatatttaccaggacacatctgttaaataaaagcattgtttcgtgttggtatacatatatacaagactatgtataacagactgtttcccctccctgcaaccacagaaccatcacacacaggcacagatacacgtcagctatgccgctttccacgaatgcatggaacccaggacgcgaacccacagctcgaggtcttataccttcactactgagctgccgccactgcagcagcaacacctctgcggaggtgttgctgaaatcactggtgtccctgcccaaggtgtcctggtcctggtcaactctactgattgacccttcgtggatacctcaggtctaaaatcctttcctccgagccagagctcttcctgttgtgcaaactcagccccgtctgtaccttcctgcttggccggtgatcgcagtccttcttcgccagcaagtgtgggcttccaaagacaaggctgggcctggcctgggactccctgaaggccgagaaggacaggccctgcagaggcagccccaggtaggggctgaagaggccggtctccctgcccccccaggagacaccctttccaaagtggaagagctgggtggacagcagcggggagaagcccgcaaggggcaggctgggcaggccccgggcggggccctcggaccccttgtctctctctcccaatgccgccccctccacgccgcatctctacctttggagcgcagtgcccatgggctgggcagccgactgtggtgggcaaagtcactccagggcggggcgcggttggcctgggctccagcatccctctcagctcccgggctgggggtcaggaagctccggttcctgcagtccacgtgaaaggtccccctggctcctcctgcctcggtgcccgctgtggcacagctgggccgctgaccaaaagcacttttggcagcaggctcagcccctcgtgggctctggtctttgtaaacgtaaacacttctcttgctcactgagagaccttggcggagacactgccgctggtcctcctgggtggcgcatgatcccctccgccggatcagtggggagccccttcccaccctggctgagcaggcacgctgcgccctgtgctcctgcgctccctgcgcctcgatgccctttagccaaatgtgggaccccccggccctctggctccgtgtgcacatgccaggcagtggggccggctccttcctgcaaggtacctctggcctggctgggccccctgtcccgagagcggtggggccctctgcctgaacttctgaactgctcaccgactccttggccttttccaccaaaaacttcctaatctccagttcgatgctatcgtcgctgtccactgaactgctgttgtcagacaaggagccagggctgggagctgggccctgggactctctggggaatagattctcttcggaggcggaggcagaagcgggtctcctcaccaggaaggccggggcttcgtcctctcggccctgctgccaaagacactggggggtttcttcctggagccctcgcagctgtctctcttggacttaggcagctcttcagcacctgcaggtgcctgtttttccactctctcaggagcctgcccagccgctcctggaagtgcgtctgggaggtgctgaacctgaccttcttcctgcacacagccctgggctccctggacctcttcttgagctttcacttggaccttaacaagtccttgatggctgtgtccaggtccttgtcactgtccagggaactgcttttgtcttcggagctcttcttcttgtctaggtgccttgcctcgtctgtcttaccctggccctgtgacgtgcgagtgtcaccgggcaccctagcggcgccctctcctcccggggcctcgctggctgtgccctggatggaaaggtcccaccctagcggcgccctcccatcccggggcctcgctggctgtgccctggatggaaaggtcccgcccctcatggccgggcccggctctcccctggctgcggtcggcatcctggccaccctctttccccaccacccgcatgttcttgggagtggatggcctcacttggcagccgcctctatgcttccttttgcagccaggagtgggtccagtgttttagagagaggggccttggggctgccggtctggctgctgaggccaggtggtgaaagtgggccctgggcagcctgagggcagctctcacctctggccagcaaacttctagactgcaccttgagggccaaaaacgtccagatttcctgctcaatgctgtcgtcgctgtccacggagctactgtcaccatcagagcgggaaggcacgttgggggagtagaagagtgggcttgcggacagggacccatcgctgccctccatagggccggcaggatcgtcttgaaaatgtccaggactgcttctacacacatcagctcagcggaggtgtctgcctggcaagaggaccattccacaaacttgctcctggaagccgggctcgttggaggtggagctttggtttcctttgggatcttgggggaatggtcagcgtccagatcccctggaccagggtccgtggtcttggtgggcactggcttcttcttgctgggtgttttcctgtgggtctctggcaaggcactttttgtggcgctgcttgtgctgtgtgcgggaggggcaggtgctctttcctcttggagctggaccctctggggcgggtccccgtcggcctccttgtgtgttttctgcacctggtacagctggatggcctcctcaatgccgtcgtcgctgctggagtcggacgcctcgggagcctgtacggcgctcgtgactcgctttcccctccttgcggtgctggcgctccttttaatcccacttttattctgtactgcttctgaagggcggtgggggttgctggctttgtgctgccctccttctcctgcgtggtcgtggtcgtgaccttggacctgaggcttctgggctgcacgtttgtctttgctaaccgggggaggtctgcagaaggcgaactccttctggacgcccatcaggccctgccggtgcaccacctttgtagccggctcttggtgggatttcgagagtgacttcgccgaattttcatgtgtgtctggtttcttctccactgacccatcacatttttgggtctcatgctgtcttttctcattcagaaactgttctatttctgccctgatgctctgctcaaaggagtctgctctgctcatgctgactggggaggcagagccctggtccttgctggatcccacctggctgccagggccacaccacctgagccaggtacaagttttggggaacacagggcagttgggcactgctgtgagccagttcccgcttacatctactgcctccgcccgcagccctggaaggctgtgcatggctgggccccgctggccccgggctgtgccgctccactctttaccttcaggtactcctggatggcctcctcaatgtcccggtccacggaatcgtcactgtctgaatctagcaccaatgggccaaagtctgcagtttcctcctcccccacggggtcaaagtcagcaacaagaccacaggcagccaacgcaggcagctccttgtgcatggtgggcttggcagcaggcctggcgtcgtggcatccctctgccccctctgcgcagtgcgctcatcgctggtgcccctagcagccctgtcgctctgcagcgtgctgatgagcatctgcacccgggtgctcaccgacatgctctccacgcccttgtcagcctccgagaagcacccggggaacctaaagctccctggcgggacagaggcctcccatttgggctggagagcaaccactggaggagcattcatgagaaacattctggcagatggggagcgacgcgcagaggggcgacactttatttctctgcaggcttcacatcctccaaagattggcaagcagtacccgtgaaataactttaaacctgcaaatgcttctttgcaggtttaaaaggatgactataaactatgacgtcatgcctagattcattcttgacccaaccaacaagctcttgacattctctgagtccaggttgactgtgatgaaaggcagctagtgttcccaaatggcccagggatcaggtcttcatcgctccactcagagggaagcatcctctctctgctttttaaatagacttttgactggggctccagcagcgcggggcgcgcagacctggagttgcatggaggccagagccacgacacccgcctggggaacggagcagccccaggcgctgatccccgtccacctgccccacggagccctcgccgcccgcttgccactgcctgcatggccctcctgtccccggccccccagccctcctttccccagctcccccaccctcctgtccccggcaccccagcttcccagcccccgaaaccgcccccccacctcgacccggcccatgccgcaagtcgcccgctgcgcggacccggcctccgcccgcctcctgcgtcctgggggaggcggctgccgggggtggtgggggagggggagggggaagaggccgccctccgcccgggtgcggggagggggcgcaggggtgtccggccaggccccccgcctccccgcctccccgcagcagctgccccgctcccgggccgcctaatacttttacattttaacttttatactacagtgaaaagtgatttacacaccaccactgcaatattacagtgttatgaatgtgactatatacttacctttccctgtgaacttttttttttgagacagagtctcgctctgtcgcccaggctggagggcagtgtccatgatctcggctcactgcaagctctgcctcccgggttcaagtcattctcctgcctccgcctcccgagtagctgggactacaggcacccgccaccacgcctggctaattttttgtatttttagtagagacggggtttcaccgtgttagccagcatgatccccctcttctgaccttgtgatccacccgccttggcctcccaaagtgctgggattacaggcgtgagccactgcgcccggcctacctgtgaacttaatatcttaatgttttaatgttgctaatcagaatccttttatttcaacttgaaaaactgccttataaggcaggtgcagtggtgatgaactcccttagaatttttttggtgggagtctgggaaagaccttatcatctctttttcatttctgaaggacagctttacaagttgtggtcttcctgattggcagtttttttcttccaatacattgaatatagcatcctattctctcctggcttataaggtttctgctgagaaatccactgatagccttattgaagtttccttgtatgtgatgaattcctttcttcttgctgcttttgaaagtctctgtctttgacttttgatattttaattataatacatcttggtattatggtctttgggctggccttttttggggcctctgaacttcatgtgtctggaagcccacttgcctctaagaatttggaaagtttttacccattatgtcttcaaatatactttcaggccttttctatcttttttacttctaggaagtccataatatgtttgacccacttcatggtggtgtcctataaatcccaaaggtttttacttataaacttttttttctttctggtcttctgacgggatatttcaaatgtcctgtctttaatttcacagattctttcttctgtttgatcaagtctgcaattgaaattctctattgcattttcatttcattcatttatttatttttatatatttttgagacagagtctgtgtcacccaggcttgaatgcagtggtgccatcttggcttactccaacttccacctcccggttcaagcgattctcctgcctcagcctccctagtagctaggattacaggcatatgccaccatgcctggctaatttttgtatttttaatacagatggggttttggcatgttggccaggctggtcttgaactcttgacctcaagtgatccgcctgcctcggcctcccaaagtgctgggattacaggcgtccgccacggcacccagcttgcattttcattttattcattgtattcttcagttctagaatttctgtttggttcttattatttctgtatctttattgaacttttagctttgctcatctactattttcttgatattattgagttgatatatacattctagtaaatttcactgagctatcttaattattttgaattgtcaggcaatttgtagatctctatttttggggggttgattactggagatttatgagtttattttggtagtgtcatatttgctgattcttcatgatctacagactttcattaatgtctatgaagaagcaaatacctcttctttttttttttttttttttttttttttgagacagagtcttgctctgtcacccagctggagtgcagtggtgtgatctcagctcactgtaacctccacctcccaggttcaaatgattctcctgcctcagcctcccaagcagctgggatcacaggcatgtgccaccacgcctggctaatttttttgtattttttgtagagacagagtttcaccgtgttgtccaggctggtctcaaactcctggcctcaagtggtctgcccgccttggcctcccaaagtgctgggattacaggtgtgagccaccatgcccaatctctttctgtctttatagattggtttcagcaggtacaaaccttttcctgctggatcccttgactggatcacagtcaagtgggcctggagccatattacatggctgctgcctggtctgcagctgaatctctgattggcaggccgctatcaaggcataggttggtgatgcagtttctgctggatcctcaggagaactggactgcctctgataccctgattgaacaggactggagccaggtcatggggccacttctagttctacagtcaagtcttcagatatcaggcctattaccaagggcatggactggtatagctccctgtgggtcccagattgagctcctgctggtttactaggtaggtccatgggaagacaggactgcctccagaccacagtagagcagggctagagccaagtcacaggacagctttggtgaccacatttgagttcaagattggtggtcctcttattaggagaatggatggtatgtctttcaccaggtcccaggatgggctggactgtgcccagactgtggcaaagcaagactggaatggagtcacagggctactttagtgtccatagctgagactgagatcagcaggcctgttaccaagggtatgtaaaggcatcactgaattcctgggcaggcatgactgactgtggtagagtggggctgaagccaggtcagggctgctttagtttctgcagtcaggaccatggttagaaggcctgttactgggggcataaatggtcatggttcctcctaggtgcttagtggatggggctagttgcaagaccatgatctagtggagctggacccaagtccataggaggacaaagctgctttcagtctgcaactggtaacctgtcactggtgtgtggacctgccttctcaaagcagctctccttggttttgggctttgctagagttttgccacctcctgcctggatattaaaactcttgcaaaggcagttttgtccatgaatggctgccagatcattgtttgtgtggggagaggtgagtggagggcctcctgttctgccatcttgctgatgtcaccctaagatgattatttgaattctttgtcaggcaatttgtagatcttcatgtctttggagtcagccactggagtttcattttgtttctttggtggtgtcatattttctcatgcttcctgttctttgaagacttagattgctttcttcatgtttgaagaaggagtcatcttttccactctttactaacttcaggagagaaagaccatcaattagctaagctatagattctgggggtctctcagtccttttctgtgggtggtccttcccttttaagggggatgtcttaggattttgtcccttgtcttcatttcacaaatgaataaaacaaccagaccagacataagtaaggaaatacagcacttgaacaacacctgaaaaaacaactagacctaacagacatacacaggatattctacccaacaacataatacacatacttctcaagtatacatgggacattttcaggatagaccatataacacatcacaaattaattctcaataggggctgggtgcagtggctcacatctgtaatcccagagtaatttgggaggctgaggcgggtggattgcttgaagccaggagcttgacatcagcctggccaacatggtgaaaccccatctctactaaaaatacaaaaattagctgggcgtggtggtgcgtgcctgtgatcccagcttcttgggaggctgaagcgtgagaattgcttaggagcccaggaggttgaagctgcagtgagcagagattgtaccactgtactccagcctgtacttcatgacaaagaaaatgtaccattgtaccactgacagaacgagaccctgtcccaaaaaaggaaaaaagctcagtagatttaaaacgatagacatcatacaaagtgtcttctctgaccacaacaggataaagttagaaatcaataacagaagatttaaaaaagttcacaaattagtagaatttaaacaacacactctcaaacaaccaatggatcaaagaaatcacaaagaaattataaaattcttaaagacaaatgaaaatgaaagcacactatatccaaacttatgggctgtggccagttgtggtggctcacacctgtaatcccagcactttgggagactgagggaggtggatagctagaggtcaggagttcaatttcagccaggccaacatggtgaaaccctgtctctactaaaaacacaaaaattagctgggagtggtggtacgtgcctgtagtcccagctacccaggaggctgaggcatgaaaatttcttgaacccaggaggcagaggttgcaccactgagctaacaccactgcactccagcctgggtgacagaatgagactctgtctcaaaaaacaaagaaacaacaaaaaaacacaacttatgagttgtggtgaaaggagtgctaaggaggaaatttatagctataaacacattaaaaaaagaaacacctcaattcaacaacataagtttacacattaagaaactagaaaaagaagaataaaactaaacccaaagttagcagaaggaaggaaacaatagagatcagggcagagataaatggaaaagagaatagaaaaacaataaaaaacaaaaccaaaagttggttcttcaaaaagattaataaaactgacaagactaaggaaaagggaaacaatctaaattacttaaaacagaaatgtatttgagaatatctttatatatttctgtctgtctgtctgtctgtctgcctgtctatgttttagagacaaggtctagctctattgccctggcaacaatcagatgcaaccagaatcagtggcacaatcggctcactgcagccttgaattcctgggctcgccactatgccagctcttttttttttttttttttttaagagacaggatcttgccatgttatccaggctgatcttgaactcctggcctcaaggaattttcccacctcggcctcccaaattgttggattacaggcatgacccaccattcccagcctagaaaggattataaaagattactataaataattgtgtgctcataaattggataacccagatgaaatagatgaattcctagacacacaaaacctaccaagactcaattataaagaaacagaaagtcagaatagacctaacctagtaagggaattgagtcagtaataagacaatctcatgacaaagaaaagtcctggacctgatagctttactggtgagttctgccaaacgtttaaagaagaactaacactgattcttttcaagcatttccaaagagtggaagaggagtgaatacctcttaactctttctatgaggccagcattaccctgataccaaagccaaaaacactgtaagaaaataaaacaacagatcaatatgcctctgatcattgatgcaaaaactctaaaaatgctagtatactgggtggggcacggtggctcatgcctgtaatcccagcactttgggaggctgaggtgggtggatcacctgaggtcaggagttcaagaccagcctgaccaacatagagaaactcttgtctctactaaaaatacaaaattagccatgtgtggtggtgcatgcctgtaacctcagctactcgggaggctgagacaagagaatcgcttcaacccgggaggtggaggttgtggtgagccgagatcatgccattgtacttcagcctaggcaacaagagcaaaactttgtctaaaaaaaaactatcatactgaattcagcatcatattaaaaggattatacaccatgaccaagtgggatttattcctggaatgcaacgatgtttcaatatataaaaattgatccatataaattcagacaattaattttaactgatgtatagttttacattatatgcacataccacgattcacttttccattttcctagtaatgagctttaagattatttccaatttttagctattaccaataatgtttcaacaaacacctttggacatctcttctgcaaatgtgtgtgtattctcttggagaaggtttaccctgtggaatttctagtgtgtatgtgtatgtgtgtgggtatatatatatacacatatgtatatattttcaactttactatatatttccaaaaaactcttcaaagtggcagatttaaactccccttcgccgtgtataaattcacggttcctaaagcccttggcatagttttgtgtttttatagaaaagggcataaagtcttattgctgttgaattgtaccttgctcttttcaattgtcttttcacaataattcactatttatcatctgttgtgaatattgtgtagtagttcttaatcattttttctactatattatttattttatatcatgaatttgtagaaatcctctttatataatggatattatacttttcaattatatattttgtaaatattttacccaattttctggcttgcatttaacctttatttaggatgcctaggatttttcattttaatacagtctaatttatttttcttttcttttcttcttcatgcattctggcatttgattaataagccatttgttgcccaacgtcattagttctctgtatatacttttaaatatcttaaacatgtaatattcataagtaatttcacaagtagtttaagatttgagtctttaacctaaatagatacaggattttgtgatatgctgtaatatacagatttttatttatatatggataaaaatttatatgttttttctgacatcatttattgaatagtataatttttctactgacttttagtatcatatcttttattacaagtccaatgtattcagcatatctatggatctatttcttggtgcttccattttttcccattgtttaacggtgtatcactgagccaaagcaaaccattttaattattataattaaaacacatttaaatattgataggctattattgttcagaataactttggttcttcctttccattgattattttaatatgacttttccaatcaagttctaaaaaaatactggtggtatatttattgaaataactttaataaaattaaatgaaagatcatgtgttttctgaattaattcttagatacgttaatgttttatgttaccatgaatgtgatattataatataatatttttaattggttgctactgtttataagaatttcattttctctttactttgccttcatatctgaaaaccttgctgatttgattagtgcatccacaaattttcttggattttctatgggtaattacaaatctccacacaatgaggttgcagtgagccaagatcacaccactgtactccagcctgggcgacagagtgagacaccatctcacaaaaacacataaacaaacaaacagaaactccacacaatgacaacgtatgtgttttctttttttcttcctctttctataatatttctttgtcctatcttaactgaactggccagaaaccccaggacaatgataaatacgagcagtgtcaacagacatctcattccctttcctagcttttataaaaaataacgattatgcttcaacattacatatggtggtgtcgatggttttgttatagataagcttatcaggttaagaaatttgtctgcttttcctagtttggtataaagattttaatataaatgaatgttgtattttaccatcttattttttttcctacatctgctaaggtaatcctgtgttttccctttttcaatctcctaatgtggtgaatgacattaaaataccttctattgttaaaatattcttgcaacgctgtatagaaccaatgcctttattctgtattgctgatggatttttgaaaaatatgtaggtggacttagttttctaaggggaatagaatttctagtatatttaaactattttgcatgtatgttctgaaggacattggtgtgtcatttctataccatctggctacgagaggagccgactgaaagtcacactgccggaggaggggagaggtgctcttccgtttctggtgtctgtagccatctccagtggtagctgcagtgataataatgctgcggtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgccttggatcatctgccactgatctctggtcaacatttttatcacccaacacaaaagaagcagagatttatcaagttacttaaacaacctgaccctttcatcttttgctacacatactcttgtaattgatctctccatgaattgttttctgtttaaaatatctagaatgttttctgcttcctgacttgattctaatattgtataggtactagaaatggttctagaaatagatctttatagatgagaatctggaagtggtttgctgacctgtttcagtctgaatgaattcctgaccttgttgtcgggaggagacagaaacctgatcatctgtagtgtacggtggtatcatgattacttaaatcatcaaatgtggttattgggaatgatgtgttttttaaagtggtacatgagaggtaaaattgctattgtagttgactgttgcagttataattttgtcaacatggtctgtaagagtgcaatggattcggcccggtgtggtggctcacgcctgtaatcccaatactttgggaggccaaggtgggccgatcacgaggtcaggagatcgagaccatcttggctaacacagtgagaccccatctctactaaaaatacaaaaaattagccatgtgtggcggcacacgcctgtagtcccagctactcgggaggctgaggcaggagaatggcgtgaacccgggaggcagagcttgcagtgagccgagatcgcgccactgcactccagcctgggcgacagagcaagactccatctcaaaaaaaaaaaaaaaaaaaaaaagagtgcaatggaaagctggtagaaaatggacattgtttaaagaccaaaacaaccacactactttgctaatccctatcagctaaagcctagagaatatatgaggtatagatttacatggtgtttgactaaggcatgcagaatataatcttgacataggctaagtttatcaacatagatacatagagattctgaagttaaagtcttagcccaagaagttagaaggggtgctcaagtttgtttgtctgacagaaactgtgaatccacactggcctgcttattttgaggttgtgttgccagagctttcctagcataataaagagaggtgcatacaaaggaataggaatagtaggaggtgggggtaaaaatatcaggtgtgatccacatgccaagccgacccgcactgtgtcccacaggaagcccagaagatgtttctctaagaaattaaggattcgtttgttggggagggctgctggcatgcttgaaaagtactgtgatggctgaattttgtgggcttggggagattgcagattctctgatttcaaggggaatgatgtgatcctagagttgcaaagaacaagtgacagtggaggcgcttatgctttgtgactgcactagagacaaggaagacacaactagaataatggggagcaggaatggagcggccaacagaatatgtgactgttagggatctttgatgaaggctgattctcagggagtgaactacatcagtgaccaactatttgtctttatataactgggtaatgtggatggattctaataaagggactacttacagcacagcaggaaagtcacaaagaaaccagacagaagagtgtaagtagtaaggggccaagcagtcacctgactagagacagtgccagcttgccaagaaggcaccagacagaagctgtgatcttcagcaaagggacacagtctgcctgtgctgaccctgcaggggcagaggtgggggataaacacactcttctctcacctatcttctgccaccccctccattagctgaaccccaataaaagcatgagggtaagggagatctctgaagtatccaattcaggtgagcctcctaaggaacaaagcagaatgcagaaaaattaagagtgggtctagggaataaaatagagatatgcaccagagtatgatgatgtgtctgggaaagaatatacaaatacttttaaaattactagacaataaacctgagatgacactaatacaggtaaatctcatttaatggtaatatattccaagaaatgcatcattaggtgattctgtggctgtgcagacaccaaagagtgtactttatacaaacctagacagcgtagcctactacatacctaggctatatcgtacagcctattgctcctgggctacacacctgtgcagcatgtcactgtgctgaatacagtaggccaatggtccccaacacccaagccatggaccagcaccggttcgtgtcctgttaggaactgggcacaaagcaggagatgagtggctggccagccgaacattactgcctgagctccgcctcctgtcagatcagcagcagcattagaccttcacaggagcacaaaccctattgtgaactgcccatagaagggatctaggttatgttctccttatgagaatctaactaggctgggtgctgtggctcacgcctgtaatcccaacactctgggaggtcgaggcaggtggatcacaaggtcaagacaatcctggccaacatggaaaccccgtctctactaaaaatacaaaaattagctgggtgtggtggcgcatgcctgtagtcccagctactcgggggactgagacaggagaatcacttgaacccgggaggcagaggttgcagtgagccgagattgtgccactgcactccagcctggcaacagtgggagactcagtctaaaaaagaaaaaaaaagaaaaaaagaatctaactaatgcctgatgatctgaggtggaagagtttcagcccaaagccatccccactccgtggaaaaattatctttcacaaaaccagtccctggtgtcaaaactttggggcccactgctgtaggcagttatatcacagtagtaatatctaaacatggaaaagatacagtaaaaacacagtacattgggagaccgaggggggcggatcacctgaggttagaagttcgagaccagcctgaccaacatggagaaactccgtctgtactaaaaatacaaaattagctgggcgtgctggcgtggggctgtaatccctgctactcgtgaggctgaggcaggagaatcacttgaaccccggaggcagaggttgcagtgagccaagatcgtatcattgaactccagcctgggcaacaaaataaaactccttctcaaaaaaaacaaagaaaaaaatatatatatattacaaaatttaaagagagtggtacaccagtaaaggacatttagcatgaacagaggttgcaggactggcagatgctctgatgagtcagtgagtacctggtgagtgaatgcgaaggcctaggatattactgtacataactatagactttatatgcactgtacacttaggctacactaaatgtatttaaattttttctttctttaacaagttcatcttagcttatcataactttataaacttttaatttttttaattttttgattctttgataataacacatcttaaaacaaaaacacattgaacagctgtacagaaatactttatatccttatttgataagcttcatttattttgattttttatgttttaaacatttttgttaaaaactaagatacaaacacacacactagcttagtcctgtaagggtcaggataatcaatatcactgtcttccatctcgaaatcttgtccaagtgaaaggtcttcagggtcttcagtggcaataacatacatgcagctgtcattctctatgataacaaggctttcttctggaagaactcgtggaagaccttcctgaagctgtttcatagttaattttttttaatgagtagtagtactacactctaaaatatgaataaaatctgtagtattatacatactgttgatccttgaacagtgcaagggttaggggaccagctcctgtgcagttgaaaatccatatataattctgggctatccccaaacttaacttaatatgatatatatcatatataatatatatgatatatatcgtatatattacatatgatatatatcatatataatatatacgatatatatcatacataatatgtatgatatatattatacacaatatgtatgatatatattacatacaataagtatgatatatattatatacaatatgtatgatatatattatatacaatatatgatatatattatatactatatgatatagattatatacaatatatatgatagagattatatacaatatatatgatacagattaaatacaatatatatgatacagattatatacaatatatatgatacagattatatacaacatatatgatagattatatacaatatatatgatatagattatatacaatatatatgatatagattatatacaatatatatgatatagattatatacaatatatatgatatagattatatactacatatgatatacatgatatatcatatatatgatatacatggtatatcatatatgatatatacgatatatcgcatatatgatatagatgatatatcgtatatatgacatagatgatatatcatacctgatatagatgataaataatatatgatatagatgatatatatcatatatgatatatcatatattatataataaatgatatatattatatataataaaagatatatattacataataaatgatatatattatgtaaaatatatgatatatattatatattatatctgatatatattatatattatatattttatctgatatatattatatattatatctgatatattatatataattatattatattatattatatattatatattttatattatatgatatataattatattatattatattatattatatatattatattatatataattatattatattatatattatatattatattatatataattatattatatgatattatatattatatataatttatgatatatattatgtattatatataatttatgatatatataatatattatttatcatatatcatatatattatggtatattatatataattgtattatatataataatatataatataccataatatatcatatattatataatatataatataatataatataatgtaatcatatataatatataatatattatattataaaatatattatattatgatatactatatattacatgttacattatataatattttgtataatatataatatatattatctattatactttattatattacatatataattatacattattatatttcatatataattatataattatacataattatatatattatattatatataatgttatgtataacaatatatattatacataatattatatattatattaaatatgatattatatataaggatgcaggatgtaaaaggaaattatatatatgttatatattatatatattatattatacataatatatatatatatttgggggtgccctatttcctatctcataacttattttaagaagcacagcataataatgtgtggacttgggattcagtttttgaaatgaaacactgagccttcgatgaccttcctgtacatgtgaaagcacacctgtctgcatggcagcagttggacctcacagtgtggattgtgccttcaccctggaatgtttatgccctatcgccatggtgatgggattagggatctgctgcccttggtcctaagtgccactatctgtgctgagtttttcaaaggtcagagcagattgaacctttgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatggttaggttttattcctcaatttatatatttgattattgtaccaagcagagtacctttgaaatttttcttcatttaaaaaatatgtatcttggctcaagcctgtaatcccagcactttgggaggccaaggcaagaggatcacaaggtgaggagatgaagaccatcctggccaatgtggcgaaaccctatctctactaaaaatacaaaaaattagccaggcatggtggcagctggtgtagtcccagtgtggtgtagccccagctacctgggaggctgaagcaggacaatcgcttccacccgtgaggcagaggttgcagtgagccaagatggcaccattgcattccagcctgtgcaacagaacaagaatctgtctaaaaaaaattatatatatataatgtatattatatgtactatatattacataaaacatataatatataatatatataatatatataaaatataatatacattatatataaataatatatattatatgtcacgttatgtaatatctatgatacatattacataataaaagacatatataatatatgatatatattacatataatatatgatatatattacatataatatatgatatatattacatataatatatgatatatattacatataatatatgatatatattacatataatatgtgacatatattacatacaatatgtgacatatattatatgtaatatatgatatataatatataatatatggtatataatatataatatatgatatataatatatgatatataatatataatatatgatatataatgttatattacatataattatattatattatattatatatatcataatatattatataatatataatatatatcataatatattatataatatataatatatatcataatatattatgtaatatatataatatatcattttatatattatatataatatgtcataatatattatataatattatatataatatatcataatatattatatattatattattataaaatatataatactatataatgttatatataatataatattatattagattataatatataatattatattagattataatatataatattagattataatatataatatattagattataatatacattatattataatatattattgtataatatgttataatataatatatattatatattatattatacataatattatattatatataatatatataatattttatacaacatattatatataatatcttatataatatattatacaatatattatattgtataatatattatatatattatgtattattatcttgtatatataattatatataattatataattatatatattatattataggtaataattatatataattatatattatattatatgtaataattatatataagtatatattatattatatgtaataattatatataatttatgtattatattatatgtaataaatacacataattatatatattttattatatatattatgtataattgtatattatattatatataataattataggttatattagatatattaattgtattttatattatttttaatattagttaatattaattaataataattaatttaaatattaattattattttatatattatattatatattatgttatatattatattatatattatattatattatatattatattatattatatattatattatatattatattatatataatatagataattatatattatatatcattatatataattacatatattatattatattgctatatatattcatatatattatattatatataataatacctattatattatacataatattatatataatataaggatgcaggatgtaaaaggaaattatatatatgttatatatattatatatattatgtcatatataattatatatatatatttttttgggtgccctatttcccatctcataacttattttaagaagccagcataataatgtgtgggcttgggattcagtttttgaaacaaaacactgagcctttgatgaccttcctgtagttgtaaaagccctcacctgtctgcatggcagcagttggacctcacagtgtggattgtgccttcaccctggaatgtttatgccctatcgccatggtgatgggattagggatctcctgcccttggtcctaagtgccactatctgtgctgagtttttcaaacgtcagagcagattgaaccattgtggtttcattttccctgattttgatttttcttatggggaacctgtgtggctgcattcaaggtatgttcttactggcctgtcaaatgcgatcttttcaaattactagttaatactttcaaaatatattatttaaaaaattagcctctgtattttccatatgcagttataaatatgtttcatgattatgttttattcctcaatttatatatttgattattgtaccaagcagagtatctttgaaatttttcttcatttaaaaaatatgtgtcttgactcaggcctgtaatcccagcactttgggagcccaaggcaagaggatcacaaggtgaggagatcaagaccatcctggccaatacagtgaaaccctgtctctactacaaatagaaaaaattagccaggcatggtggcagctggtgtagtcccagtgtgaattgggattcagtttattcccaaattcccaaattttatatatatatatatataaaatatattaaatatattatatatatactatatattatattatatataattatatatatatatatttttgggtgccctatttcccatctcataacttattttaagaagccagcataataatgtgtgggcttgggattcagtttttgaaacaaaacactgagcctttgatgaccttcctgtagttgtaaaagcccacctgtctgcatggcagcagttggacctcacagtgtggattgtgccttcaccctggaatgtttatgccctatcaccatggtgatgggattagggatctcctgcccttggtcctacgtgccactatctgtgctgagtttttcaaaggtcagagcagattgaaccattgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattactgtaccaagcagagtatctttgaaatttttcttcatttaaaaaatatgtatcttgactcaggcctgtaatcccagcactttgggaggccaaggcaagaggatcacaaggtgaggagatcaagaccatcctggcgaatacagtgaaaccctgtctctactacaaatacaatcaattagccaggcatggtggcagctggtgtagtcccagtgtgaattgggagtccgtttattcccaaattcccaaattttatatatatatatatataatatatataatatataatatattatatatattttatataatatataatatatataacatatatattatatataatatatacattatatgtaatatattatatatattttatattatatataaaatatatatactatatataatatatatagtatatataatatatattatatataatatatatagtatatataatatatattatatataatatatatagtatatataatatatattatatataatatgtataatattatatattatatatattatatatattatatattatatattatgtatataatatatattatttatatattatatataatatataatatataatatataatatataattatatattatatatattatatattatataatatataataaataatatatattatatatataatatatatgatatataattatatattatatattatataatatataatatataataaataattatatatcatatatataatatatataatatatataaataatatatattatatacataatataattatcatatattatatatatgtcatatataatatatgtcataatataatatatgtcataatatatataatataatatatgtcataatatatatataatttccttttacatcctgcatccttcaacctgcatccttcaacgttccatcccccaccccacagattaagttattcccctggggagaatatggcgaagtctattttaatgctgtttttaacccaattaagaacctatgaaatcattactttccaaaactttggaacaaagccacagtagtaaggatccgttggaggcttttcacacaataaaatgtaactctctttgtttttaacatgtttttcccttcctctcttctttttttgtgaaatgtgtatttactttaatatatttgtagtaagtcacttccatgcacatattaattttttaaagtaataagcatgtgtattgtctacgtgtgaaagaaaacacacatttatttttatgctttggaagttatccagaatcatggaattgtcaatcacagtcaatcacccaacctactcacctttccagtgtaatcttagtcaaatttttttttttgttatccaatgagatgcagtatttcaactcagaaagataaatagagtgaatttatagagactattaactaagaacatacagtttgatttatactcagaagcaagtagattatgtacatatatatgaagataaaaattaaaaggataattgtgtaaatttgcatgtagagggctttgaaaacctgtttacttgtgaatgctgttttgatgtattgtgtctttgttctcccgacccatcatccagagctctctgcaggagctaagtgctcatcagttccatgacttggaaactgtctaagtttagaggcacttgtatttgttagtaaataaggcaagatgatattgtttcacaggttttagtgccgaagactgaatagataagctgctccacccagtacactggtgttcatttcatggtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaaaattcacacataaacagggcagaaccctataccctccatgataaatgcagtagcagtgtatgtgggtctgtggaggttgaaagggacttggtcgatgtcaagaaggtagtggcagtcctgctgggcttttaaagggtctgaagaagtgacaggatgctgtggttgaatcgtagcatgtgttttagcatttgttcatttggagttgattatttcacgttgctttcatttgccattacctggaaagccaagggctctactctcatttccttgctgctctttctttgccttccttggtccgtgaagaagatggtccaggagaagctcattccatgcttgttaaccaggcacgcccctaagttccagtccctgagtcattcatgagtagcactgccaatgaactgacagccatgctgtgtccctccacatcccctaggtgactcgaagaagccttccaaaaagcgtgtgaaaaggaagccctactctaccaccaaggtaaagtagcctgtctttgcctaagatgtaaatgttgttttcttggatcctttatttttcagttgatatcagctatgggaaaattctccactacattataggtgttagataatatttccttggggatggaggaggtgtattttaccaactgacacctgattccagaggacgtgcaaaattggcagtgtcagatagtacactgggtgttaagggatgttttcttcaggaacaagctttccactttagataagaattctgcaattgctactcaaaaattacctagacagaaacattcttcaacaaaagctcctgtgctttcctaaggcaactctactctagagttggggcttttgacttgaaccttatttccagtcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctaggaaaaaaatgttgtgtttacccagcacaactctcagtgccatgtttcttaatttaacaaatcagaccacatactttacttacattagttcacacctcatcatcatcatgcccatatgttgtgagcttgtttattgagcccacatgccagatggagaaactaagccacataaataaatgtgccctggttcacttgctgcatagtgaagagtcaaaatgtttcctcatacggtgctaatgttgaaggcctgaactacaaccactatttatcagccagtgaagagatcactattcaccatgcaagggagttccagcaccctctatgcctggaattacccacgcctgcagagatcccaaacgccatccctcacataagacagcctcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaatgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgttatccgggtatccgtcgtccttgtggcaaccctcttgtgaagctggtgtggacagcctcagtgctggagctgtgcctgccttctgagtggaccctttctgtgttagcaggtgggtacaagcgtgggggtcagcacactcagtggatttacacacacagcgttgaagagtaaggctgggcttcattatttatacattttcaataaatgatgatcttcataacataaaatcaatgatgtagtacactagaatactgtccctagtattgaatcttgtctctcagcaaagggttgcttaaagtcacgtgacagattccattcaactgatgacacatgctgtagcagcagttaaagcagtcatttgaaaaggcttttactataaacttacgtgtgagcctgaagtgggggataaaagaggcgattagctcccctgtgccatgtttctcttatgtgcgtggtggaggaaaattacacaggaaggtgatggagagaacagagcaaaggattggacaggtccattgaacccataagactatggtgaggttagtgaatgagactggtcattttaggtcaaattttacccagagctggtgcagccactgcccattcttagccagaccttattgcaggcagctctgatcaatagtcaaggaggcagtgggggttgcagacttaattcattaaatcaccaaagcaccagcccacacggccacttttccagttaattcacagtagcttgcatattcaggtttgatcagtggaagggaagttactctttgcagacccatcttttgacaatcattttgcagtgtcggaaggtctgagcagcctcgggaggcaagcagtccctggtccctcagtgtagtcactggaggagacagtcactgagaggcagctggcagggtgaagggaaaggggaggcaggccacagagatgacagcctttaagctgtcatactgggaggtcaaggatctgaaagaggaaggagaattctttatcattaaggacctgtccttatctcaggcatttcctccagagcatcacctttgtccacccacacaccttgggctaggaggactggagaaaaacagtgaggggtctcttgggtctctggcacagggcgtgatgaagaggtggcagtttttcaggaatctctctctctagggaaccaaatacatttcccatctcaggtccttcactcagcggggttgaggttctgctcgtcacttatcatctctgaatgtcagcaccctcaagtgtaaaatctcagtcacagcccctcctctgcaccccctgcagggctgatgttctccataaaccataaggcatcatgcccacggaaaagccgaacaggaaagcatgctccactgccccggagccatccaagttccccctccatattccgccactgctgagtgtccagcttattcctcctggcctgtagtaaacacttagagaacattactgaagtaccagtcctctctaaggttttcctgtatttagtgattttttagccctgtactgtgatactaagaagtagggcctaaatagggcctaaaaagtattgctaaaattacattatgacagtgcagagaactgagggcagagggaggacatgagcttgccaggtccacatggcttagtggaatttgaatccgggcccctactctgcaccagccctgcactcacagtcatcctgctgtattctcctctccaggaaggcactgcccacgcagtctgtctgatagaggtgttgagtgctcactgaactccgtgatcttcctgaaacccaactttgattcagtgggctctgcttggaagcctgtaaagaaaaggatcataagtttaaacttagaacagattatcactattttccctctggtcctctgtcagcaagatgtcaacagccctatctattgtaaatgcattaaccagcatcttctctgatagagaatataagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgtttcaagctaatgtctagaacttacctggttgttaaacataagcatagatctccctgaaagagtggtgctatattattatttttcaattaatatatttctttagagagttttaaattgacataaaaactgagcatatggccgtgtgtggtggctcacacttataatcccagcactttaggaggccaaggcaggcggatcatctgaggtcaggagttggagaccagcctggccaacatggtgaaaccccatctctactaaaaatccaaaaaaattagccgggtgtggtggcaggcgcctgtaatcccagctactcaggaggctgaggcaggagaatcgcttgaacccgggaggcagaggttgcagtgagccaagatcatgccattgcactccagcctgggtgacaagagtgaaactccatctcaaaataaataaataaataaataaataaataaataaataaataaaaattgagtatataatacacgaagttcccatattattctgtctcctcaccctcacttcctaatttcacctattagtaacatcttacattactgtggtacatttgctagaataatgagaaaatattgacacattattatctgaagtctgcatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtacgctttagctgctttcatgtcttttttatgccttaatggcaaaaaatggcacattaaatcaccaaataatattgcattaaatgaatttttgtctttttattcacctgttgaagaattcggtagatttcatgagagaaaccatctgggcctggtgctttctttttcggaatgctcttaatgtgaattcaacttatttaatagacataagtttattcaaattaggatcctagcatgaccttgggaagattgcctttcaaggaattgatacatttcactgaggttatcaaactgcgctcatagaactgttcatgatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctatagatttccctctaaggactgcttttgctacatccagaaatcttgccaagtcacattttcttttaatgtagttaaaagtacttttaattttctattgagacttcttctttaacccaacagttatttaaaagtgcattgctaatttgcaaatatttggggattttgtggctcttttacagttgttgattttttgttgtcaggtgtgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggcgagggggcatcaatggcagttctgctgtggcactgccctccttcttagcttgtcttgctctgtcttaggctccctcaaagatcccacccttcaggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaaaatcaaggaagatgtaatagttttccataaattagaataccctacatgtacaattaaatgaaatggctagtatagtcttgaaaccaaaaccagataaggtaaattaaattctgtgatattttaaaatactgtaaattctgactaatgtgagttaatctcaatatatgaaatagtagattaacattgaaaatgcaataaataaaattagctacctcaagagtttaatggaaaaaaatgtgattattgcaatagattcaggaaattcatgaataacattcaccctatatttgtaggacaactatctaactttaagtgacctgtgacaaccatttgaattaatgctgctttcacagcatatctcttggcttgttaaaaacccgacaagaatttccgtaacattaatttatttttaacacctatattgggtgtgaacccaccataaagtttgcccactgaaaaggtctacaatttgatgctttattaaattgatactgtgtgcacccatcaccacgatctaatttaaatatgtttccctcacccaagttctctcttgcgcactggcagttaatccccactcccatctccagccctaagcaatactgctgtgacattccatctccataaatttcccatttgcttaatagaaatggacatatatatatatttggaatctgacttccttcatttagcatactatgtttgaagttaattgacgtgttagcacgtgctggtcatgtgttttccttcatagtctgctgtgtttactcatacagatagtgtttattcatttatcagttaatggacatttaattgttttgttattttctttgatgagtaatgtagctttgagcattcatatacagtcatgtaatgcataatgacattttggtcaaaaaaatttttttttttctgagacccaggctggagtgcagtggcacaatctcggctcactggaacctccacctcccaggtttaagcaattctcgtgcctcaacctcccgagtagctgggacaactggcacacgccaccatgcctggataatttttgtattttcaggagagacaggattttgctgtgttggtcaggctagtctcaaactcctagcctcaggtgatccacccatctctgcctcccaaagtgctgggattataggcatgagccaccacacccagcctaatttttttaagaaagaagggaactattttctaaattacttttgccaatttatatttctaccatgatgcatagcactaatttcaccgtacaatgtatggtaggccccaatatgtaagaaatgatgaaagtaacacataaagattggtataaaacaaataagattatcattgttgctatcatctttgtcaaattctgaaaacaatctgagtatatttttatataaatatgcttggcaacatagctgaaaaacgcattatcagttacatttatcagtaacaaagacataaatttgaagggggaaaaacacttgtactaacaacgcaatgtcagaattaacataaaaattctgctggtcactttggaatatttaattgcctggggcagtgtttagtagacaaatgagcatctatggagcacccaaagtaggggaatcaacagaacttgggtttcaaaagttatctgggtttagagcgtgaaactttgttagaggacacacaccttgcatgagcgaggtgccttggtgtgtgtggacgtaccattatgcttggaggtacagcataatggtggcttcctccagaaagggacatttggggtggattcattccatctagacaacacagcctgatgtggcatggacatgaatggaggtgaaatggtcagtagttgagaggatcagtcctgacaagggccgaggtgaaaaacctgggaaccccttcaggtgcaaagtcttcagttgaaaaaggaggtggtcacaggaaatactgagacaggacagcaaagcatgggagacagagttcttggccctgcagggtgagtactgtggattctcaaattttctcctctctccattaatttctttcccaatgcagatgacttccatcatacagtcttcagcaatcttgaaagattggacaagcttcagcccactcttgaaggtaaaggaaggcagctaacaagactggcatctgggcttggctgtgcgtgttttctatcgtggggaaatatatataacacaatatttatcatttgaaccttttaaccaaagtgtgcactccatggcattcaatatattcacagggttgcataaccagcaccactatctacacccacaattttgatgatttcttacgaaaccttgtccacaataagcaatatagcaccttccccctatttccagcccatggtgattcctatcccactttctcttgtatgaatttgactattctaggcacttcatgtaattacaattatacaatatattccttttgtgtctggcttatttcactaagcataatgttctcaatgtccacccatgttgtagcatctatcaaaatgatgttcgttttttacagatggatgatgtagcattgcatgcagaccactttgcttttattacattcatttgttcactgatggttggattatttccaccttttggctcctgtgaaaagtgatgctacaaacattagtatacaaacatctgtttgatttccgttctctattctttggggtgcctaagagtagagttcctgggtccaacaggggttctatatttaaccttctgagccactgcagactgtttttcacagtggctgcaactttatccatttctaccatcaatgtatcagggttacaatttctttacgtccttcttcacacttattttcctttaaatcatcctagtaggtgtatattggtggctgcttgtgtttttcatttgcatttccctaatgactaatgatcctgagcagcttttcctgtgctactatctgtggctgtatcttctttagggaaatatatgttgaagtcttttgcccatttttaaagagttgtctgatttttatttagttagtttgttgttgtagatttttgaatatatcttaaatatatttaaaatatattctaaattttagtctcttacaagataaatgatttgcaaatatttccacctttgtgtagaactttagattcacaaacttcattaatttgtatgaaatcctcggcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgtttagttcaccacacttgttgcaactgtttgcgctgcagagttaaaacacaccagcattcaacccatgtctcctctcttgaagtaaactgtcgtatgttggctggcctgaacaagcgtagatattctccatcctcaattaatatgcatgcatgacaaagaaaaggaggcctggatgaaaaaatattgtgtgattaataattatgctttaattaattttaaaagatataatttcagtacttctaattctcccatcagcagttataacaaaggattagtgaataaataccatagactgttttgcctagaatcgaatccaatctgtctattaaactttgcttttattcaagtgcaaaatgctaaaacacataataactgcagtgacagccactgtggatcctcagaggtaaaagtagtcttgggacataaatcctgcaagctaatatcgtttttacagggtttagaaaaccatttagctgggtttcaaacctcacagtgtgagcagtgggactctcatcaaactatagcatgtgcttcagtaccatttgtagactgactcattcccattgccttaagttgccatcagcaaaatgccagggactctatttcttgctccttagctcctcgttcttgcctgtctttccaccagggaagattttctagcaggagctcaagctgtgcttttaatgaaacacatccacacacactgtcctgttgtccacattgagcagagctccctgaataactcatgaacaaaagcatctatgactaactgttgctctgtgtcctcttagcctctgaggagtctctagttcacaaggacagaggagatggagagaggccagtcaacgtgagggtaaggttgccttgctttctctgaaatagaaatgttcctttcttggtgtctttctttttcaactgactttacatgtgaaaaaatgacaatgtccatgacaggtattaaatgcagttttctgagggggaggaagaagtgactcttagcaactgatatgtaatccaaaatggcatttagctatgacggcttcaggttgtggactgtatccttggggtccttgtccttggaagcaatgtcttctccttggattcagtattttgcacttgccaacctacgtggacctgagagatacaccgtccagaagctgatgccttttccagtgtgtatcctacccttgttttggaggccttgaagttgactacactttctgatcaagttttcaatattcattgagagaaacacagccttgtgcaaacaatccacaacgtgacatacccctcaaaaagctttgtttctgtattgcaggtggtgcaggtggcccctctgaggcatgaatctagtaagtattctggaatcacttgccaagaaaacaatctggatgccaagaaaggtgtggcatccttgcctggtttcaatgtgaagagccaccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccacttatacaacccaatcaccagtgtccacttctaacaataaaatccacccccgctctactctctctgtacagtgactcctccaccctcaccagagccatccccgggtctgccttattatccccactgctcaggtggagaaactgaagggccaagggagtggccccagctcccgagttcctgaatgaaaaagtgaaaacacgaacccaggagtgtgggccagtgctgacgctgacatggcacttagtcatggggtgttcaccaccacacagggagtccaacattcatgtataagccctaaagcaccgagcccaaaaggccccagacactgcccatcatcataaagtgggctccgtggtcacacaacccaaggcagttataggctcatctccccacagacaggcatagtcatcagtgtgtcaaaagcacaaagatccccaggtgtttggctcagctcaccaatccttttttttttttttttttaacttttaagttcaggggtacatgggcaggatgtgcaggtttgctacatatataaatgtgtgtcatgagagtttgttgtacagattattgcatcacccatatattgagcctaatatcagttatttttcctgatcctccccctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgaccggctagtgccgggtatggccaccagcccaactgaaacaaaatgttgctttaaaacacgtgtaaatctcatacatacaacaggcaaatgcagaagcagtgtggtctcgcaagttgtaaagaggacagtcgcaattttgctggacttcaacctgggtagaagacatgagggaactctgtcactgaatcacggcagagttcaaggccacttgcagactatttcatgttatagaaggtggcctttagctactaagcaaaggcctctgtttctcatttctttcctgttcatcttcttcgtcatccttcttccgcaagggaaacgagcccaagcaaaagacagtttcaatattaatttgaccgaggttttgtgcagttaattatcatccaggtaatcaggtgcaacccagtctgcctagcagcccccctatctctgctctgtgttttcatttaataaacattttggtctacttactatgtgctagattttctcgagaccaagtaaatgagatagaatctttatgttggcagctaagttagatttaacataactgacaaaaattaaaatttctgatttcttgtaaaaatattttgtatgtgtgaatgcatactgaatgtaaagtggataaaaaaaatcacacttgcactcatggaaggcttttcatgaatttgtcaatttctatttttttatatttccccatttcaccggataatacatacctgaacctggaaaatgattcccacagcagaaagtgttctgagccacatcccttagcttcactagtgcaggtccacctgggagtatgtcccaccatcagcttgacccatgctgtaatcagccacctccatgcatcacaccaagcaagcccctgggtgattcacagtctccagcaccagggcactgaccttaactctgtgttcttctagctccctatgaggacactgtacacgacatcgctaatgaggacgctgtatatgacattgctactgaggacgccatatatgacatcgctaacgaggacgccgtccagggcatcgcaaaggaggacgccgcccagggcatcgctaacgaggaagccgtccacgacatcgctaacgaggatgccgcccacgtaatcgctaacgaggacgccgcccagagcatcgctaacgaggacgcggtccacgacatcgctaacgaggatgccacccagggcatcgttaatgaggacgccgcccacaatatcgctaatgaggacgccgcccacggcgtcgctaacgaggtcgccgcccagggcgtcgctaacgaggacgccgtccactgcatcgctaacgaggtcgccgcccagggcgtccttaaagaggacgccgcccaggacatcgcaaacgaggacgccgcccagggcatcgctaacgaggacgccgcccacggcatcgcaaacgaggacgcagcccaggacatcgcaaacgaggacgccgcccaggacatcgcaaacgaggacgccgcccagggcatctctaaggaggacgccgtccagggcatcgcgaacgaggatgccgcccagggcatcgctaaggaggaccccgtccagggcgtcgctaacgaggaccccgtccagggcgtcaataacgaggacgccgtccagggcatcgctaaggaggaccccgtccagggcgtcgctaacgaggaccccgtccagggcgtcgctaacgaggacgccgtccagggcatcgctaacgaggacgccgtccacggcgtcgctaaagaggtcgccgcccacggcgtcgctaacgaggatgccgcccacgcgatcgctaagccggacgccgcccgcggcatcgctaacgaggttgccgcccagggcatcgctaccgaggacgtcgccgacggcatcgctaacgaggacgccgcccacggcgtcgctaacgaggtcgccgcccagggcgtcgctaacgaggacgccgtcgagggcgtcgctaacgaggacgccgcccagggcgtcgctaaagaggtcaccgcccacggcgtcgctaacgaggacgccgtccagggtgtcgttaacgaggacgccctccacggcgtcgtcgctaacgaggatgccgcccaagcgatcgctaagccggacgccgcccatggcatcgctaacgaggtcaccgcgcagggcatcgctaacgaggtcgccatccacagcatcgctatcgaggacaccacaccgtccagggcgtggctaacgaggtcgctgcccagggcatcgctaccgaggatgtcgccgacggcatcgctgaggacgccgcccatggcatcactaacaaggaggccgcccaggccatcgctaagcaggatgccgcccacggcatcactaacgaggacgccgtccagggcgtcgctaacgaggtcgccgcccagggcgtcgctaacgaggacgccgcccacggcgtcgctaacgaggtcgccgcccacggcgtcgctaacgaggacgccgcccagggcgtcgctaacgaggtcgccgcccagggcgtcgctaacgaggacgccgcccagggcgtcgctaacgaggacgccgtccagggcgtcgctaacgaggtcgaagtccagggcatcgcacacaaggacgccatccagggcatcgctaacgaggatgccgcccacggcatcgctaacgaggtcgccgcccacggcatcgcaaacgaggacgctgcccagggcatcgcgaacgaggacgccgcccagggcatcgctaacgaggtcgccgcccacggcatctctaaggaggacaccgtccagggcatcgcgaacgaggacgccgcccagggcatcgctaaagagaaccccgtccagggcgtcgctaacgaggaccctgtccagggcgtcgctaacgaggttgaagtccagggcgtcgcacacgaggacgccgtccagggcatcgctaacgaggacgccgcccacggcatcgcgaacgaggtcgctgcccagggcatcgcgaacgaggacgccgcccaggacatcgcaaaggaggatgccgcccaggacatcgcaaacgaggacgccgcccagggcatctctaaggaggacgccgtccagggcatcgcgaacgaggacgccgcccagggcatcgctaaggaggaccccgtccagggcgtcgctaacgaggacgccgtccagggcgtcgctaacgaggttgaagtccagggcgtcgcacacgaggacgccgtccagggcatcgctaacgaggacgccgcccacggcatcactaacgaggtcgccgcccacggcatcgcgaacgaggacgccgcccagggcatagcacatgaggatgccgtccagggcatcgctaacgaggacgccgtccacggcgtcgctaaagaggtcgccgcccacggcgtcgctaacgaggatgccgcccacgcgatcgctaagccggatgccgcccacggcatcgctaacgaggtcgccacccagggcatcgctaccgaggatgtcgccgacggcatcgctaatgaggacgccgcccacggcgtcgctaaagaggtcaccgcccacggcgtcgctaacgaggacgccgtccagggcgtcgttaacgaggacgccctccacggcgtcgtcgctaacgaggatgccgcccaagcgatcgctaagccggacgccgcccatggcatcgctaacgaggtcgccgcccacggcatcgcgaacgaggacgccgcccagggcatcgctaacgaggtcgccgcccacggcatctctaaggaggacgctgtccagggcatcgcgaacgaggacgccgcccagggcatcgcgaacgaggacgccgcccagggcatcgcacacgaggacgccgtccagggcatcgctaacgaggacgccgtccacggcgtcgctaaagaggtcgccgcccacggcgtcgctaacaaggatgccgcccacgcgatcgctaagccggacgccgcccgcggcatcgctaacgaggttgccgcccagggcatcgctaccgaggatgtcgccgacggcatcgctaacaaggacgccgtccacggcgtcgctaacgaggtcgccgcccacggcgtcgctaacgaggatgccgcccacgcgatcgctaagccggatgccgcccacggcatcgctaacgaggtcgccacccagggcatcgctaccgaggatgtcgccgacggcatcgctaacgaggacgccgcccacggcgtcgctaacgaggtcgccgcccacggcgtcgctatcgaggacgccgtccagggcgtcgctaacgaggacgccgtccacggcgtcgctaacgaggacgccgcccagggcgtcgctaaagaggtcaccgcccacggcgtcgctaacgaggacgccgtccagggcgtcgttaatgaggacgccctccacagcgtcttcgctaacgaggatgccgcccaagcgatcgctaagccggacgccgcccatggcatcgctaacgaggtcgccgcccacggcatcgggaacgaggacgctgcccagggcatcgcgaacgaggacgccgcccagggcatcgctaacgaggtcgccgcccacggcatctctaaggaggacgccgtccagggcatcgcgaacgaggacgccgcccagggcatcgcgaacgaggacgccgcccagggcatcgcacacgaggacgccgtccagggcattgctaacgaggacgccgtccacggcgtcgctaaagaggtcgccgcccacggcgtcgctaacgaggaccctgtccagggcgtcgctaacgaggacgtcgtccagggcgtcgctaacgaggttgaagtccagggcatcgcacacgaggacgccgtccagggcatcgctaacgaggacgccgcccacggcatcgctaacgaggtcgccgcccacggcgtcgcgaacgaggacgccgcccagggcgtcgctaacgaggacgccgcccagggcgtcgctaacgaggacgccgtccacggcgtcgctaacgaggacgccgcccagggcgtcgctaaagaggtcaccgcccacggcgtcactaacgaggacgccgtccagggcgtcgttaaccaggaggccctccatggcgtcgtcgctaacgaggatgccgcccaagcgatcgctaagccggacagcgcccatggcatcgctaacgaggtcgccgcccagggcatcgctaacgaggtcgccgtccacagcatcgctatcgaggacaccacaccgtccagggcgtggctaacgaggtcgctgcccagggcatcgctaccgaggatgtcgccgacggcatcgctgaggacgccgcccatggcatcactaacgaggaggccgcccaggccatcgctaagcaggatgccgcccacagcatcactaacgaggatgccgtccagggcgtcgctaacgaggacgccgcccacggcgtcgctaacgaggacgccgcccagggcatcgctaacgaggtcgccacccatggcatctctaaggaggacgccgtccagggcatcgcgaacgaggacgccgcccagggcatcgcgaacgaggacgccgcccagggcatcgcacacgaggacgccgtccagggcattgctaacgaggacgccgtccacggcgtcgctaaagaggttgccgcccacggcgtcgctaacgaggaccccgtccagggcgtcgctaacgaggacgccgtccagggcgtcgctaacgaggttgaagtccagggtgtcgcacacgaggacgccgtccagggcatcgctaacgaggacgccgcccacggcatcgctaacgaggtcgctgcccatggcatcgcgaacgaggatgccgcccagggcatcgcgaacgaggacgccgcccagggcatcgcacacgaggacgccgtccagggcatcgctaacgaggacgccgtccacggcatcgctaaagaggtcgccgcccacggcgtcgctaacgaggatgccgcccacgcgatcgctaagccggacgccgcccgcggcatcgctaacgaggtcgccacccagggcatcgctacccaggatgtcgccgacggcatcgctaacgaggacgccgcccacggcgtcgctaacgaggtcgccgcccacggcatcgctaacgaggtcgccgtccactgcgtcgctatcgaggacgccgcccagggcgtcgctaaagaggtcaccgcccacggcgtcgctaacgaggacgccgtccagggcgtcgttaacgagtacgccctccacagcgtcgtcgctaacgaggatgccgcccaagcaatcgctaagccggacgccgcccatggcatcgctaacgaggtcgccgcccacagcatcgcgaacgaggacgctgcccagggcatcgcgaacgaggacgccgcccagggcatcgctaacgaggtcgccgcccacggcatctctaaggaggacgccgtccagggcatcgcgaacgaggacgccgcccagggcatcgcgaacgaggacgccgcccagggcatcgcacacgaggacgccgtccagggcattgctaacgaggacgccgtccacggcgtcgctaaagaggtcgccgcccacggcgtcgctaacgaggaccccgtccagggcgtcgctaacgaggacgccgtccagggcgtcgctaacgaggttgaagtccagggcgtcgcacacgaggacgccgtccagggcatcgctaacgaggacgccgcccacggcatcactaacgaggtcgccgcccacggcatcgcgaacgaggacgccgcccagggcatcgcgaacgaggacgccgcccagggcatcgcacacgaggacgccgtccagggcatcgctaacgaggacgccgtccacagcgtcgctaaagaggtcgccgcccatggcgtcgctaacgaggatgccgcccacgcgatcgctaagccggacgccgcccgcggcatcgctaacgaggttgccgcccagggcatcgctaccgaggatgtcgccgacggcatcgctaacgaggacgccgcccacggcgtcgctaacgaggtcgccgcccacggcatctctaaggaggacgccgtccagggcatcgcgaacgaggacgccgcccagggcatcgctaaggaggaccccatccagggcgtcgctaacgaggttgaagtccagggcgtcgcacacgaggacgccgtccagggcatcgctaacgaggacgccgcccacggcatcgccaacgaggacgctgcccagggcatcgcgaacgaggacgccgcccaggacatcgcaaacgaggacgccgcccagggcatcgctaaggaggaccccgtccagggcgtcgctaacgaggaccccgtccagggcgtcgctaacgaggacgccgtccagggcgtcgctaacgaggttgaagtccagggcgtcgcacacgaggacgccgtccagggcatcgctaacgaggacgccgcccacggcatcgctaacgaggtcgccgcccacggcatcgcgaacgaggacgccgcccagggcatcgcgaacgaggacgccgcccagggcattgcacacgaggacgccgtccagggcatcgctaacgaggacgccgtccacggcgtcgctaaagaggtcgccgcccacggcgtcgctaacgaggatgccgcccacgcgatcgctaagccggacgccgcccgcggcatcgctaacgaggtcgccgcccagggcatcgctaccgaggatgtcgccgacggcatcgctaacgaggacgccgcccacggcgtcgctaacgaggatgccgcccaagcgatcgctaagccggacgccgcccatggcatcgctaatgaggtcgccgcccagggcatcgctaacgaggtcgccgtccacagcatcgctatcgaggacaccacaccgtccagggcgtggctaacgaagtcgctgcccagggcattgctaccgaggatgtcgccgacggcatcgctgaggacgccgtccagggcatcactaacgaggaggccgcccaggccatcgctaagcaggacgccgcccacggcatcactaacgaggacgccgcccagggcgtcactaacgaggtcgccgcccagggcgtcgctaacgaggacgccgcccacggcgtcgctaacgaggtcgccgcccacggcgtcgctaacgaggacgccgcccagggcgtcgctaacgaggtcgccgcccagggcgtcgctaacgaggacgccgtccacggcgtcgctaacgaggacgccgtccagggcgtcgctaacgaggtcgaagtccagggcatcgcacacaaggacgccatccagggcatcgctaacgaggacgccgcccagggcgtcgctaacgaggacgccgcccagggcgtcgctaacgaggtcgccgcccacggcgtcgctaacgaggatgccgcccacggcgtcgctaacgaggtcgccgcccagggcgtcgctaacgaggacgccgcccagggcgtcgctaacgaggtcgccgtccacggcgtcgctaacgaggacgccgcccggcacatggctaaggaggacgccgcccaggacatcgctaacgaggacgccgcccacggcatcgctaacgaggacgccgtacacggcatcgctaacgaggactccgtatacggcatcgctaatgaggatgccgtatatgacatcgctaatgacaccgtacaaggcacgctaacgaggacactgtacaggacatcgctaatgaggacaccatacaaggcatcggtaatgaggacgctgtatacgacatcgctaacgaggacaccctacaagccgtcgctaacaaggacactgtacacaacatcgctaatgagggcaccatacaagacatcaccaatgagggcgctttatacgacattgctaatgataccgacaaggcacgctaacgcggacactgtacacgacatcgctaatgaggacaccgtataagacatcgctagtaactatcgcaagaacaaaaaaccaaacactgcatattctcactcataggtgggaattgaacaatgagatcacatggacacaggaaggggaatatcacactctggggactgttgtggggtgggggggggagggatagcatcgggagatatacctaatgctagatgacgagttagtgcgtgcagcacaccagcatggcacatgtatacatatgtaactagcctgcacaatgtgcacatgtaccctaaaacttaaagtataataaaaaaaaaaagacattgctagtgagcacactgtatacgacatcgctaatgaggatgctatatatgacatcgctgatgaggacgttgtacacgacatcactaatgaggacaccatacagatggcttgagcccagtagtttgagacaagcctggcaacacagcgagacctcatctctacaaacattttttaaaaatatgccaagcattgtggcgcatgcctgtagtcctggctattcaggaggctgaggtgggaggatcacctgtgcccaggagttcaaggctgcagtgagctatgatcacaccacaatgctccagcctgggcaacaaagcaagactccatctctaaaaataaaattaaattaaaaaaaaagatcttcgatgtaaaagaggtatgctcaaatgcaataaaatcatataagaaggccgggtgtggtggctcatgcctgtaatcccagcactttgggaggctgaggcaggtggatcatgaggtcaagagactgagaccatcctggccaacatcgtgaaacaccgtctctactaaaaatacaaaaaacaatcagctgggcgtggtggcacacacctgtagtcccagctattcaggaggctgaggcaggagaatcgcttgaacctgggaggcggaggttgcagtgagccaagattgtgccactgcactccagcccggcaacagagcgagactccgtcaaaaaaaagaaaaaaagaaaaccatacaagaagcccctacgaatctgggtgaatcagcaaaggcttcacaggataggaaaaggccatgagtatgaaaacatgagtggggggttggcctagatggtaaacgaggagaggacaatacggccaggaagtgcatgtgcacagcagacgggagatggagggcacggctgattggcagctacctgtactttaatattcctggagtgtgacgtgtgaggcaaacatggggtggtggggtgagtgctggagatgaggcagacagtgagccatcagcatgttagtaacaggggaatccatgggcgtttcatgcagctccaaggaccctatgtgagctcatcagactccaattacccaaatctgtttcttaccagtggtagttaggatttccgtaggtacactggatgtcttcccaggacacctggaagccagaaacaaatggggtcaagcagccagctgacacaagcacccacagaggacaggacactataatgtgcccctcatcctccagacaagcccacccctagcaactcccaagagcctggagcaacagcagcaggatgtcttgtgcagtgaagtatgtttagcgcccttgtccctgtgtttaaacttggtcatgcttttcccagaggcctaacttacatatttctaactctccttgctctctagacatttcccacaaagcaggaagctgcagagcatgagcctagagcaccaaaaacttagaagtgaagtgaattgaacccttgcagaggtgcaaaccacatggggacttcagaccgaaaaaggcttgaaccctcatcaaaggccccacacccagacagcaggatcacagtgtgtcttgatctcagagacccaggcagccctgagcccagcatttgctagaggtggccaatccagggcaggaggcaattgtggatgatgtttcttaccaagcaaatattggagtcattgaagcagaaccattttccatccacagcattccggatgtagacacagtaatgaccggagtctgccattcccacgtgcgcaatcacagcaaaaagctcatactgccctccagactggaaagagacaggcacgagacagttcacccaccaccacaaacacgactgcctcacacatttatacctgtccacccgaggcccgactctgggactttagaatattagaaaacagtcctgacccacggccagtgggcaccctccaggaggggctttcctgagtgtggatcctgaactgtgaaggctcagcagcttggcagggcagagcacacaagagatggaaggcatgaggtcatgagagaggcccccaaagccaaggcaagattagaactttcccctgggaggggtggggatcatcagaacacagttctgcttctccacaagcccaggaatgaccctaacctgagccaccgtacccagccaaaaaagtcttttgtagggggaggggagacagagggcaagggcggcacacgcaaagctgagtcacccacagtggaggctgaaattatccctatttccatttgcagactttgtgcagaactttacaaaatgcagggcaatatctgtatctaaatattagtttacaagaaataaaagggttatagatgatgttaaaagatatcaaccagccagtgctggcatatgaaaaaaatattcaaccaaatcaactgcaaggaaaagaaaaggagcggaaatctaaaaggaacttaagaaaagaaagaaacttaaccaaatgcaagtgtaggcgttgtttggatctagagtcaaacaaaccacatagattacacaacagtcaggaagtctgaacgttaaccagatatttgatgctattaaggaattgcaagatggagatgattatcttttaagtgcttattctttagtgatacataatgaagtgtttataaatgaaatagtatgatgtctgggatttgcttcaaaaaaatccagtacagggttgggtgaaacaagagggtgggttataggaaaagcaagacctgccatgcgttttggtaactgttacagccaaggattcactgtctaactcttccttcactacacactttggtatctatttgtaatgttccataacaaagtcttttttgttgttgttgcaaagatggagtcttgctttgttgtccagctgggctcgactcctggactccagcaatcctcttggccccgcaaagagctgggattacaggtgtgacccactgcatccagccaaaaaagtcttttttaagtgaaaaacaattttaaatgtacttcatcgggtagaatctgcaggtagaaataaaaagaactagaaggaaagaaaaagagaatcctatgaaatgtatacggcctaagtagggaaagaaatcatgttataataggagctattgtaacgtattatcaggtcttaattttctaaatgtcatggttctagagcataaatagccaaacagaccaataaaacagaagagacactccaaaaatagacccgtacatatagaaatacaaaatttgttatgtagcatttcaaatctatggaaaaaaagatatttgggtcctttttttttttttttttttttttttttaagtttttcttgttttgtttttagagacggggtcttgcgctgtcacccaggctggagtacaatgatagatcatagctcactgcagcctcaaactcctgggctcaagtgatcctccaactcagcctcccaagtagctgggactaaaggtttgtgctaccacacccagctaattttttttttttttttgagagacgggggtctcattatgttgctgaagctggtctcgaactcctgggctcaagcaatcctcctgcctcagccttttgaggtgtgggatcacaggcatgagccacatcacctggccttgtgtctctttttttctcagaatctcttgataagttattatctcaggacaagtgaattaaactttactctgattaaatgtggtccagtcaactggctactttatgattatcctcaaagtgggcacaggccatctgaggaagaaagtttggttggtactatgaacccacaatgacatgtttgcctatgcatttctatgtattccacattatttccaaagaagcctactgaattctggattctgtccctcagtgctgtgaggcatatgaacacaaatccaatatttagaaagaagaaaggcttttgaggctggggacagtctctgaggaacaggtggctcctagcagactgggggtgaaggaagggaaaacagaaaggacatggcatctggggagaggcaggatggcaaggaggtcgggatcatcccacctgctcctcagcatcacaagactctcgcttcattggaaggatctggctgaaatccaagctctgggggaagtacagggagtggcagatctttctcgtctgtgaattcctgatggagaatcgcatgaggtggattgtcagggtctggggcaaatgggtcagcttcaagacctgaaaaatcaaaatcactctggagatgaagtccacttggaatgagagagtcagagaaatgtcagggctagcaacgcgttcttcccaaaaagaggggagcagggcgacatcatggagttcaaggctcctgttcactgaatctgctgagctcctctgagaataatgcaaaacttggctattctaccaccatgtggccccccacaagaggcacaagggcacagggctctgcacaggtaccaggacccagggagccaccacgtctgctccagggagctggtctcgccccgagggaaatgccctgcccgctgctctcaggccccctcctgcagtccctctcagtgatgcgacatgagaagccacatccacggctccagatatcagaaccacagcgtcccagatactagccagacccagattccctttctcacccatcatgggatgtcctcggggcctctgatgattctatcaggaaatccacggggggcaaccccagactagtgaaggacagatgacccctgaacagcacaggtttggactgtatgggtccgcttatacacaaattgttgtaaataaatacagtctgccctcccccataggcacgagttccacatctgcaaccaaatgctcatcaaaaataaagtatcccagatgcacaaccgcatagatgagggactgacttttcctatacgtgggttccacagggccgactgggtgtgacttgagtgtgtgtggattttggtaaaagcaggggtcctggaacaaatcccccatatgcaccgagggacagctgagtctgatttagggaatgagtacctgtttcccacgggtcttcttcccacagttctcacagaagcatttgcttttgcttgataactccctgggctggaagaagcagtgcagggcgtcctcctgtcccacccaagagaacagggaaaaagcagcgttggtatttcccacctagaatactatattcgtctgttctcacactgctgtgagacaatagctgagactgggtaatttataagaaaagaagtttgattggcccatggttctgcaggccgaccggaagcatggcagcatctgcttctagggaggccgcaggaagctcccaatcatggcggaaggccaagcaggagcaggcgtcttacctgggaggagcaggtgcaagagaccaagtggggagctggagtgcaggagcgcgatctcagctcaccgcaacctccacctcccgggttcaagcgattctcctgcctcagcctcctaagtagctgggactacaggctgcaccaccacgcccagctaattttttatgtttttagtagagacagggttttaccatgttggccaggctggtctcaaattcctgacctcaggtgatccacccacctcagcctcccaaagtgctgggattatgggcgtgagttaccacacccagcctggctccacacttttaaacaaccagatctcatgagaactcactgtcacaaagacagtaccacgggggatggtgccaaaccattcacgagaaacactcccccatgatccaatctccttccaccaggctttacctccaacactggggattacaattgaacaggagatttttgggcagggtcacagacccaaactgtatcaggtacagcctccccacactttgcagctgagggtttcagcttttcttctggttctcctcatatcccccttaatgcctggcctggtgtggtccacttggcaggatctcaaagggcacctactgactggaggaacaaaacaggagggggctcctattaagggagcagtatgagggaagtggaggtaggagggaaaaacatttttgccaaaacaaaggagaaattggccagcgccgtgaaaatgaaataagtgactttccagaagccagagatagatcaaagaggcaagggggaattggccacactgtgctgtgtggtgtgatggtttgagggtttgtcctccccaaaacccaggttgaaactgaatccccagtgtggctgtatggaaaggtggggactttgagagataattggggagggcaaggtgtctcatgcctgtaatcccaaggaggctgaggcagggggatcacttgaagtcaggagtttcagatcagcctggccaacatggtgaaaccccatctctactaaaaatacagaaattagccgggcatggtggtgggcacctgtaatctcagctacttgggaggctgaggcaggagaatcgcttaacaccggaggcggaggttgcagtgagctgagattgtgccactgcacttcagtctgggtgacagaggaagaatctgtctccaaaataaaaggtaggggggttattgcgtcatgagggcacagccctcataaatgaattaatccactcatggattaatgggttaatcggttatcctgggagtgggactggtggcttcatatgaagaggaagagagacttgagccggcacattagcatgctcagccccctcgccatgtgatgccctgcactgcctcgcctcaggactctgagagtccccaccagcaagcaggtcctcaccaggtgcagcccctcaaccttgacttcccagcctccagaactgtaagaaataaattacctagtctcagatattgagttataacaacagaaaatggactaacacatacaggtgcagcaaataccaagagaatccccttaccagtgtcttcaggggctttgagtccacatcaaaaaaagaaagtcggagggtgagcatgctgctgtttctgctactctccatggcacagtcaaggcaaatcaaggagtccttcatccggatcatatacagggcctgcagtctctccacctgcaagagggagagcggagaggtgagatgggaacaccaccataagccaggtcaggccaactgccagaaggtggagccaagagacagaagctcctcacaaaggtgcaaaataataccagtaacaatattatgaaactgtgataagtgttttatgtggattaactcttttttttttttttttgagacagagtctcgctctgtcacccaggctggagtgcagtggcgcgatctcggctcactgcaagctccacttcccgggttcacgccattctcccacctcagcctcccgagtagctgggactacaggcgcccgccaccacgcccggctaattttttggtatttttagtagagacagggtttcaccgtgttagccaggatggtctcgatctcctgacctcgtgatctgcctgcctcagcctcccaaagtgctgggattacaggggattaactcttttattcctctacacactacgggaacaacagctgaatgaatgaaatgagcagcatcttaagcttccgagtgctctggttctaggttcttaccaagtgcacatcagcgatctggtccttaatcaggttccagagtttgaggtacagttgggcagcatcatgttggacaaacactggccacagagaaaaggaacagccaattagtgaggtcttcagagtcacttctcatgccctggtacttagacacacatgaacactgatcactttgtctcttcctagccctccaccccactgcaaggctaagtcggcacgacagaagaagtgatcaataaacaaacagtaagtttggtattgatttttgagaacgcctcttaatacttaagctccagtgccagatgtagtggctcatgcctataatcttaacacttcgggaggccaaggtgggaggatcgcttgaactcaggagtttgagaccagcctgggcaacatagcaagactccgtctcgataaaaaatttaaaaaagtacttgagagtagcggtgcacgcctgtagtcagagctacttgggaggctgaagcaggaggatcactggagcccaggatgttgaggctacagtgagctgtgatgtcaccactgcactcagcctggggaatgagatgtccacagggactttgaaaagcactgatacattcctgaggatctagaaggccaggcgcatgcccaagtaagacctgagagggctccgatccctcccctctggctgaccacaaggccacatgcaagaaagcaatgaaggcgaatacagaatcatgaactgcccagaaacgataaaacagcaacaacaacaaaccctgctgtggggatctctgatgtccagtgttgccaccttacattatctaaaatgttcattttccaacaaaagagacaagacctacaatgaaacagaaaagcatggccacccaggaaaacagcaatcgtagaaccttccactgagaagccctagatgttggcgttactaaacaaagactttagccgttataatatgttcaaagaactaaagaaaaccatgtcaaaagatgtaaaagaaagtgtgaaaatgctgcctcaccaaataaaaagtatcaataaagaaaaaactataaaagaagaaccaagcagaaattcttgagttgaggagaaccataactgaaatgaaaaatgtactagaggaggtcaatagcagattagagctggcaaaagaaagaatccataaacctggagctaggttggttgaggttctccagactgaggacggaaggaaagctgaacacagtacctatgcagcgaaaagctgaggagctgctcactgcgtgtagagctcaactaactctgatacaaaaaaaaatgtgatacaaaaggttttatacacaaacgtgaacttattctgaagccagcctggggcaaggagcaagacacatcctgccttttaatgtgccatttctcctttggaggagagaggggcattttcataaggtgtgttgtgggggtggggggagtgagcaatggcggttttctaccgggcagttatcaagttcccagcagctgagttggcgcctttccgggcagaaaagtggccgagtgggcatgctttctccatgccttcctagtgggtgaaagacaaacccctagagggtggaagtttcgaagccaccccctggcagggagagttccctggtgggtatgctttgggctgcaaatctactgccaagtctcaggaaagatcagctggaagatcttgccctgttctcaatcaaacctccatcagcctacctccatttacagattcttccttttgcccagcagggaatgtctggagaggggtaggcgaaaggtgatatttgcatttctaaagggctaacaggaaacaggaaacacggccgcggtgaggggtgagggatgggaagaggagaagtgaaaagaaagtaataagaaaactaatataactatctcttagaaaatgggagtactcagttacacccagatgggttcactagtgaacgatgggttctaccaaacatttatgggaaaaattataccaattccctacaacctcttccagaggacaaaagcagagagaacacttcctaactcattctctgaggccagcattatcctaacaccaaaaccagacagacattgtaagaaaaaaacctaaaaaccagtatctcccgtgaacataaatgcaaaattcctcaacaaaatattagtgaatcaaattcaactatgtataaaaagaatcacagagggtgacacaagcgagatggtagagaaggaggctcctggtgctccccttctcccatggacacacggtaaaactctcatctacacacagatcaactccctctgaaagaaacccagaaaccagctgagagaggcctgcacagggggcaatggggagaacacccacatcgcaaccggttggaaaagctgagacacactcgaaccacaagccccaccccagacacagtaccttactgtgaggaaggaatccctactcccagctttctcctggagaggggagggtttggaccacacataggcagccccagcttttgcagttcccactcaagggcttggctgctgggtcacctagctctgggagcagacatgggttagcagttatgaatcctctgcgaccacagaggacaaagaggcagttttaaacgggcacgtgagcacttccagcagctgtgctcagcacagagcaaacaggcagaaatgccaggctcccagttcctccctggaaggatatgtctgcgggctctcctagctgttgcccgagggatgggcttctattaataactggcctgcacctggagccaatgaggcaggtaaacaatagatttccaggagtctggacaggcctgtgggcaagtcccatgccttctcccaccccctgctgtatggtaaaatcaggtctctaacttcacacattgagtacacatttacccctctcaaatgaaggtctagctcctcaaccaccgagctttgggagctgacaaggctctgtatttgtaagtcccacaggggcacagagaccaaagaacatccccccaggcccagtgcagcgtgaacaggcaaaaaggcccggctcctactttctccctagaaggagtttgtctgcacagtgcagctgctgccctggggtttctatgcatctgggagctgacagagcaggaaaccagtgctcctctgagaccctgaacaggcaggtgagcacctccacagctgctcccactggtttgctcaacagatagcgtcaagcttccaactaacctgtccgtctctaagcagagaacagccagcatttgctaggcccctgggggtgacaaagagtaaaacaatgcatgaaggagtgtgcagtttaaacttgagtgcaggcacttgccacagatcctctctccagcattttgcagagcgagtggcagataaactcatgctcccagcttttccctgaggatagaataaactggaacacacatttaatgccccaacgtctccagctgcacctcaaggggctggtttctatctcccctgtctggggcactgacaggacatgacacattctaatctcctgagggccgctaagaacatagatgacagtttggacaacacaaaaggtcaagaggtgctccgagtgtctggcagggctaattggtaagttcgtctcttatacaaggcccgtgggacaagactgggagaggtatttttcttttttttttttgagacggagtctcgctctgtggcccaggctggagtgcagtggttcgatctcggctcactgcaaactccacctcccaggttcacgccattctcctgcctcagcctcccaagtagctgggactacaggcacccgccaccacgcccagctaattttttgtatttttagtagagacagggtttcaccgtgttagccaggatggtctccatctcctgacctcatgatctacccgcctcagcctcccaaagtgctgggattacaggtgtgagccatgatgcccagcctgggagaggtatttttcttaactaaagtacagaaaataacagagaatcaagaacaatgaagaaacagagaaatctgttccaagcaaaagaacaagataaatctccagaaaatgcccccggtgaaatgaagataagtgacttaccttacagacaattcaaaataatgatcatgaagatgcttaccatgtctaggacagcaatgcatgaacaaagtaagaatttcagcaaagagacagaaaaaagttcaaaagaaataatagagctgaagaatacaataactgaaataagagctcaaaagagaagctcaacagactaaatcaagcagaagaaaggattagcaaactagaagataggtcactggaaatcattcagaggagcaaaaatgaaaaagaatgaaaaagagtgaagatatcttaagagagttaggggacatcaagccgaccaaaataggcattatcagagtcccagaaggaggagagtgagaagagatggaaagcttatccaaagaaataacagtcacgagttgcagatcaacatttcagtcaatggcagaccgcatgagcacagtggccatagcatgcagcctagctgtgtagtaggctgtcccatctaagtttgtgtaagtgcactccatgatgtccacacaatgacaaattcaccttctgatgcattttcagaacgtatccctgttggtaagcaacgcatacctataatgactgaaaacttcccaacccagggaaggaaatacaaatccacatccaggaagcccaaaggacaccaataagactgatctaaagcaacccacatcaagacacatcataatcaatttcaaaagttaaagacaaagaattctgaaagcagcaagagaaaagcaatgtattatacacaagggaaaacccgtaagtgtaggatttcttctgggggtgatgaaaatgttatgaaattagattgtgatgatggaggcacaactctgtgaatacactacaaacctttgaattgtatgtttttaaatggatgaattttacagtatgtgatgcacatcccaatatagctatctaaaaaaaaaacctgacctatttgtgaattattttgtagaacatgttttctcttttttattcctttattctgttttcctgcagttccctaactgtggtggaataagcttggaggagatgccttcacctactctactgagaggcagagaaaggttaggtatggaagtaaaatgtccataaataatatcaattctgcacctccaaagatgtgtgcctcttacacaaatgtctctataatctgaggggtccaggctacctaacttgcttcttgttgcttcactgcccattagttcctctcttcactctctaagcttcccatcccctttggatcagcagccaggaacccagtgggagggtatcttacggggcacgttgtacttctgcaggcagtaggccagctccaggggccacactgctttctgccggctgtcctgcatcttctccagcagcagaagcatctggaaagggacgcttctcctctgctcgtcagctcccctgggcaccgtgatcctgccacacaagaacagccagaaacctccttacatgtagttctcaaagctaggtgcacactggaatcacctgggagaaattttaaatcttcatatccaggccactcccatacaaattaaaccagaattctgggtccggggggcggggcgcgggcagttatcagaatttttcagttcctcagattatttcaatgtgtggtcaaggttgagaagcaccatgtgagtgaatctgctctacaggggaccctctagagagggggatcagcatgactgctgccttggcccctctgcaccctgcccagcaatcgtgctagagcagacggcagatgcacgaggtcctggctccacatctcgggcaagcagcaaaatgtccagcctaaagctctccagactgcagaggcacatgctgggttaggtcctgggaagaaaggcaacatgaaaggctgtccgtgtggtttggcaatgattcatttaatcacaggcatttttcggatgggaaaaaggagagagcacagggcagaaaaggagtgatagagagagacagagggagagagtgcattgtgtgagtgttggtggaaggaggggtgtgtactccccactgacttactccttctccgactttggtctagtcccaactctgtcttttaaccaagtcagtggctgtcaatcctggctgcatttaaaatcacccaaagagggcttttaaaaagtaccaatacctggccgggcccagtggctcatgcctgtaatcacagaactttgggaagctgaggcgggcagatcacctgaggtcaggagattgagaccagcctggccaacatggtgaaaactcgtatctactaaacatacaaaaattatccaggtgtggtggcgggcgcctgtaatcccagctacttgagaggctgaggcaggagaatcccttgaacctgggaggcggaggttccactgagccgagattgcaccatccctctccagcctggggacagagtgaggctttagctcaaaaaaaaaaaaaaaaaagtaccaatacctgggccgcaccccagaccaacctaagaagttttagaaataatgtgtaggccagaatatgcagaagccgatctttcctctgccagcttttgagagaagatctcaaaaagtccaagtcactgtgaataactgaatatattaaaaatgaaataatacaggccgggtgcagtggctcacgcctgtaattccagcactttgggaggctgaggtgggtggatcacgaggtcaggagatcaagaccatcctggctaacacggtgaaaccccgtctctactaaaaatacaaaaaaaattagccaggcatggtggcgggctagtcccagctactcgggaggctgaagcaggagaatcgcttgaacccggggggcagagcttgcagtgagccaagatcgcgccactgccctccagcctgggcaacagagcaagactccatctcaaaaaaaaagaaaaagaaataatacaaacgcttatcagcctgaagaacagtcttacctcttcaatatcctggcgaagtccacattcattacaaacacctgaatcaaggagttaaggcagcaggtctgtccaatgttgtgtaaaccaaccaggcctataaggggaagagaaaaaaatgctgagggcaaggcctaggtaaagaagttgacaaggctgggcatggtggctcacgcctgcaattccagtactttgggaggccgaggtgggcggatcacctgaggtcgggagttcgagaccagcctggccaacatggtaaaacgtgtctctacaaaaaaatccaaaaatcagccgggtgcggtggctcacgcctgtaatcccagcactttgggaggccaaggcaggtggatcacctgaggtcgggagttcgagaccagcctgatcaacatggtgaaaccccgtctctactaaaaaatacaaaactagctgggcatggtggcacatgcctgtaatcccagctactcgggaggctgaggtaggagaatcatttgaaaccaggaggtgaaggttgtggtgagccgagatcacaccattgcactcctttctgggcaacaatagtgaaactccatcaaaaaaaaaaagaagaagagaacttacagcagggtgtggcgtttcacacctgtaatcctagcactttgaaaggccaaggtgggcagatcacctgaggtcaggagttcaagaccagcctgggcaacagggcaaaaccctgtctctactaaaaatacaaaagctagccaggcatggtggcaggtgtctataatcccagcttcttgggaggctaaggcagaagaatcattggacctaatttattgatttttttgaacttggaatatggtgtcatgacaaaatcatgccactgcactcaatcctggatgacagagcaagactctgtctcaaaaaaaaaaaggttactttttatttcctgaaaagcttgacttcctgacaatgaaagtcctaaggagcgagtggcagaagacagctggcagctggcagtcattggtggggcaaaggcagagataccactgctgactctactgggcctcgggcctcagcgctcatgggaagggaccctctttcaagcttttggaggggtaagggagggccaggtaacagtgcctacatcttaggcaccgaaaacaactggagctgcttcatgcagtcaagaatcccctgaagaaggaaggcagttacctccctattctccagatctcttcagctggcctggctctcatcctttccaagacctggctgtttgctttgcatttagttatatgagctaattcatatgcttctaataaatgcctttcatccttctccaaagttagccctagagtatattgctgttgtttacaatcaaaaagccccagaggtgtactctccaattctcttaataacctcatttttctgtcattacccctgttttagtacaagtagctgagcttcagagaagttaaaagatgtgcccaaggtcgcacagctaatgagtgtcacagtcagaatctgaacccaagtctgtctgatgtggggtcatgacaagagcatgggttttcttgggagaaaaaaatgacttcaaatccccacttcccgcataaaaatgcacaatgggtgtagcaatgccgaagccacagagctattgaggatggatggaggtgacgcataggaaagcacatggcctagggtatgtattcccaacactttgggaggccgaggtgggcagatcacctgaggccgggagttcaagaccaacctgaccaacatggagaaaccctgtctctactaaaaatacaagataagctgagtgtggtggtgcatgcctgtaatcccaactacttgggaggctgaggcaggagaatagcttgaacccaggaggcagaggttgtggtgaaccaagatcatgccattgcagtccagactgggtgaaaagaacaaaactccatctcaaaaaaaaaaaaaaaagaattaagaaaaaatatttgaacacttctttttatccctaatttattcatgtttttgaacttggaataggaacactactgccaacaaaagtaattagagaatatagatgttaaatctattctctaaatgaattattgcttattttaaaattgcatattaattaattacaggaaatttggaaagtaagagacatatgaagaaaaaaaggtaaaaatgatttgtaatccctctgagagttaccctttaatgccatttttggtatatttcctctcagttctttccccctccaccaccagtatgtgtgagtagtttatgttttataaagctgggttcatacaatatgatttcttggctggtgtggtggctcatgcctgtaattctagcactttgggaggctgaggcaggcatattgcttgagcccaggagttccagaccagcctaggcaacacagtgagaccccatctttacaaaaagtaaaaaattaggtggtggatatggtggcacttgcctgtagtcccagctacttgggaggctgagaccagaggatcacttgaacggaggaggagtctgcagtgagcctagattgtgccactgcactccagcctgggtgacagagtgagaccctgtctcaaaaaacccaaaaaagatttctctataatttctttttttattcagtaaaatattgtagttttctctatcttgattaaacagtctaaaatggttttaatgtcaccatagtattccattttataaatttgtcaaaatttatttaacccttattgttacatttccattttttaaaatagtgctgcagctgttgatttgaaaagatacttttttcaggtagttgacaaccaaaatatccccttgatgggttccagcataccccatgcctcagtatcacacagtatacctttgtaactaacctgcatggtacccccgattctaaaataaaagttgaaaaaaaatcatctagtgttttaaaacaaattatgtattatttttgggccaagcgtggtggctcacacctgtaatcccagttctttcagaggttgaggtgggaggatcacacaagaggatccactgagaccaggagtttgagaccagcctgggcaacatagtgagacccccatctctacagtaattaaaaaaaaaattagctgggcatgatggcatgcacttgcagtcccagctacttaggaggctgaggtgagaggattgcttgagcccagaagtttgaggttacagggagctatgatgatgccactgcactccagcctgggtgacagagcgagactctgtctcaaaaaaatatactattttaaatttataaatgacaattgaattacatttatatagtacaatgtgatgtgtgatgtatgtatactgttaaagagaaaagcctttgactaaatttgacagagtttagttgaacagaaaaaagattcatgaaccaggtagcactgagaaccaaaagtggttcagagatctctgctccacaggtgggcagggaatatttatagccagaaaacgtaagtttcattgagaaatagcctgttggttacagctctgcagttgccttgtttgaacatgtttttggcagcttgcagcctgtgaagggctgagagctcagctgctgtgattggctgagactgggctacttattccaagggcatattctcaggttaggttgcagtttgttttgtttacctatgtgaacccccaatagctgagacaggtctcagttaatttagaaggtttatttgccaaggttggtgacatgcacccataacacagcctcaggaggtcctgacatgtgcccaaggtggtcagagcacagtttggttttatacattttaaggagacatgagacatcaatcaacatatgtaagatgaacattggttcggtccagaaaggcaggacagctcgaagcaaaggtgggacaactcgaggtggggagggggcttccaagtcttagatagataagagacaaatggttgcattcttttgagtttctgatgagcctctccaaaggaggcaatcagatatgcatttatctcagtgagcagaggggagactttcaatagaatgggaggcaggtttgcccaaagcagttcccagcttgacttttccctttagcttcttggggccccaagatttattgtcctttcacatctattaagttagattacagtgtgctatatatggaggcagctttattttattttaattaattaattaatttatttgttggtgatgttgatttctcttgttttaaaatcaacattataggctgggcatggtggctcatatctgtaatccctgcactttgggaggccgaggcgggtggatcacttgaggtcagaagttcaagaccagcatggccaacttggcaaaactctgtgcctactaaaatatatgaagattagctggtcacggtgatgcacacctgaaattccagctactcaggaagctgaggcaggagaatcacttgaacccaggaggcagaggttgcagtgagctgagattgcacgattgcactccagcctgggtgatagagtgagactccaactcaaaaataaataaataaataaattaattaattaaataaaatcaactttacggagaaaaatttacattcaagaaaatacgcccattttaagtgtccagctggatgaattttcagaaatgtgtgtaccctcatgaccacttcctcaatcatgatacagaacattcccataacctggaaatccctgtggccctttgctggcagtttccccacccagccccaggcaacccctgatctgccctctgtcactgtagactagttttgccttttctagaatctcatatagagggagtcatgcagtatgtactctcttgtagctaatgtttttgaggttccttggtgttactgcattgttttctattgctgagtagtattccgttctactcagtaccataatttgctcatctactcttctgtggctggactttccagtttggcgctaatatgaattgtggaggcagttttagaccaaatttaacttaacaatacaatatgaaaagattaagtcaagctaatgaacatacctgttacctcacttacttggcattcttttaagttgatgcactagaaattttctctcttagaccgggcacagtggctcacacctgtaatcccagcactttgggaggccgaggcggggggatcatgagatcaggagatcgacaccatcctggctaacacagtgagaccccgcctctactaaaaatacaaaaaattagctgggcgtggtggcaggcgcctgtagtcccagctacttgggaggctgaggcaggagaatggcatgaacccaggaggcagagcttgcagtgagccgagatcacaccactgcactccagcctgaaagacagagactccgtctcaaaaaaaaaaaaatttccttagttattttgaaatattcattattattgactatagtctcctgctgtgcaatagacctcaaaacttttttctcctgcttggctgaaactttgtaccttttgaagaggaagtctccattcccttgttctgccacctcgccagctctggtaaccattattcttctactgaatgaattcaactttttttttttttttttgagatgtctcactctgtcacccaggctggagtgcagtggcacaatctcagctcactgcaacctccgtctcccaggtttaagcgattctcctgcctcagcctcccaagtagctgggattacaggcgcctgccaccatgcccagctaatgtttgtatttttagtagagacagggtttcaccatgttcgccaggctggtctcaaactgctgacctcaagtgatccacctgcctcagcttcccaaaatgctgggattaccagcatgagccagggcgcctggcccaaattcaactttttttttttttttatgagtgagcagcagcaagatttattgcgaagagcgaaagaacaaagctcccacagtgtggaaggggacccgagtgggtagctcccaaattcaacttttaaaagattccacgggcatgtgagattatgtggtatttgtctttctgtggtatttgtatttcacttagcagtatgtcctctagatttattcgtgtcattcccaatgacagagttttgttcttttttatttttttggagatggagtttcattcttgttgcccaggctagagtgtaatggcatgatctcggctcaccacaacctccacctcccgggttcaagtgattctcctgcttcagcctcccaagtagctggaattacaggaatgtgccaccacacctggctaattttgtatttttttttaatagagatggggcttcaccatgttggtcaggctggtcttgaactgccgacctcaggtgatctgcccacctgggcctcccaaagtgctgggattacaggcatgagccactgctcccggctgagttttgttctttttaaggctgaatagtacttcgttgtatgcgtgcaccgccttttctgtacgcattcatcttaggctgattgacttaggcagattccacatcttggctactgtaaatggggccgcagtgaacatgggagtgcagacatccctgaacacactgatttcaattcccttggatatattcccagaagtgggattgctggctcacatgatagttctatgtttagtgttttgaggaacctccatgccattttccatcgcggctgtactacacaccggcagtatactaggattcccctttctccacatcctggccaaaacttaccttccatctttttcataaaacttgttctgatgagagggagatgttatgtcacggtggttttaatttgcattttcctaaagatttaggttgccactggtcagctccaggccccagagcttcttcaactgaagaagtacttgctgtctatagtaagcatctcaaactttaacgtgcatgtggatcacctgggaatcttgtcaaatgcagcttccaggtaagtgggtctgcagtggggcctgatattttgccttttgaacaaactcccagataatactgatgttactggtcccaggacctgcctttgaggtagcattttttcatgaacctattggctgtttgtatgtctacttttgaaaaatgtgtttggttcctttattcattcttacattggcttattggttcttttgctgttgagttgattgagttcctcatatattttggatattagccccttttctaatgtatggttagcagatattttttctcacgacgtgggttatctctttgttacttgttccttttgctgtgcagaagcttttcagtttgatgccatcctgtttctatttttgcttttattgcctgtgcttttggggacatacccaaaaaatcattgcccagatcagtgtcatggagcttttcctctgtgttttcttatagtaattttacagtttccggcataatgttaaagtctttgatccattttgggttgattttggggcatggtgtaagataagggtctaattttattttctgcatatgaatagccacttttcccagcaccatttattgaatagagtgttcttaccccttggcgtgttctttgtgcctttgtcaaaagtcaatagacagtcagctgggcacggtggctcacgcctgtaatcccgcactttgggaggccaaggcaggtggatcacctgaggtcaggagttcaagaccagcctggccaacatggtgaaaccccatctctaataaaaatacaaaaaattagccgggtgtggtggcaggcacctgtaatctcagctactcgggaggctaaggcaggacaatcgcatgaacccaggaggcagaggttgtagtgagccgagatcactccactgcactccgtccagcctgggcaacattccttctgtgttctgggatatatattcttgagggtattcccatctgtggatagttgccagttagatttctgtggtggggaagtggagctagagtattcttttcctttttttttgagacagcatctcactctgtcatccacgctgcagtgcagtggcattaacatggcttcattgatctcttgagctcaagtgatcctcccacctgagtctcctgaaaagctagggctacaggcatgcatcagcatgcccggctaatttttaattgttttgtagacatgggttcttgctgtgttgcctaggttggtctcgaactcctggactcaagcagtcctcctgccttggcctcccaaagtgctgggattacaggcgtgagccactgctcctggtctgtttcttttgtttagtatttttgtttgctttgtttcatgagctgctattttgactacagttttaatatttttagcaattttttggatatgcagaaatttaattcttattcatcaaatatattttagtattttgtgtgttttttagatttccttttttaggagtctttccaaccataaactgccaaatagaaatacacacacacacatacacagaggctatgaatagacaactaattgaaacagaaaaaaattgattaattaaagcacctatgggatttttctccagccaaattagcatttttatttaaaaaaatcttttagtgttatttagcctacataggaagaggcttacttatgtagttgataagagtgtgaattgatcaactttttggaaaataatctgccagtataattaaaattataattaaaatgtatcataggtcagttacaccactttgagaatcctatactacagaaaagaagaaatataaaacaaaaacatcagtgggatccatgtatattgatgattattgtagtcatcagtggtgggaatttttaaaaacaaccttaatatccatctaatagggaataaagaaatcagaacttatctacaatgcgcattactacacagaaattcaaatgatacatttgatctacattagctggaattagtaatgtccatgtactctaatgggagaaagaaaattactaaataatgtaagatttgagcacgttctttaaacaaaacaaatcaataaagccctaaaaggacatactattgaaagcaagtcacaaaatccagaaatggcagggaaaatgttcaacaatttgactatgtaaaaatgaaagtttcttcaaaacaaagataatataaacaaaataaaagttatgatacagaccttaagaaacaaacttgctaattatatggaattaataaatgtgcagaatatataaagaatatcattacatgaattagaaaactagtaaatcataatgaaattctcagcgagaaatacaattggccagtaaacatatgcaaaaatgcacaatctctctaataagtggagaaatccaaattaaaaatggaaatatttcttaatcataaaattggccaaggttagcattggtcatttcctctgtaactaagggtgtgtggaaataggaactctcatatactgatggtgggagtataatatcattaaatttttttgaaacacagatttttaattttttatcaaaatatggccaggtgcagtggctcacgcctgcaatcccagcactgtgggaggccaaggcaggcagatcatgaggtcaggagatcgagaccatcctggctaacatggtgaaaccccgtgttatttgtaaaaatacaaaaacaaaattagctgggtgtggtggtgggcacctgtagtcccagctacttgagaggctaaggcaggagaatggcatgaacctgggaggctgagcttgcagtgagccaagatcacaccactgcactccagcctgggcaacagaacgagactctgtctcaaaaaaataataataatattaaaaatttatactttgcctcagtattttatttttagaaatcaatcataaaagaaaaaacccacctaactaaggtaccaaaaagatgaatatacaggtatgcccaggatagtgtaggtaacggtaacaaataactgaatccaacataaaaattccacagtgaaaaagtgaccaaattatggtcagataccctgttgaataatgatgcaactataaataagaatgagagagacctatatgcactcataagcaatgatcaccacattctattttatatggaaaagccagttagggaacaacacacaaagcaggattacgttatgtaaaaacatgggcatgtctatctgtgtgtaagtggatgtagacgactgagtgggctgggagctggcggtgacacatttcattctacagacctaagcagtatttgaatttttataacaatagcatatgtgtttcttatgtgatttactagaaacaatttaatttcttcagttgtaaaaggtgtattttaaacctatataaaggtacatggagatcgtcattcagaataacaaaataaaaagcaatataaagacacaaatagatatagtacaatattaaatactacaatattcaagatgatattaaaattatatatatctacatctatatgcatgtaaggatctcagtaaatgatattgtctaaaattaaactgtggtaatttttgcagacctctgtgaatatattagaaaccattgaattgtgtgtacactgtgtgtgggtgaaatttattgtatttgaattatatctcaaagttctgttaaaaaatgaatggcttgatattctagtgctaagggatggttttatttaaaacataaactaatagtttccagcagagtcccttaaaaatattacagcagggatttccagatcacactcactcccacctttttagaatttttgactattttccaaagtattgaattcaatgaggtgcaggtggaagaaagcgtttacaaagtcagtgggttacgggagagctggtgtgggttgaggcagagtggggagagaggctcctttcaaatggaagcctctggaacccacagacggcaagcgtaaggcagggcaatcttctggagacctaccagagaaaggctttagacccaacactcccattcacaaacatggacaggggcatctcagtgtttccttaacttcactctttctatattgacacaaggaaataattaaaagggggtaattctggtttagtttatttcattaaattatcaacaaacaacttttgaaacaaaaactattaaagtggaactcaataaaattactaggtttaataatctgtatctgtgactcagatacagatcaggcaaaccagctgtggatgaagctcccagctgtggatgatgcccccagacatggatgaagcccccagctgtggatgatgcccccagatgtagatgaagccacaaatgatgcctgtgtggacagacagaatgatggacaggcagatgaatgtgagggttttatgtgaaacaagtccacttggttgttgacaagatgctgttttaaagtttcattttgccatactttgaatagcttttcattagctaaatttagccacatgtaaaatcactaaggcagacacctggagttcccatatgaaaatcaaatgtaaaccagcagtgacctacttcaatgtgatcatcggaagtcagaagttgagctcatttttgatgtttaaagcctgcataatattcactgtgttattattcagtgtattactatttccttcatgatggaaatttggtttgccccaactttctattctatcaaaacactgctacatagaaaatccccatgcacatatttctcctaattgtggaaatattttacataaaagactctagacatgggatgaaattcccaggttattggaattttaaaatagataggtactcccaaattgccgtcttacaaattatatgaattcgtaagcttccaactgttatggagttacccattttgagaaatctgtgctaaaaggacccaaacaatgctgatgacaatgatcaggataataagtacgctgggaagacaacaaaatgatttaaatcttagacaagtcattctaggtgtctccactgtttcagttcttgcattcattcttgtggtatcttttcccttttaccaataaaaaagctccctgacatcacattgtggcagtccccatggtttgccgcagttactgcgggactgaacgaaggaggacgaatgaagaaatgaaaaccaaggaaaaaaggagctgtttaaagaagggtccagggaagaagaagagggctcccagcttctagtgagcaagggcagcagccctgagcttctacagcccttcatatttattgagtagaaagagcagggagcaggaggtaatgattggtcagcttctcaattgatcacaggttcacattattgctaacaggtttcagatgtgcctaatctcaagaaacgccgcgcctggggcatgactgccctcagcattccctctgggtggcagacgcagtttgccaacattctgcattcatgagaacagtttactgtttactcatataacctccagtggtacaccgagttgatcatgaccctccctctttcggcctgcaacatcacatgaatccaatgagtattggttagtaaaatgcctatgactagtcatcttcatctatgcaattaaatattaattcatcaaacacttcaaatgtaagcaattaataattagtgaatgaaaaatacataatacatcaattagaaaaaaactctattaaaaagacatttgtgtgataaaagagattgccatttttgtatttttctacaaagttaaagaaaactaagtcagcttatataagtgaattttaaaagcctttaggccaggcatggtggttcatgcctgtaatcccagcactttgggaggccaaggtaggcagatcacctgaagtcaggagttcgagaccagcttggccaacatagtgaaacccatctctaccaaaaatacaaaaattagccaggcgtggtggcaggtgcctgtagttccagctactagggaggctgaggcaggagaattgcttgaacccgggagacggagattgcagtgagccgagatggtaccactgcactccagcctgggcaacagagtgagactccatctcaggaaaaaaaaaaaagggcatatatatccattatttcactgggccttcacacagccctgctagtcaaccctcgagaattgaggaatcagagaacttaggaacaagaacatgacctgggacttcttatgtaagtgagaatcttaggctaaattgtcttgcggtaaatgcctttcccatcctcagaagtctatagtgagcagaaagcagtaacagcatcctcccttccactcttcccttcaggctgaacacatccctgtccctacagcctttgcagagacacaggtgacagagcactcaatatagaatccctgggctcacactggctttcctacagacacaggggatccatgaggcccacagtgacatacacatgtacacaaggatgcacgtactgacactgatgagccctggaagtcaacacagagtggcatacagaagaacacatgcaggcacacacacagccacaactggacctgcgaggtctacagccccacaaatgaaaagaggtgcataccatctcacaacaaactagaactttgagagaaccacacacacacacaggtctacaaattcacctgaacaagacgccgtccatagtcactggcgtaaggcatctactcactatcacacagaacacactcaggcaagcagacatagatgatacatccacaatctacagagatgaactgcagagttacatgcacagatatgccagtcatacattcagatctgtgtaaacagtgaggcacacacacacatacacatgtgcacttatacagaaagactcagacccagccaggcatggtggctcaggcctgtaatcctagcactttgggaggtcgaggcgggtggatcacgaggtcaagagattgagaccatcctggctaacatggtgaaaccccatctctactaaaattacaaaaaaattagccgggtgtgatggcgggcacctgtagtcccagctactcagaaggcagagattgcagtgagctgagattgcgccactgcactccagcctggacaacagagcgcgactccatctcaaaaacaaaaaaagaaagactcagacctgacctgttagtcaacagccagatgccaacagataatcacattagactcatcagcaagcacaccgtgcacacaagttccactcccatgtacaggttcctgtcccatgtacacaagcctgcacacaaacacgtatccagactccagaactgttgagacagtgcccacatacacactcatagagtcacctgtgcacaggtgcacgtacacattgtttcacagaggcacaccaggacagaaacacataagaaatgtgaggcaaaagcggacccacacctacacctgtaagatacacagagaaacaaacacatacacaaacttacacatagactcatgcactgtgtaatcaacagttctataccccaccaaggctcttgtcctggtgtgtccagaattggtgggttcttggtttcactgacttcaagaatgaagccacagaccctcgtggtgagtgtcacagttcttaaacgcagcgtgcgcggagtttcttccttctggtgcgttcgtggtctcgctagcttcagaagtgaagctacagaccttcgcagtgttaacagctcataaaggcagcgtggacccaaagagctagacacaaaagttctccacgtccccactagattagctagatacagagtgtccactggtgcattcacaaaccctgagctagacacagagtgctgattggtgcatttacaaaccttgggctagatacagagtgccaattggtgtatttacaatcccttagctagacataaaggttctccaagtccccaccagagtagctagatacagtgttgattgatgcattcacaaaccctgagctagacacagagtgctgattggtgtgtttacaaaccttgagctagatacagagtgccgattggtgtattttcaaccccttagctagacataaaggttctccaagtccccagcagagtagctagatacagtgtcgattgatgcattcacaaaccctgagctagacacagggtgctgattggtgtgtttacaaaccttaagctagacacagagtgcccactggtgtatttacaatcccttagctagacataaaggttctccaagtccccaccagactcagaagcccagctggcttcacccagtggatcccgcaccggggccgcaggtggagctgccttccagtcccgcgccgtgcgcccgcactcctcagcccttgggtggtcgatgggactgggcgccgtggagcagggggcggcgcttgtcggggaggcttgggccgcgcaggagcccacggcggtgggtaggctcaggcatggcgggctgcaggtcccgagccctgccccgcggggaggcaacgaaggcccggcgagaagtcgagcacagcagctgctggcccaggtgctaagcccctcactgcccgggtccggctggcagctccgagtgcggggcccgctgagcccacgcccacccggaactcgtgctggcccgcaagcgctgcgcgcagtcccggttcccgcccgcgcctctccctccacacctctcggcaagctgagggagccggctccggccgcagccagcccaggaaggggctcccacagtgcagcggtgggctgaagggctcctcaagcgcggccagagtgggcgccaaggccgactaggcgccgagagcgagcaagggctgtgaggactgccagcacgctgtcccctctcactgggttgctattaaaaatgggcgctgaatataaaaattaaccgggcgtggtggtgcatgtctgtaagtcccagctactccggaggctgaggtgggagaatagtttgagcccgagagactgaggctacggtgagccgtgattgtgcaactgcactccagcctgggcgacagagtgagacccagtctcaaaacaaaatcaaacacgggcgctgccctgggcaggggaggtctgggcacagctgtgctgatgtgggcagtggacaggtgtcacgtgagagcctgtggccaagcctaagctgcggttaaggtgggaggctgaagggtttggagtgtgcaccaccccggaccacctctcagtaggaatgtggcaatgcacttcggtgctggattcctacttctggctgtgtgatttgcgacacgttaccccacgcacctgtaccacaacttcctcatctcccaaatgggatgacagtagttagcaaacctccctggactgctgtgagcattctgccagaaaaatgtactccaagctcttgaagtaggcctggcgtttggttggtgctcagtacatattcaatgtttctgtcgctggcgtcatcactgtgttcatggcagagctctgtgccgccaggactgggccgccacccagaccttcctttcccgccccaggggtgaactgtggacaggaccctctggggggactaggccaaggctctcccacctctggggacccgcgcccatgggcctcagatatgtggctcgagaagggggagtgggggcagggcccctggaaaacccctcgaggccagacccaccactcccaatatccgtaagaccaggggcttgagtctttcctgcagacagatgtgggcaggaacccacccgactcccagctacgtggggacgtggacgaactaacaggacaaattctagttcctggacaccgccctcccagtatcctcgcaattagacacccatgcagcggcactacactgatccgcacacggagatacacagcgacatccgcccgcaagagcatggtgggtgccggagctcccggctgtgggcccaggaactacatttcctagaaggatgtgctagatactcgttcgcgtcgggacgcaagcaccggcccgaactcgctctaggaaatggagtctgacgcctgcgcggcgcaaacgctcccgggaggtgtagtttgcgcctatttcgcgcaggcgcgctttcccgcagcggccgcctgctgctctttgtggcagtcgcagtccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacaggtacagcttcactcttgtagtcagtatgtctgtggatttgcacttgaggatattgacactcagagagatcaggccagtttcccagaagcatccagcatctttttttttttttttaaatggaatctcactctgtcacccaggcgggagtggtgcaatggcttgatctccgctcactgcaacctctgcttcccgggttcaaactattctcccgcctcaacctcccaagtagttgggattgcaggcgcgcgccaccacgcccggctaatgtttgtatttttagtagagacggggttttgccatgtttcccaggctggtcttaagctcaagcgatccgcccgcctcggcctcccaaagtgctgggattacaggcgtgagccatcgctcctggcctcctgcttctttcttccccgcgcccaatcatttgttcccactcagacgtgcttgattgggggtagcagctcttttcgtcatgaattggagtgtctgagacacaggcagattattcctcgatgctgtttctgttggtgctagctactggggctcgttccccacctggccttgctggcaggttctgcctcctctctgattctcacttgtgccacgacaggtgggctttaagctcagccgtgagcctggtagccgtgaccttgactcatttctccttcgccagctctttcctctcaggatcctgctctttccctgaaagagaatctcgaggatatatcgggttggggtcttcccgaagccaggtccaaggtgagtggctgtgtgttcttccttctttatgaagagggttggcacattccctccccagccctggatcgtcagccttccacagaccttcacccgggtacctgctggccagtcctcaggaagctctgggcagtgggaacagctccaagtgaagagtccagatgttgcccgaggtgtgccctcgagatgtgctctattgaatgtctcgcccagtccaattcagtgggtcagttgctggggatctctctgcccagcgctgtgctgggagctctgaggagtggttttagtggaatctgagaaagtagttgacggctcacatggggtcgctttgcctatccacgtgctggccaggggttggtgcaggatgtttgcacggttggtttactgggactggaatcagacaggggcacgtggagcagctcaggaagggctggattgcagcacttggttaagagtggcggtaggggacacatccctgtgtgctttcctctgtacccagcccctggcatggggccttcatggagagtcctggagatttagagaatctgggggctcagcaaggaattggccctgggaacttctgcagccaaatgggacccagatccctccttttacagactgtgaactctgttcctcattttgtttttctaccgcaaccacctcaccccatggttgtatttagaagggtgcagttgacaaagagagcacagtagagtgaaagatgtggaggaataaggggtctttgggtttttgttttttttttagcattttgtgattttgtcagtctgccactcaaaagaggtgatggcagattatagccagctagaaacagctgcaaaacgtgtattgtgagctgtgcctcacttctgtagtgtgtcacaatgctttatagtcctcaagaaacttgacagtcaaatgcaatgcatgttccttgcttaggggatagatccaaaaaaattgataaagggcagtttgggacaagaggaaatttgaaaatgggctgtatcttaggtcatattgtatcaatatgaaatttattgcatgtgataatagtactgtgattatgtaagagaatatccacaggagatacaagctgaagactgtagagtgagacatcatgatgtctgcaacttaccttcaaatggttcagcaaaaaaaaatgtgtgtgcatgtatgtatgtctgtatgtgtctgtgcagctccgtctaggtggtagggccctcatgcatgtgttattcctattcctaaaatattagcttgttagatctttgaataaccagttgactctcctgagtacacatcagctttggcattttctcttgacagtctcattctcactcacagttcaagttgttctgtctcctgggacatcttgtgtggtctgttctgacttctctgctagtgtcattaccacatcagcatctgattccaatgcatactgtctgggttttttattcctttccctgcagaatgatgacacattagacatggacttctcccagtggccagaaatacccatcaaaaaggcctgtgcgggcctcagaccctaccctactcttgctggttttgctccccacactgaagccatgtagcctctgacagcctcactggccaacaccatattctgatacctgtggagctatttttttgtttttctttctttttctttttttttttttgagacagagtcttgctctgtcgcccaggctggagtgcagtggcacaatcatagctcactgcagccttcaactcctgggctcaagcaaatcccccacctcggcctcctaagtagttgggaccaacgtgtgtgcccccacacctggcttggagccttgtttcagcccattttctccttccctcggctatcgtcatccttcatgcctgcatgcctcagttaggggtgtgttctcagcatttgtcctcatctctacctcctcatctgaaatccagtgttttggggggtaaggttttattgaggtgtaatttatatacagcacagttgtacaattttaagtatacaatttgatgaggttgagcaaacgtatacagttgtgtaaccagcaccacaatcatgatatgggacgtttccatgacccaaaaatgtcctcatgcccctgtgcattcagtggtctcccctctccccttggtaaccactatagttttgctgtagattttcctctttaaggatttcatatggaatttatattatgtggtcttttgtctctgctttatttcgcttagcatatgcttttgagtttatccatattgttgtgtgaatcagtagtttgttcctttttattggtgagtaatattccatttgtattagtctgctagggttgccatacaaagtatggcaggagggcttaaatgacagaaatgtatttcctcacagttccagaggcaagaaatctgaaatcaaggtgtcagcagggttgatttcttctgaggcttctccttggcttgtagatggccaccttttccccgcatcttcacatggtcttacctcttctatgtctgtgtccaaatttcctcttcttatgaggacaccagttatattggatcaaggcccactgcattgaattcattttaactgaattacttctttaaagaacctctctccaggccgggtgcagtggctcacgcctgtaaccccagcattttgggaggctgaggtgggtggaacacttgaggtcaggagttcaagaccagccggccaacatggtgaaaccctgtctctactaaaaatacaaaaatttagctgggcgttagttctcgcctgtagtcctagctactcaggaggctgaggcaggagaatctcttgaacccaggaggcagaggttgcagtgagctgagattgcaccactgtactccagcctgggtgacagagtgagaccatgtctcaaaaaaaaaaaaaaaaaaaaaaaacctctctcggagttaccaagcattgagacataagaatttgaggtgaggggtatacatttcatcccattgctccattggatggagcaaactgctccgcagtttgcttatccattcaccagccgatggacatttaggttactcataggcttttgctattacaaataaacccgctataaatatttgagtacacgtatggctgtgcattttaatttctcttgcataaatacctaggtgtgaaattgctgagccatatagtaaatatatgtttgtcaattttattgatcttttcaaaaaacaatttttttgttttattgatttttctctattttctgttttccatttcagagatttctgatccttattatctccttggtgtcttaagattgaaacttactttacttactttagtgtcttaagattgaaacatagatattgatttgataccttttttcctcatatagcattcagcgttgtaaatttctaagcactgcctcaactatatcctacaacttttgttatgtcacattttcacttttattcagctcaaaatagcttctaatttccctagtgatgtattcttcagccatatgttatttcagaatgtgttgtttcatttcctaatatttagggcattttccagataactttctattatggatttctgatttaattctattgtcatcaaagaatgaactttgtgtgatttaaagtctttcaagtctaccaagatttattttatttcccagagtgtggtttatcttggtaaatgttccacatgcccttgaaaaaatatgtattatgcctttgttggttagagtgttatgtaaatatcagttaagtcaagttgaatgatggtgttttttaattgttctgtcagtttttgcattatgtattttgaagctcttttagtagatacatttatatttaggattgctatgagttcttaatgaattaactgttttatcattatgtaatattctctttgtctctgatagtcctctctctgaaatctactttgctattactataggcacttgagctttttttttttaaattagtatttgcagggtttatctttttctatcctatcacttttaacctatctttgtatgtaaagtgggtttctgtagcttgctttttgaattcagtttgacaatctccaccttttaattggagtgtttaaactattcgcatttagtgtaattattaatatggttggatttacatgtcctttttttttttttcttttgacagagtttggctcttgtcacccaggctggagtgcagtggcgcaatcttggctcactgcaacctccacctcttgggttcaagcaattctcctgacctcaggtgatctgccaccttggcctcccaagtgctgggattataggcgtgagccaccccacccggccttgctattagttttctatgtcttatgtcttttttgtttctcatttcctcccttaatgacttcttttgaggtaaacacatactgttctaatatactcttaattcctctgatttcattaatatttttcaccttttagttatttgattggatgctggacattgtgaattttactttgttgagtaggtttttggaattccttgtttctgggatttgttctgggatgcagtgaaattacttggcatctatttgatcctttcaaggatcaaagcaagtctggagttgggtggtggccaggatgcccaggcccagggggagcaggcaggaaggattggaaggcagtcaggtgaggactgcaggtagcctctcttagtcccttggggcacagaacttgctgatatatacaaggtttccttccttagagtgtaataacagtttctagtctgggatcggatccttttgcgttactgagctttgaatagagttgctgggatttttgtactattaatattctctcaaatttttaagtttgaaattcttgactccaggaagcatagcatctcacccaggacttagagcctgatacaacagccatgtacagcccctgggtcccaccgcaagttgccagggccctgtggtgtctattcagacctgctttcccaatctagaaggtggtgtgggaatgcatgccaattcccagcccccctccctgcccctggtccccgaattcagtcatggtcagtgtctacagcacaaccttctggcatgggagaaggtcacctgaggttaaccctttacttgtagggtccttaatcaatctctggctcctttggaaccatggacacagaatcagtcctgggtgagaacctatatgtcatttcaggaatcggtgagtttcaaggatgtggctgtggacttcacccaggaggagtggggtcaactagactcccctcagagggccttgtaccgggatgtgatgttggagaactaccagaaccttcttgccctaggtaaaatccccccagccccaggctgggcgtcggctgtcagccttcttctacatggtagatattaaggagaatcccttcagtgccggccctggtgccagatatatcatggggtgggaagcaaggcctgtgccttggggcactcatggccaggggcctcggccacgccagaagtccccaagggacagcgtgggagctggtagcatccttgcttggtgtttcccctggtcctgggataggggcagggagagaagagaagaaggtgggaccctggagcccagctggctctggaacagtcctcaagcaatgaagtaaggacgtcagcacacgtggggtcttcagagtatacactgggatttgggttccagtctgagaccctcactgcttttggcccagaggacctcctgttcccagagagggtgtccacttcacaggcattgtccttgttagggggcggcctgtaaggtcgactgggcctggagagctgcagcatgcccagcccactttctctccacgagcaggacctccactgcacaagccagatgtgatctctcatctggaacgaggcgaggagccatggagcatgcagagggaagtccccagagggccctgtccaggtgagcagaggcacaggtggaagggtgccagccccagcacccctggtggcacctcctcctatggcccctattttcctccctcagtttgccccggctccatctccccttttcaggtcccccgccagaccctcctgcctgcctcccttcagcacgtactgagcactgcctgtgtgctgagacctgttctgggatacaacagggaacaaacctggccactgggaccaaatggtcacctgctgatggggatggggaggcaggaatagaaatattgagccattggtgttggctgggcagccgggggtgtgggattgggggcagggggccaccagggaaggggcagctggcgttggtcagtgtcagggtcagcatgagcatcagcatcagggccagcgtcagcgtcagggtcagagccagcatcagtgtcagggccagcgtgagcatcagcatcagggccagtgtgagcatcagtgtcagggccatcatcagcgtcagggtcagagtcagcatcagcattagggtcagcatcagcgtcagggtcagggtcaacgtcagcgagggcttccaggctgtggccaagatggcagccctccgtaagggaaaggggactggggtgggtgttgagcagaaggtagtctgcttttcttctccaacattctttttgtagacttctcttctgagttggttgataaataagtggtaaattcggcttaatttattggacagtgactgctgagcatgttaggtgtctagaaagctcgagaaacacctttctgtgggaaaggcagccgataagctgtggagcacagaacacgggggtcggggaaggcagcccctcctccatccccctccactgccacataccacccagccccaacctgcaacagtggctgcagccccagctttctggtctttatttctcaccccagcctctgatgcttgctttgtcctctttaacaagattacaggtttcaaaaaattcatatttttgtttgattcatatatgaatatactgaaaatgaggctgaaaggttactgaaatcctgcataatctttccacccagagatgacggttctctaataactgaccatgtcactgattcctctgggcccttcctctgtgtgcggatagacttctaaagctacatgtggccaggcgtgatggctcacacctgtaatcccaacactttgggaggccgaggcaggcagatcacctgaggtcaggagttcgagaccagcctgaccaacatagagaaaccctgtctctactaaaattacaaaattagctgggcatggtggtgcatgcctgtaatcccagctacttgggaggctgaggcaggagaatcgcttgaacccaggaggcagaggttgcggtgagctgagatcgtgccattgcactccagtctgggtaacaagagtgaaattccatctcaaaaaaaaaaaaaaaaaaaaattagctgggcgtggtggtgagcacctgtaatcccagctactctggaggcttaggcaggagaattgcttgaacccgggaggcagaggttgcagtgagccatgatcgcaccattgcactccagcctgtgtgacagagctaaactccatctcaaacaaataaataaataaagccttatgcaccctcggaagcacagcactcacgccggagtctggctaccacactggccatggcatagtgagcgtcctcacgtgatgtttactgattgcacagtatcccttagatgaatgtgccctgctgtgttgttggccctattgctgccaaaacaacttttttctggcctgggcctcttctctctgctctgtgcaacttccctagactcttacctctcacttggtgtggatgtggtctacactatagcaacaccagctgagctgcagccctgtgtcactgaccatctcgtgggcctctgcttgcatgtctaaaaccagacttggaactggcccttcctcctcctttataaaagcttccaccatccacccaggcttgggtgtttgctgaggtctcatcctctcccccatttcctctcttgccaccttcagtcaacagctagggccatcagttttagcacctaaatggctcttagatctgctgcttcctgttcattttcacagccttggttccagtctgaagttgccatttttcacctgaattattcagatggcctccctaactggcctccctaactgctggctccaaccaccttacacaccaccaaagccaccttcaagacaaaccattatgccaggcacagggactcacacatctaatcccagcactttgggaggccaaggcaggaggaccacttgagcccaggagttggaggctgcagcgagctgtgattgcacccctgcactgcagcctggacaacagagcgagactgtgtccccgccctctgcttcccccgccccccgtcaagacaccatatgatcacatcaccctctgtgcaaaaggcctttcttccccggctgccctctgagtcaggcatctggtcacctcgaacccatccaccttgccagggtcacctctcagccttcctgcctctgcgtgtcttgtcttcatcttactgtctcacctctgagcttctgcacatgctgttcactctccacctggctacctgccatgtgtgccatggccagttccacttgccctgctcttctgcatgtgttggggccacaggcagcaccaccatgcagctctgcccgctgcactagactgctcccttttaagcctggggaggacagaattagaaataaaatctcctgccagctcagaaaaccttgctatagagatagaaaagaaagaaagccttcttattgaataagtgtttaaccagatgtggtgtacaggagagaaagaaacctccccctttgacagaggagacacatccaacccagcacacagggcaactgtcttcacctaaaggaagagtacagctttttgggttttgtttgtttgtttgttttttgagacagggtatccctctattgcccaggctggggtgcggttgcatgatcatagctcgaagcctcaacctccctaggctcaggtgatcctcccacctcagcctcctgagtagctgggactatagacaggtaccatcattcctggctaattttgtattttttgtagaggggtctcactgtgttacccaggctggtcttgatctgggctcaagtgatccgccaccttgacctcccaaagtgctgggattacaggtatgagccaccgcgcccagcctcttgtagctttttgacaagcaggaagttacatcttggactcgactcttggactaggctcattttgcttctgaaaaggtttgcatgcgtctcgagacagagaaagcatttgcaattcccagtgttctaaagggaagcgctggggtgtggggagcccttttttccttttggcaccacagacaatttttaattcatttgttagtcctagctactcgggaggctgaggccggagaatggcgtgaacctgggaggcggagcttgcagtgagccgagatcgcgccactgcactccggcctgggcgacagagcgagactcggtctcaaaacaaacaaacaaacaaaaaacatgtatttgtcctgtgtattgcgagcacctgccatggtattgatacagagcagtcggtcagccgacgtgtccgtgaatgagtgtaatcctcatcaacagctcccaagcttgcccctttctcagcccccttggtgcttgtagctgttccttccgggattcctttggcttctccgcctctcccggtctttgctctctggtagctccttccgtgttcttcctctcccttcttcccgctcttgcttgcccatctcatcctgggcgctcccttctctctgcctgcaccttccagccttggccctggtggcctctcctctcttttctgggcttatctgcatctccaggccaattctcaaatctgaattctaggccaggtttccgcttgctcacagaaaatcattttcaatatcttacagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacacggctttaatcaggagtttcctccataaactattattttcagaataataataaaacaagaattatgactagcatcactttccagtgaacattattatattgctagagaggagaataatcttgggtggtgggcatttggaaaaagtgaatttcctggacttaactcatgtaaatagctctactgcagagctgtgtgtttagtgacagtgcagtcaggggcattcccacagctgtcacagcacggcccagcatcattgtagccagatcctaacatgccaacatcacctcttgccatttagcccctagtgagaaattgggagctaccaggcaggtgcccagtgcattcagggaagatgggcacaacatcaggatgggtgtgtctggaagctcctcttcactgaccagggctgggcagggccaccctgggctggtgaggctgccctgcagggcttctcactatgtagcaccagtcaccagcccaggtcacagaagaagcccctcccagcacccactggagaggggaagctgaagcccagggagacgggctccatggtggtcccacatggagctgttttgcaaaccctggaaaaggcggctctccctgtcccaacactcttcagagacaggaagacagagttaatcttgaatgaatgttatttctacttagtcctaagcaagaataagctgccctcttggtgatcatactttatacggagtgctatcgtttatgaaatgctttcagtatgctttttaaattatgcaggcaaaataaccacacttcagaaaatgtggacttctgaaaaataaaatccccataattcttaataaaactgccttttgcactttgatacattaccctctgctttgttcatgtagaactttgcattattttcaacacagtgtatctatagtttttatcttttttccctctttagctttgtagcagatttttttttcaagcatctaaactgtcctcgttatacttcttttttttttaaattatactgtaagttctagggtacgtatgcacaacgtgcaggttagttacatatgtatacatgtgtcatgttggtgtgctgcacccagtaactcgtcatttaacattaggtatatctccaaatgctatccctcccgcctccccccaccccacaacaggccctggtgtgtgatgttccccttcctgtgtccattgttcaattccaacctatgagtgagaacatgcgatatttggttttttgtccttgcgatagtgtgctgagaatgatggtttccagcttcatccatgtccttgttatacttctaaacagaggcacagtgttctctctggtctcttagatactcttttgttggatgttgaagttatttccatggtgcagtggtgtgatcacagctcactgaaacctcaacctccctggctcaggtgatcctcccacctcaacctcctgagtggttgggactttgggactacaggtgtgcgccaccacgcccagctaaatttttggggggggcagggggtctcgctgtgttgctcaggctggtattgaactcctggtctcaagcgatcctcccacctcagcctctcaaagtgttggggttacaggcatgagccactgcacccagtctattgatctttctttttgaaaaatatttgaatatgccctttgtccctctttatattggagtcttgatgtttttcttttatgtatgtaaaaacttttccctgattatgaatattatatgtatactgcagaaaatttttaaaaatcacaaaatcataataaaaatgaccctcaggttccagctcagtggctcatgcctgtactttgagaggccaaggcaagattgcttgagcccaggagttcaagaccagcctgggcaacatagggagatcccatctctacaaaaaatacaaaaaaaaaaaaaaaattagctgggcatggcggtgcgtgcctgtagtcacagctactctggaggctatggtgggaggatcacttgagcccaggaggtcaaggctgtagtgagtcataatggcaccactgcactccagcctgggtgacagagcaagactgtctcaaaacaaacaccttcagaatcagttcatggatcattaccattattaacatttagatgcgttttcttgcagttgttttctatgcatgtatacatatcttttttcttttaaaagaaaattaggctgggtgcggtggctcacgcctgtaatcccagcactttgggaagccgaggtgggcagatcacctgaggtcaggagtttgagaccagcctggccaacatggtgaaacccctgtctctactaaaaatacaaaaattagccgggtatggtggccggtgcctgtaatcacagctagtcaggagcctgaggcgggagaatcgcttgaacctgggaggtggaggttgcagtgaggccagattgtgccattgcactccagcctggtcaacaaacaagagcgaaaccctgtctcagaaaaaaaaaaaattagattcatattctacatattatttttatcattttccatttaacattttatgataagcattttctatgttataaaatattttcagacataattggccacatcattttctgtcttacagttgtatcttaatttatctattcccttactattgaacatcaagattgtttgtgcctataaataattatttaacataggcctctgttcccatctttgatcatttcctctgagtacgttctgagaaatgcagttaactggtgaaggttatgaacactgaagctcgttggtgttcctgggtggaatctgatctggtggacctgctgtgagctgttcccatcggctctgacatgacgctgtgagctgttcctccctggacgaacatgttcctcccatgacgctgtcaccactccctggccagcatggggtcgttccggccttgatttttatatctgccattttgaggctttaagaatgttatttgtccctgcttgttggccgtttgtttttctcttcatatgtgtggtctgttcttgtcttttgtccactattctctttggtttatttcacacacacacatacacagagagacacacagatgcataaatgacatacacatacacacataaacagatgcataagcacagacacacacacacacatatatatccccttggcatgtacattttctgtctttgttacagcatttttaatgcccagaggttttctttttcttttttcttttcttttctttttttttttttttttatgagatggagtctccctctgttgcccaggctggagtgcagtggtgtgatctcggctcactgcaagctccgcctcccgggttcacgccattctcctgcctcagcctcccaagtagctgggactacaggcacctgccaccacgcccagctaattttttgtatttttagtagaggcggggtttcaccgtgttagccaggatggtctcgatctcctgaccttgtgatccgcctgcctcggcctgccaaagtgctgggattacaggcgtgagccaccgtgcccggccaaaaaggactcttaaaactcaacaataagaacatgaacggctgggcacagccgttcatgacacagatggctgtgtcatgggccatagaataatttaaaaaacaataaaagtctcagctgggcacagtggctcatgcctataaacacagcattttgggaggctgaggtgggaagatcacttgaggccaggagctcgagaccaacatggacaacatagcaagactccatctctaccaaaaaaacaaaaaaaattagttgggcatggtaatatgcacctgtaatcccagctgcttggagacttaggcaggaggattgcttgagcccaggagttcaagtctagtgagctatgattgtgccactgcactttagcctgggcgacagagcaagaccttgtctcaaaaaaaaaattctattttttaataaatggacctgaatattttaccgtaggtcttcccaaagggtccagggatgccatcacccgattgcatagctagaaagcggatggactttttagtaagtgtgggttctagtaagtgttgccgcactgaagaacatctctggccaggcgcggtggctcacgcctgtaatcccagcactttgggaggccaaggtgggtggatcacttgaggtcaggagttcaagaccattctggccaacatggtgaaacacttcctctactaaaagtacaaaaattagctgggcatggtggtgggtgcctgtagtcccagctacttgggaggctgaggcaggagaatcgcttgaacccaggaggtggagcttgcagtgagccgagatcatgccaccgcactccagcctgggcaacagagcaagactccgtctcgaaaaactaaaaaagaagaagaacatctctgctctcagcttaggtcctgggcccctaaagtcagcgaggcagccattgtcctagggtgatacgatgacatggatttgggactccctggaggaggccacacacacacaaaatgcaactctacaaggggagggaacagaaactgaaacaggtatctgcaatgtgcctggatccgaatttcaaaatgtgttgaagaattatggatttacaccatgagaaaagcactggttggcttttgtgcctgcttcactttggctctgagttaacttcaaacactgccaaacacaatgctagcacatggtgaccctcaaactaataatttataagatgggatccacttccccggtggaagtggccacatgctgccctctccccacccccacggcatacttgggcatgacctgcagccttttgttgccatccaggttcgtgttcattctgctggtgcagtaaatcaaccactatgacatggttttgcaaaaaagaaaagatttattcacaagggcactgatcggggaggtggatcctttttaagtccttaagtctttcgtcccccgaagataagtaacagcttccttctgtgtgagcatggctggagttcatggcatttcacaagacacgtgtacagaagagggtagcattagcattttccaaaggcggagtttttggccctccagtgtcaaaaggccacctttcgggcacttgtgcaggcccaattgaagggttggtggtctcaaccagtttgaactggacaggagctggcccaagttcctgaaaaacaactgaagaagccggcaccatggtgacttatgcatgttatctatacagtagccagggaaggttaagtttcagcattcagcggcaaggctttcagctactgtggcccttaagcttcacagaaaaaggagaaaaaaaaattaaaaaccaaatgacccaaaagcaagcagagcaggcagacctggccaaattaacccttcagtttcactttcccttgctctgttgggcatttgtggcttggaaaatggccccctcctgccgcagacagaccctttactgctgacaccaatcattacattgatctgtcgtggttcagtgcaccactgcactccagcctgggcaacagagtgagaccctgtcaaaaaggaaaggaaaggataggaaaagggaagagaagagaaaggggaaggggcaagggaaggggaaggggaaggggaaggggaggagggagggaaagaaaggaagaaaataaaagaaagaaaagagaaaagaaaagaaaaagaaaaaaagaaaagaaaagaaaatgcacagtgagttagatttggcctggaggctgtagcttgccaactcctcctctggattcatggattagagtttaaggaagagatggagaagtatggcagaagaactggagtgaggccgaaccccgtggtgttctagaagaaaggctcttgacacaagcatctggcagttatttttcaggggagaacctacaaattataaggctgtgcagctccccttactagtcaagtgattacacttttgttttcttttatttttttttagagacaggatctccctctgtcacccaggctggagtgtggtgccgcagtcacagctcactgcagcctcgaacttgtgggctcaagtgatcctgcctcagcctcctgagtagctgggactacagacacactccaccatgcctgggtaattgtttctagttttgtagagatgaggtctccttgtgttgcccagaatggtcttgaactcctcgcctcaagcaatcctcccaccttggcctcccaaagtgctgggattataggtatgaaccaccatgcccggcctcatgtgactactcctacagaggccctcgatggcctggaatgattgattccaggaccctgtcttctcatcccaaagcaccaaaccctactgacaaggaaagagcccccatttcagaacttccatggccaccccccaaccctgggattggcaactttgcaacctgggcttctccgataatcagatttacggtaagaccccaaagaggtccaggcgcttctaaaacaagttagacagagaatccaaacccaaatcctcaagatgtgagcccacatcacatcccccaaaatagagcatccgtgaccactccagccttgctagggacacagcatactccttgaccctcaccaaaggacaattgctctcacaaacacggggatccactggttcccacgcactaagcaaacttttatggccttaattgacactgtttccccagagaccccactaaatgtaagggaggaaccctctctgttccctgggacataagattgaaggcaaacaagtccgccttagcctgatcactggtgcaatagctttgcagaatattccagtggtctcagttctttctgctcttgaatttctatcactgggacagatgctccaattggaataaaacccacactttgtcccttactgttggtcttggcagatgagaccctgaggacctgcccaagccattaaaatcattaatatgacccaaaataaattaaaacagggacttcaaggattgagagaaggggtgaccatcccctctgtttctccatttaacagcccaatttgacgtgttcttcaaatggaaaagaacaaatgacatctcacagtcgatgctgaaaccttaacccagggggccatgggggccccagcccctgcagactgaaaggatggagcccattcagtcttttgctggccgatattttgctatttttgcttccttgcagtgttccacagtacctaattcaacaggctctcagcctctactcccattctatttattgtggtaaaatatataacaaaatttaccgttttaacctttttctttctttttttttttttttgaaacagggtctcactctgtcacccaggctggagtacagtggtgccattgcagatcactgcagcctcaacctcctgggttcaagtgatcctcccacctcagcctcctgagtaattaggattacaggcttaagccaccatgcccagcctactttaatcattttttaattttaattttatttatttttttaaattttactttaagttctgagattcatgtgcagaacgtgcaggtttgttacataggtatacacatgtcatagtggtttgccgcagctgtcaacccgtcatctaggttttaagccctgcatgccttaggtatttctcctaatgctgcccctcccgcagccccccatcctcagacaggccccggtgtgtgatactcccctccctgtgtccatgtgttctcattgctcaactgccacttataagtgagaacatgcagtgtttggttttctgttcctgtgttagtttgctgaaaatgatggcttccagcttcatccgtgtccctgcaaaagacatgagttcattattttttatggctgcatagtattccatggtgtatatatgccacattttctttatccagtctatcactgatgggcatttgggttggttccaagtctttgctattgtaaatagtgctgcaataaacatatgtgtacaggtgtctttacagtagaatgatttataatcctttgggtatgtacccagtaatgggatcactgggtcaaatggtatttctggttctagatccttgaggaatcgccacaatgtcttccacaatggctgaactaatttacactcccaccaacagtgtaaaagcgttcctatttctccacagccttgccagcatctgttgttttctgactttttaataatcgccattctaactggtgtgagatggtatctcattgtggttttgatttgcatgtctctaatgaccagtgatgatgagcgtttcttcatatgtttgttggctacataaatatcttcttttgagaagtgtctgttcatatcctttgcccactttttgatggggttgtttttttcttgtaaatttgtttaagttccttgtagattctggatattagacctttgtcagatgggtagcttgcaaaagttttctcccattctgtaggttgcctgttcactctgatgatagtttcatttgctgtgcagaagctctttagtttgattagattccatgcgtcaattttggcttttgttgccattgcttttggtgttttagtcatgaagtctttgcccatgcttatgttctgaatggtattgcctaggttttcttctagggtttttacggtttttgggttttacatttaagtctttaatctattttgagttaatttttgtataaggtataaggaaggggtccagtttctgttttctgcttgtggctagccggttttcccagcaccattattaaacagggaatcctttttccatttcttgtttttgtcaggtttgtcaaagatcagatggttgtagatatgtggtgttatttctgaggtccctgttctgttccattggtctatatatctgtttaaaaatatggaacactttggctgggtgcggtggctcacacctgtaatcccagcactttgggaggccgaggcgggtggatcatgaggtcaggagatcaagaccatggtgaaaccccgtctctactaaaaatacaaaaaattagccgggcgtggtggcgggcgcctgtagtcccagctactcgggaggctgaggcaggagaatggcatgaccctcggaggcagagcttgcagtgagccgagattgtgctactgcactccagcctgggtgacagagcgagactccgtctcaaaataaataaataaataaataataaaaaataaaaataaaaatatggaacgcttcacacatttgcgtgtcacccttgggcagaggccatgagaaacttctatcgttctgattttagtatatgtgctgccgaagcgagcactattttaatcatttttaagtgcacggtttagtgacattaagtacattcactgccatctatttctagaatcttttcatcacccgaaactgaaactctgcattcctattaaacactaattcccatacctcccagcccgtggtaaccacggttccaccttctgtttctacagaattttttttcttttttttttttttttttgagatggagtcttgctctgtcgcccaggctggagtgcagtggcgtgatctcggctcactgcaacctctgcctcccgggttcaaacgattctcctgcctcagcctcccaagtagctgggactacaggcacacatcaccatgccctgctaatttttttgttttgttttgtttttgttcatttgttttctttgaggcaaagttttgctcgtcacccaggctggagtgcagtgccgtggcagtggcgcaatcttggttcaccgctactctgtctcccgggtccaagtgattctcttccctcagcctcccaagtagctaggattacaggcacacacgaccacatacggctaatttttgtatttttggtaaattttgtatttttggtatttttgccaggctggtgtcaaactcctgacctcaggtggttcactcacctccgcctcccaaagtgctgggattacaggcgtgaggcacctcgccccgcctgtctctacgaatttgactcctctagatactccacatacatggaactgcacagtatttgtcgctgacttctggctgtcctcacctggctatgcctactttgggggataatctgggcctgggacaccacatccccgtagcaggccccaccgggccgcacaaacagaactgcgccgaagttcccccaggctgttacccccacttgtttaggctcttcaaagatgctaccggccgggcgtggtggctcatgcctgtaatcccagcacttcggtgggccgaggtggtcagatcacttgaggtcaggagatcgagaccagcctggccaacatggtgaaaccccgtctctactaaaaatacaaaaattagtcgggcttggtggtacgcgcttgtaatcccagctactctgtaggctaaggcaggagaatcgcttgaacctgggaggcagaggttgcagtgagccaagattgcgccactgcactccagcctgggcgataaagtggatactctgtttcaaaagaaaaaaaaaaggtggcaccggcccggtgcggtggctcacacctgtaatctcagcactttcggaggctgagatggaaggatgtcttgggcccgggggatggaggctgcagtgagcggttattgagtgactgcgtccagcctgggcctcagagtgaggccgtgcctcaaaaagaagaaaaaaaaaaaaaaaaaaagcagcagctacccatccagccgccagatggcagcacgattccatggcccccactagccgctggctgcctggtgccggatgcagtccgaaaggcggttctgagctccaagggccggcgccgcgcgtgcctgcggtcccagctgctcgggaggcccaggcaggagaatcgcgtgaccgggagttctgcgctgcagtgcgctgtgccgatccaggtcctcactgaagccggcatcagtatggtggcctctgccaccaggccgcctagggaggggcgaggcagccccagttggaaacggagcgcgtcagtagtggcatcgcgcctgggaatagcctctgcgctccagccgggtcgacctgccgagactccgcctctaaaaccagcaaataccgggaggctgagggacgaggaccgctggagcccgggaggcggaggttgcagtgagtagctgggattacaggcaggcgccaccacgcccgggtaatttttgtgttattagtagagacggggttccaccatgttgaccaggcaggtcttgaactcctgacctcaagtgatccaccctccttggcctcccaaagtgctgggattacaggcgtgagccattgcgcctggccaaataagtaatttaagcaattttttttgtttcagaaaaaaaattaactcataaaggagcccccccgacacacacacacacacacacacacacacacacacacacacacacacgggaagcagcagtgtaattggaatgcccactgctgaggctctcgaatgagtgtcatgtgtgcacattttgcccctcacaatgcacgtcagactattaataggaagcagccgctggaatacctctggtggggtgtgtgcagcaggcagctttggaattacggtatccccaatgtgacagcaggacaatggcttcttcactggcactgtccaaccacagtgctgtggttatgtctcgaggtccattattgggcgaaggtcactgcagactcagggaggcccaggagctcaccccaaccagcttctttaccaggtgagtgacctcagccctgcagctggactcatggagacaatgacctcacccgaagatagatgacccctgtccaccgtccacacaacaactgaactggccccaggttgactcctctacaccctgcttcctactgtacccctgtcaaaggccttcctcccacccttcccactcctcttcctccctggcagcccaaccaccacaaattcactaacttgttttcaactcttacaggctgccctcctaaccctagccctgacctctgccctcctaaccccagccctgaccccaccgccctctcaggaggctttaccaatcctctgcatgttagccccacccaaggaacaggcctattttcaagcatactaactgttgggtgtgtcgcttacctatgcatatgacagccaatccaacctacctaaatgacagcacagctccatccatggatgtggctgatcacatctccaaaccatcttcccactggggacaaattcttggattttttagagacaggttctcactctgtcacccaggctggagtacagtggtgagcctcagactcctgggctcaagggatcctcccacctcaacctctggagtagctgggactacaggtgcacaccaccaccgtgcctggctaaatttttaatttttttttttttttttttttttttagagatgggggttgctatgttttccaggctggttttgaactcctatcctcaagtgatcctcccacctcagcctcccaaagcactgggattatagatgtgagccaccaatcttagcccaaatttttaactaaactcaattaaacaaatgaacaaacagaaaagactctcaaaccacacactgtcgtctctcacccaacagagacaagacgtctataaaccaccaatctgtttaaagagaccaccaaatgttcagaccatgaaactgaaagaatcaaaataaagttgtcactatgccaccaacggacaaaagccaggagcacacaaccaggggtcatactcactgaaggtcccccaccctgatggccagtcaggggcggcttgcgggtctcagagagggctcaccacctgcttgcagtcattggggatgggaaggtaagtccaacccatgccaggtcaaggcacaaagactgtggggggaatgcaccagacacataaagagatgactttattcaggctactgctatgggaagaaaactcactaatgaggaaggaggggcctggtaaataagagactcatgtggaaggctggaggcggggtcttagaatggacaagggcaaagtgctccttctggtctcactatttctcagaacgcaaaggaagaggcaatttctcagtgagcaccatttccctggaacccagggctgagatgaatttcagtactgccagcggcctccgcgttctcctgtgtgtgtaggagtttgtgtgttccagtgtgcgtgttcccactgtgtcttggtgtttctgtgtgcctggtggcatgtctgtgtgtgtatctgcagggtgaaagaccacagatactatccgaattcccgtgctcaagtgcgcctcctgccttggctttcctgagtgtggggatgacaggcgtgagccaccacgctgggcctcatgatctgtttctagtgcagtgagtgcatcttagggtgggtgcccgcctccatgcttagtagggcatggatgctgtgtatgccatctgtcggtaggatggttacacttctgtgtgttggctgatgtgtgtgtctcagtatttagtcggctctggtggcacatgtgtgtgttgcaggttgtataagttgctgtttctctgtgtctggtggaaggtgtctatggttgcagagtgagggtctcttggtgtttctgtgtgtcagagggtgtgtgtgtgtgtgtgtgtgtgtgttttgcaggatgaggtgtgttctgtgagtgtgatgtggggggtgcagggtgcatatctgtgtctacatttcttttttttcttcttcttcttttttttgagacagagtctcgctctgtcgcccaggctggagcgcagtgatgcgatctccactcactgcaaacactgcctcccaggtttaagcaattctcccagctcagcctcccaagtagctgagattacaggcgcatgccaccacgcccggctaattttttgtatttttagtagagatgcggtctcaccatgttggccaggctggtcttaaactcctgatctcaagtgatctgcctgcctcggcctcccaaagtgctgggattaacaggcgtgagtcactgcacccagcctgtctgcatttctgtctggtggtgagctatgtgctgcaggtagtgtgtttaatgtgtttctctcatgtttccgtgtatctggtggaagatgtgtgtctgcaggatgagtgtctcttttgtcggtgtatcatggattgtgtgtttgtgtgtgttgcagggaatgtgtttgtctcagtatctgagtgtgtcgggtcgtgtgcaggtgtgtgtttttttgtgtgtttgtttgtttgaaacagagtctcactctgtcgccaggctggagtgcagtggtgtgatctcagctcacctgcaacctccgcctcccgggttcaatcgattcttctgcctcagcctcctgagtggctgggattacaggcgtctgccaccacacccagctaattttttgtatttttagtggagacagggtttcaccatgttggccaggctagtcttgaactcctgatctcaagtgaaccgcctgcctcgtcctcccaaagtgctagaattacaggcgtgagccaccgtacccggccgcacgtgtattttgtatgatatatatctgcttctgactttggtgaagtgtgtgtgtcgcagggttgtgtctatcttgtggtttctatgtggcctatggtgtgtgtgctgcaatgagtctctgtcttggtgtttctgtgtctggtgatacatgttgtatgttgcagagtgagtctttttttccatttttatgtgcgtggtgtgggttgagtgtcctccatagtagtgggctggctgtgtgtgtgtcacagcgcgtctgtctctgtgagcggtgggttgtgtgtgtgtgttggagagtgagtgtttctgtctgatggagtgtcgtgtgtgtgtgtgtgttggcaggtgagtggctgtgttcctctgggcccagtgctgtgtgggcgtctgttgcagtgtgtgtgccgtctctgtgtttctgagattctgctggctttgtgtgtgcatgtctgcgtttcgggctgtgtgtctgtgttggtgtttctgagtctagaggagcgtgcatgcggcgtagggttagtgtctgcaggcctctgtgtgctgtggcctgcgtctgcttgtaaccaccaggctgggcctggtccccacattcctcccactccattgtgctctgtgctacaaaaaatatttgcgttttccaccactcataatttttcctcctcaatcgctaccagatgtgggtcctgtggtccccatccccatggcaacggaggttccagcagccgcggttcccttttgtggcgcctgccctgggagctggcactgctgtgagccccgagggggtggggagaagcgggtggtgggaggcaggaggctggaggggtcccagcagctcccttcccagcagccactggaaccctcctggggggaagggaaggctggtggtaggttggggggggtcccctgttttgtgaggcacccacaggtagagtcttcgacacctagggggcttcccagagaagggcaaggagaggtccccagaaaggcctggtcactgggacatccctgttctctccaaatcgtgctggtccaggctgggggaggagaaatagcaagagctgagggcttgggggttcagggaacagcagtgtggcatcctcatcgttctggggggtgggcaccgcctagacaagaatgtggtctgagcccctgcactgcccacccctcacccacacgcaggcactgccctgccctcgcggagcccggctgggcatctgccctcttggccttaaccccagcagcccgcatggcgcagtgcccaaacagagcagaggctttccagccacagggccatggctgggagggtgcccagctggctccagggaagcagtatggcccagaggcagggatcccacattccacgtgctgcctgtttgtgtcctgccagctgctctggacggccgacccagggcaggacgcagtctccactcagatggctgggccttctgagatgggtgacccctctaagatgggtgaccaaagttgacctccgtggggcatctggtcagaggatgagagtgtgcccaggacgagagccccaagttgccagcgtgagaccaatgagtgctgtgtggcggctgcagggtgatcagaagatcctggcagcaggggaagactttgagctgggcatcaaaagatgagatgcaggagaacaagaagaggcctgccgggcagaggcaggaggtgggaggagaacagacaggcaggagctgggggaacttagtgtggggacagcaggggccatggaaggtgagggtctgcggcttaggagggtcacttaggaggcctgcccgggagggtaggcgggtcaggagcagcgaggccgtagggcacagatggtcacagatagccaggcagccgggtctggcttgggggcaggggatctgccccgggcgctccctccgtctccctcaaccttccgcagtagcaggcggggctggcaggcaggagagtttccggctgaggacaaggaacccgttgaggcagacagcagggctctgtgcagcaggagaccggcttgtttgtgctggaggaggcccggctggagtaagcgcccgcggccccctggccgcagcctctgcaccccccgcaagctgccaccaacagctctgaggcccaagtttaacagcagcggccaggggaaaaggccgggatccgaggcaggcccatcgcctgtccctttcagtcagggactctgcctgatctgcccccacccaaccttcctccccgtgaccagtccagaatggggcaggccagatcggggccgcataaacttgataaacaaacgaagcctgtgggttgacacagcccacttccaccatggtcccgggagacccacgcctgggctccagggctccccgctgagataaggggtgggggagagtgcaggacaggtcgtcacataaagttacttctggggggcatctttggccgaagcctgcaaacaggaagtgatcagagcatgaggggaaaggcattttattaagaaagctttggccaagcccccgccgggaggagcccatcctggggcaccggccgaggggggagcagccctgctgggggcctataaatacatctcctcaggccactagagtcgcccctggaggtcccgcggcgtgtggggcagtgggaggccatcaaaaccagctgacagctgaggggcctgggcccggggcgccagggaagggaaggggtgggacggactaagcccctgaggagcggagaccagccctcctccccaggctggggtcaaccagatgcccgggagcctggccagtggaagtagccccgggctctattgggacggccaagggagggagcctccagccagaggcaccaggccctagcgggggagaggcagcccgggcagaagtgcctctggctgcaaccaatgagaaggtagccctaaccaagtccactcctggccagtaagaggcggtctttaagcggaaccctcccatctttggccaatgagacgctgtctggtcggagcgctccataactcggccaatggggagggagtcgcccgctaagcgcctgtcaggcctcgaccaacgggatgggcccttcccgccagagcacactgctccaatccaggagcggctgcaggacctgagccaatgagacgcaacctccgctagccgcgcggtgcccggccaataggaggccgcccgtgcccggtagcgtgggaggtgtggggtggcgggcggcgctgcgaagctgagggagctgcgcgcggacgagccacagcctgctacagggtgggtgcgcccgccctgcccagctcgcccgccgcctcccggctcttcttgcgcggcggcttctggatgggggtcttcttccggggggtctcaggcgcgggcaagtcggtcgccgccttctcaggccccggggtttcggtcgctgggggcgcgcgggcgggcgaggctggcggcacggagcgcttggctttctgtgggggcgccggcttttccctggggccctgcgcgcccagggccacctcggcgcggcccaggctgcgagtcttgccgcgcacgtcagcggccaacatggaggcagcctcggcgcgcttcgcgggggaccgccggcgtccgtgggctccaagaggccggggcgcggcgcgcgctcgggccctgggcggcgagggcgcagcgagggctgtcgcctcctcgggcagccccggggggcgcggcgttgggtcgcgggtccgggggctgccgtgttcgaccgtatgcgccgatttgtcgctgggcgtccgtttcctcttgctggggctgggcgcggcctcggagcctggcggcggtggtgagggcgcacggccagctgcagcggcgctgtgcttgccgtggatccaggacaccttaggcttggtggcggggtcaggtggcggcggtttcctgcgctcgggcgatggcgacagcgacaggcccccaatctcgccccgggcccgggccggccgggcctcgcgtcgggccacgcgcgcgtacagagcccctccgggcccctccacgctggacgccgaccgctcgctgtcggaggacgcggggaggggtatcgcctcctcggcggaggctggcgtggtcaagggcacaggggacggcgccggcgcctcggcagggacagtggggacttcggggtcccggctctccgctggtgcctctggcaagggaagagcagggcggtcacagccttcaggaatacctttaggggctccaacctccaggcgcaaaccttcacctttcctcctctacccacgcccttggcactgtgtcaccctggcatctagacgtgcctggcacagagcaccaaccacacatgtgtacttcagagcctcaggctatgcggctgactctgaactcaggctgtgcaaggagtgatgggcgcattcccgcgactgaagcccaaccttggcctggcctggcagccctgccccaacacccctccagccttgggcgcctgcatcatcgaatttgaggctggaacatccccacaggggttccattatccttctttaagagagaaggcttctagctgggcgtggtggctcacgcctgtaatcccagcactttgggaggctgcggtcacctgaggtcaggagtttgagaccagcctggccaatatggtgaaaccctgtctctactaaaaatacaaaaattagctgggcgtggtcgtgggcgcctgtaatcccagctactcgggaggctgaggcaggagaattgcttgaacccaggaggcagaggttgcagtgactggagatcatgccactgcactccagcctgggtgacagaggcagactccgtctcaaaaaaaaaaaaagagcgataaggcttctgaggctctgagttggtcacctgcccgtggcatctgggggcacagtcaagggaggagacagggcagaatcccagaccatcaggctcctttctgctatctgtggatcaaaggctgtgtgtggatccaactcccatactctgtggatcccttcctcctgtctcctctgccaccccctacctaagcccagaaacttctctctgcctactttcccccaggagcaaccctgggctgtggcctacccatctccccacacctgtctccggtactgagcagcagagtccagctctatggcctcagctctgtgggcaaccctcaggtaccagcatggccaaggccttcctctccatgctgcctgcccttctcctgtgtcccacccagaacacagcttttccatgggaacatttcactgggctggagtgatgcccaggtagggccttacttaccctcatggggtacacagtacacagggccttcatcagtggtgtcaaacgaggagaaggaggcccgagaggaccaggatggtgagggctgctccagccctgagggtggctccaggaagctgcagttgagtgtgttatccaggtcgtggtgggccactggggaaggatgaggcagagctgccaggggtccactctgccccagccggtgccctcattagcccctgctgtgacaaatgttgatggggtgaccaagaccagccctattcttggactgcagggggcacaggcaactcaacaggtacagtgacactgggccaggactggagaatgggtagaggtgaacccagaaaagaaacatgggcacaacatgtgttaaggtgcaaggcaagtgtgtgcatccagggagctggaaaaggttgggctgacgtgttgagaaaaggccagaaaggtgggagacggggctgaagaagacacctggctgggacaggccaccaaggcctccaagctctgttttaggccctgccttgtgcgaataaggaagccttggagcacttctgagcccaaatgcgcagtggcagggctgccctttggctcagcccatctcagcaagctgcaccctaggcctggcctccagagatgcagaccccacaacagggggccccagaagctggctagcctggcctccattccacagagggatgtggggtccactccccacacctatgtccccagatgccatgctgctaggtgggccaaggggttttctctctcttgcttgcttgctttttcttttctttcgacagttttggggtttctcctccctccctccctccctccctcccttccttctctttcttcttttctcttctcttctcttctcctctcctctcctctcttctcttctcttttttcttgacagttttgctcttgttgcccaggctggagtgcaatggtgcgatctcggctcactgcaacctctgcctccctgcaacctctgcctcccaggttcaagtgattctcttgcctcagcctccagagtagctgggattataggcatgcgccaccacacccggctactttcgtatttttagtagagaccgggtttctccatgttggtcaggctggtcttgaactccaggcctcaggtgatccacctgcctcggcctcccaaagtgctgagattacaggcatgagccaccatgcccggcttggctaaggggttttctcagctgtttccttcatctcccaagagtctgagcccccttcccctccatctttagaaataagtgggaaagagaggaagagagggtccacccaggtgcaagtcagcatggagagaagcggcacaccccacccccctatcctgttggtgggtggggaccagcctgcccactttccaggaggatctctgggtactgctggggatgtaggcaggagggtgggtcctctccgtggggcagggcactcccgtggccacgcattcccccagcagctctggccgggatatacagcattctcctacagactgggggagcctgcgggacccagatgtccacacacccctgatgcgatcactctcagggccaacgtttctgacatatgcccacatcagccggcgcacctaggactcctgccttcctaccttgcctcgccctcagcagctgccacacctcttaccttccctctggtcgcacctcctcgcgcccacgcacatcaacactcaaggtcccccatttcctcactgagatctggaccccctcacacccatttcccagcagcttcctgcgtcgagaggtgtttctcccagataccccgcgctgtcatccttacctacgactttgggtagtttctgcctccggagcgggatccggggcagcttcatgctgatgcgactgaagcgcccgcatagtcggtgcggcgccttcttcctcccaagcgaaagctccctgcgggggcggggtctgagcggaggggcggggccggggcggggcccaggggcgattagatctcggccggagccaagcacagaaggggcggggccacgtccggggcaggggcgcggaagggttggatctgggtccggtggcacccagagggtgcggcctgaacccaggcgaaagcggggcagtatctgggctcaccggcgcgtagggtccttgccgcggcaagcgcagcagcagccgagcagcgagagcagcaggcagacgagcaggacgagcagcgcgcccgcgcccatcacgcccttgcgctggttggtttctgtagggggttatggggtcagcgcggtttctggcaccccctgcattccttaacgggacgcccctcatccacttacctaggtggcaggcaccagtgaccgggtcgcacgtgtcctcgtggcagctgcaggcctgagcacagtccgcgccgtggagtccgggcgggcacgtcacgttacagctgccgggacatagggtcaaggcatgccacagccgcccccctaggatgccccctaccctcacccctcacccgcggccagggcccagggtccagggtcccagaaccgggctctctctcgctgcattcgtcgtctagggattgaagccccgccccgcccgtggcacatattgggtagtggatgttttggaaacgaatgttgcacaacactagtgggggggcctgggggataggacccgtggtggccgcgccgcagcgcccactgctggggctgactcggctaggtgggaagaggggctgctgaaccagacccttggctgtaagtggaggtccctggtccttctgtaccaactcggggtcaccttaagagcccactgacacaggctggactggtcaccagatcctgcgctgaacgtgagctccccgacatccaggcaggaaactgcccccaaagagcctactgtcactccctagctggggtaagggaccaaggctgaggtgataacccagctcagggtggagaggccacctcgtcggctggacccccctctgtggcaggtacaagcccccaaccccctcccggtcccggggcactcactggggcccgtggacgccagggctgcacaggcagcgccccgactggaagtcgcagtgtccgctgccgcagtcggcgcacacgaaggcgcagtcctcgccgtaagtgccattgctacacttggtctcgcaccttggaaagaggggaggaggcgtcagcagaaatggaggcaaacggaccacagcgccctcgacattggggcctttgttagggaggcagggcgggggactgcgtgtctgggccgacgcaggcagggctgctcaccggtcgccgatccagcccgcgttgcagcgcgtacacttgccggtgacatggttacaggcatgcccgtcgcggcatggcggacagcggtggctgcagccctcgccatagaaaccggtggcgcaaggctggtcgcacttggttccgttccagccgggctcgcacgtcaagcagcggccctcggccaccgtgcacggctgctggcccttgcactggccacacctgggggaggggtcggaggctagggaaggctgggacccgcctcacccctgtccccatcggcggcccgcccttccacctcctccctccctggccgagagaccgcgcttaccggcggcgacagcccaagccgtagaagccggcggggcacggctcgcgacagtacttgccgcggtagcccggctcgcaggcacacgtgccgtccacagggtggcagcggccgcggaagcactggcagtagcgatcgcagcgcgcgccgaacgtacgctcgcggcactgacagcggccgctctgctgctcgcagggagacgagttgcaggcgcactggttgttgcagctgcggccccaccagcctgcgtggcacaggcaggcgccggtctgtgggtcgcagcgcgacgtggcgctgcagtagcacgcgctggcgcactgcgcgccccaccagccgggctcacagcggcacgcgccgctccgcgggtggcacgtgccgtgctggcactggcacgcatgctcgcagcgcgcgccccagcgccgcgcgtgacaagtacactggcctgtcacgtcctcgcactgcccgtgtgggtggcagctacacagctccttgcagtcggggccccagaactggcgcgggcactctgcaggggaggagcggagggggtggaaggccccggtgcttgagtaggtgcccccagccagccggaacctgcccgcgtcccgcactccagccgccacctctggggacccgccccgaaggcggatccgaccccgccccaccttggaccccgccccatctctccaggattccgccccaccgaccaataccggcccgaccccacgctcactggtgtcgcagttggcaccgaagtagccgtggcggcagcggcactcgccaggcctcacgcacacctcgttctctgagcacgtggagttgccttcgcacaccgctgtggacgagacaggccagagctgctgcgcgtcctagccccgccccctcccccgccccaggtccccgggatgacccactcaccaatcccacactcgtccccttgctgcctccagccagcgcagcacgtgggcacctgggagctgcgagcagagggaggacatctaagcccgatgcccctcccccagcccccatctgctccgggctcctccgcagcctccgcacagcctccctgcctctgcagttgcgctcctgtcctaggggggtggttaatgaggtcctgccaggcagtcgtctggcggtggaggattgccacaaacagacctcaccgccaagaactttccagcccagaaccacccaccccatctcacctaactcctttgtgtcctcctcccacagccattaggcctgagaaaagtggccttggagtcccaggaaggacagcagtgaggcagcagccagggagaagaccatgggcctcaggacctgcccaaatgtgagggtctagggcatccctccaagtggagggcccagcctaatgggtgtcatggatccagatgtcatgtgatgtgacatgatgaggacggcactaggactagctgggccacagggacacacctagatgcccagttggggttgagctccagtggggaggggcagcctctggacagggggacggggggtggcatgtagacacagtgaggtgaccacttggcagaggggcttctggagggaggtggggtgaggcccacccagccactagggaaggagcaggcacatggggagtcctccacgtgcaggaggaaagtcaaactgtggcaaaagggctcagggaccagggtggaggaaggagctattagagcatctgtttatgcctttgttgttggttttgaaacagtctcgctctgttgcccaggctggagtgcagtggcacgatctcggctcactgcaacttccacctcccaggttcaagcaattctcctgcctcaaacctctcaagtagctggaattacaggcacgtgccaccacacatggctaatttttgtatttttactagagacagggtttcgccatgttggccaggctggtcttgaactctgacctcaggtgatccgcccgcctcggcctcccaaagtgctgggattacaggcatgagccagcgtgcccggcctgtttatgctgattgtcttccacttgttccatttgatttggctttacagagtacacaatgctaccgcagcacttcaggagagcacaacctctaaaaccctgggtggatggggtgtgtgagcacaaaggtttggaggccctgcctgagtgaagccatgatggctagagagggttcgtaggggatgagctggggttagcccacattcaggggcagaggaggctgagaaggaagagccaccaaggctgcgggatcctaggttcccagccgacccagaacttcgcctcgatcctaaaggcatgtaacagccattcgcactttagagaaaaggagcacgcttcttcacaagcaggcttggattcagtatctgaatctagaaccggaaggtggtggggggcggagtttgggaggaagcctgaagaccctagcgggatgggatagactggccctacaccatgcatttcaggatagtacatgcctggcatgctcctgcccaggcttccgaggatgccccagccattccccagctagacagaataccaccccttgtacagagcacctaggcctcgaggcccctcctcctgaacaaggcttggttctccttcaggccaaagatgggacctggcgaacaggaccataaaatctcaaactttggggaattggtccagtgtattttccacaataaaactggaaaccagagacaggaatacaaaggcctggcttttcctggcccctgcccccactgtctccacccacccagccctgacccagggggcaccaaggtgcccatctgcagggagacccaggtctgctggccatcacccacccacttgtgtctgcttctgaaccatgttcactggatggagagcctctgcaggtgtccctcctgtggggagctttgccaggtggcctgctggaattgccccggaagcactaacccccttctgccctggacataaggctctgtggctaggaccctcgttttagggccacactcagctgggtttgatgtctgggtttgccacttgctgtgtgacctcaggcatgcagcttaagctctttgagcttcaggctccttagctatatagtagggctctactgtagaaagattaagagagccaagatgtttttttgccgggcgtgctggcatgtacctataatcccagctactcaggaagctgaggcaagaggattgcttgagcccaaggagtttgaggctgcagtgagctgtgatggcaccactgctctccagcctgggcaacagagtgaaaccctgtctcaaaaagagagatagagataggagagagagagagacagagaaagacgacagagagaaagagagcgcgcgccaagacctatgaagtggtttggcacatactaagcacaaaggatcctgagcacaggctgcagtgcctctgagtgcactcggtcatctctggtttagcgggcacccaggcctaaccccagcagagctaatgcccaccagcaggacagagtccatttgggttcactgagaacaagatgctttccttcttggaagggctggcagaaaaggccgggtggtggtggcaagcccactctctgaagatcttacaaagacgggtggggaaagatggcctgctgcagggctgctcccacgcttgccctgtaagtcggcaagaccctcagaagccaggccataggctgggcccaggcccctcagcaagcaagacatgccgtaggcttctccctcgtagagcattagttctgtgattcaaacccactgtgagttcttacatcttcaagttggctcatggggtccatacctgtccatgttctcccccaaatccaggcagaaaagcttctctgcctgccacacccttcagaccccacaccagcccgaccctcctgctgccccgcctggacacctctcctctggtttctgtccccatcctcagatctctcttgtgtccacactagctccctcgggaagctcactgaacactgacaacaccttggaccctccagcagggctctccccatcaatgctagacttgcaaatccaactgcccaatagatgatgtcaccagaaggagacctcatgggcctcatgcccaaccagcccaaacctgaactcttgacctccttgcaccctgagtcttccctgcctcagataaccctgcctgtcctttcaggctgggaagctgagacctggagaagcatctctgactcttctttcttgtctacaccagatccattgagaaaaaagacgctgagctctagcttctaaacgatatctaaaatgggatcacttcctccttccctatcccagccttgtgagagccaccctccatctccctggctttttgtaactggccccagcttccaccccctgccccccagggtgcgaagtgtttgccacctggcagccaatcctggtcagatcccaccctttctctgtacaaagcccccagggggtcccatggccctcagaagaaaagcccaagtcttctgagcagtggcagcccacggtggcctgcccaccctcactctctggcagctcctccgccagcccctcctggactctgcccagcctcctggatccttcctgtacttccacaggccctctgccttgggaaccttgccccagacacccacagggcctccgtgctcttctgcaggcctgtgctcactcaccaccttctcagccgttctcctcagaacaccctaaaggaaacagcactccccaacccaacacctcccagctcttgctagatgtctagacacacttgcttttctggactgtgtctcctctgccacagggtcagggtctccactgcagcttccctacaccaatacaggcctggcacagtgtaggtgcataggattttactggctttgcactctcctctccccatcctcctgcctcccaggaaagggaagggctgatggaagccttgcaagatgtgggaggacaacaaagacatgacccagaccccaggtgggcagtgcccagagtggctgtccttcccatcgacccttgccactcatgaccacagcgatctccacttagccccatgagggggttgtgatcactatcccattttacagaggtggagacaggcccagagaggtcaaatgacttgcccaggtccacacagctgggtagggtggcaccaggatgggaacccaaacccaggctcggttcctggagcaggcgcctcctgggaggtctgcagaccaggggagcgggagcaaagggctctcaggctccggacagctagagcctggcaccggacccccattcctggtcccgggcctgtctgggaaagagggctggagtgagtagacagagaccacggcgatcgcgccctccccctctccaggcaccgccccgcccgccgccgccgctgcattcctggggccggggaggcccgggagtccgcggcggcggcatcgatgcgaagcagatggcgggccaggccggcccccgccccggaggcggggctcgcagcggggaggggtctgcgcgcctccggaccagagttcggaaaccccgcgctgccccctcgcagccccttgtctctggcgccgagcccctggactcggcttgccccgggtccgtggctcaggcgccccgacgcgacccagctcggagcccggcggccgcctctgcggctgccagcccgtgcggcgtctccaatccgcgccaaggcgcccccacacgcccgctcctcacccctgcgtggagatgcccttgaccttgtggcctttggccagcccaccggctcccccgaccccagctcctaactcctggcgtccggggctcacctctctgccctccgtgcaaactcccggactcgcccccccaccggccgggcctgtcgcctgcctgtcccacactggcttccccagccggcgccccacatttgcgcggccccttcttgcacccagaatccccacctggttgtcgccagggttcccacatcctccggtcccctgtgcctgtcatagtccttccgcctcccgcttctggtccacttcgagcgccggctcctcgacgctcgcctgggtcaccaccctcccacccgcgcccgctctaagacgcgaatctgtctttccaagtctggcttgctccaggacctccccggctagcaccgctcctcctcccctgaccttcctcctcactcccactcccggctccagtcggactagtgcggggctttagcacatgcagttcctttggcttgaatgcccttccccagcttttccccgtggacttcacaactcggtcaagggtccctttttccaggtctttcctgatatcccggacaacgcgtgtcatcccctgggtgcccacggcactccatcctcccctcaggtgacttctcgtccagggttccctgggatgcactgtcgtggcccatggccgaggctgggcctggaacggagccgcgctggctagggagccgaaggggcccacacttggcgtaggaaggttccggtagccccctcccaatgcccggcgccgccacaccactgcccagagcgtccctctcgccccctcccccagccaggccggctcctacccgggagcacggcacacgttgcggccgcgagggttcagttcctgaggcgccacggtgtccggcagcatccagagcagcagcagcagcagcagcgacggcagcagcggtgacggcggccccccggctccccggcgccgcgccggcccggccccccggggccctgcgccctccatgaggcgcggggcaggcgcggggcgggcacgggcgcgggtgcggccgcagcgagagcggccggaagcggagtgcgaggccgggcggggggcggcaggaggggcgccgagccgggcaggaaattccacatcggctccctgatcccgggccagccgcggccggccaggcggcagcgcccgccccgcgctccagaccccaccctccggcctagccaccgcccctccgcgcagcccccgcccccatttggccgctcgcaaacttgggggcgaacttggaggaggcccgccgagcgctggtggagggagggtccgcccgaggaatccccggttcccgcgcctttccctccgctccctagacatctaccgaagcagccgcccctgcgcgcccactgcgtaggccaggcccgggacgggaaggcggatcggggacacggacgcgactccgcaagcccacccccgctcccagcgcctcggaaccggccaagggagtggggcccgcagacagcccaggtcgaggccgaaagccaactccacagcaccccaccgcgaagtccttgtagtgctggggtgtgcggtcagctccccctgcgcactcctgcgcactcagagctcgcaaggggcggaccgagcaggatgcttgaggcctgtggtagactcggtccggaccagaggcctgggggaaggggtctccgtagggacggatgggagagatacagaggaagtagaatggccaggctgtggactgcggtaggaagtagaggtaaagacagaaggagacccccgggatggaaaccctgcagtcctagttgaggagtgaagggggctgggggagcctgggcggtggattctgctggctgtcggatttccaggagaggctggggctagagagtgggaactcctgcatcaggtaaggtgggtaacagcacagagcagaaggaaggtgtgggaagggagcaagacagagggacaggccctagggagccagcggggaagctggacttggactgggaggcagcagggtgcgggtccccggggggcaactggggcagaccgactctggaagttgggcagggagcacaaatgtcccgtgtgtagccaggtcctagtgaggatgtttgtcttttggggacttgagagctggcagaaggcctaagcagggagcgggcacctccgttctttggggagcaggccacatgcggcccacaggctcactgagggagggcaggcagactctgtccaggtgtggccagatagccccgaagggtggggctggaggagggggcttggaggaggagccactgaaaggcccaaggccatgggcatcaccaggctggcacaggcagagagtgggatggggaggagcaggcccctcactcagccatgctggtgcaggagggaggtggggtgggctgaaagagaagtggaactagtgtggacacgaatgcaactacctggggacaaataaacaggccaaccacttctgggcagctcagcctgggcacagccctgacctcagcaatgccctcccagtgctggggcccctcccacggaggatccggattgcggctcccaatagaggccagcagaggtcccagtggctgcaaggtctgtcccagcccagctcctggctttagaggcactgaccccctgggctggaggggacactcacctcagctggatggaggtcatgaataggcatatcaaattccatcacctttctccttcccccagacctgtccagggagggcaccacctggatggtgccccccaatcccccaggacctcctaaatgtcttagatctctgcccacccctgtctgccacccagagtagtctttttaatctcacatgtggctatccaccactgctctcaggatgaggaccatccccagtctcacctcacgacccggtacatacatcccttgcagtagatggcaactttgggtgtcatgggcagagccctcatttctcccaaccaccactgcacccctaggggaagactgagaagtatgggaggaatgaaggatcatccacatggcactaggatgtagaaggaacccacagacaattgaccaccacgcaggcaaactgctggagcccggagccctggcctgctggttttggccaggatggctgccagaaggaagtggactttgaaggctgaggagggttttgcatgaaagcagggaccaagagcctagccacactggagagcacaagttgggctgcctcagctccggggtatcaggtgtaacccttagaaacccagcttagccccaaggctgacagtggcagggccaggctgcgcccaactccaaggcactctccacccctccccaggctgtgcaggacctcagtgagcccttcctgcccctgcagaccagaggcctcctgcaaacctgtggctgtggctggtggctcaggtgagatgttgccagccagcatgttgtcaggacgcactggagagtggtggggcatgtctggtgctcctcctttccagaaacctctgaggtctgcaggagctattgccctggcctgccaggtggtagcagagacacaggaagtgctgggtctgagacccacagagtggggttcctactctgaacccatgctcttgcgcctcaccctcaggagaaagggagatgacactggagtgtatagccatcccgccccactagggctcaacactgggtctgccaccccaaggcaatgtcatgtttcctcaggggtactcagggcccaggacagtgaggaaggtcttcaggttacacacacacccacataccacagccctgggggcacaggccaactctgagggctttgtctctaccctcaagaatccttggggtatccatttaggagagcccagagtgactgatagtcccccgtccccatcccctctcctcccatcaaggagcacacactgcccccttctcttccgggacaggatgccagcaggaacacatggctgtccccatgctctgcccagtcaactgggaaaggatggggccttggcaagttacagccctgtctgcgggatggctctgggcacaaggctcatagtaggagtctgcaggtgcagaccctatgagggcatcaggatggaagaaagcttcgtgtggtgcagccctgcagtgaggctggtgtgggctcacagcccatccatgcagggtgcaggctaagcctggcagtctcaagagggcaagaaaagcatggggacaggtgaacaggggagggtcccagctgctgtgccagtgtggtccttgagactgggtgcctaagggttacctggcaaacctgtagcacatgcagctcccctccccagcacactcagcttcaggaggttgggaggagccgggcacaggccagaggggccccccccaccgaccccctgatgctgccccgctcccaggtgctgaagctctggttccctgaccctcaggctgagagactcctaacgagctgggctgaaactctgcgtgctgccctggttgggagacaagttccacaccagagaagacactcaagtggctgcacaaccacctgtcaccagaccagggcgagttccagctttcccactgagtgccctgttagcttgtggagtttactgtgcttccctctcaggcagggtcttcccagtgccacttggcttctggcctgggcttccacagcctctcccagatggcagctctgaccccagaagccacgcttcctggggacgcagcttgggtgcactgtggaaaggaactgaggctgtggctacagaaaaacagttaacaccttctgtaagatgctttatttcattgaccaacaacatggggtctgaaaacccagcgggaggggtctttttatcacagagccagtcccaggcgagctgatgcatctctgctcctctgcccctcaggagctctcatcctccaaccccagctgcccccacagccccaccccattcacagaaagagggctaccacgtgcctcagcccccctgcccaggctgccagctcccaggtccttttggagaaggactgatctaggcagggaggagagaaggccaacccctccagggctcactgaggaaggccaaagcctttcagaagcagttcctgcagtgacgtaatccacagcctgggatctgcatggccctgagatgcctgcggcaggctggccaaggggctggtgtgaagaaagagggcagggcccataagctgtggccaacaggggcaggggccctgcctggagtaaagtgctctggcctaggctgcgtgggtttcactgccctgcagccccagcctcccttccctctgatgccaggcacagggagcctagtcctcactggagttgtcaaactcctcccagtcagacacactcatcacctcagaggcaaagtccgggtcggcctggctgcggtcaggggtcccgcggggcggctcaaggagcagggagcggggcagggtgagcacacaggccgccaggcctgagatggagttgtccagctggggcccttcctcccagcagtccttctccacatcgtaaatgtgcacgtagcctgtgcggctgccgcggttgtgtgagcggccacctaacacatagatcctgttgtccagcacagcaatgccaggctcaccgtgcccagcagggagtgggcagacagatgaccactgtccagacgtgcagctgtagcaggccacctgcaaagccaaggctagaataaagcccagcacccactgggacgaggctgccagctcccccacaagcccactgaccaaggtggcaacagttacccaccattctgacaggtcaggccccctggaaggatggcacagggccagtgttgaaacatcctgtccatgggccaggctgctgctttctcacccagggatggccgagtctgcaggaggctgtcttttgggccctcccctagaatgatcctattctctctggctttgctccagcccagcccttcctctaggccacccggccctaagccagtctctgcccccgagtgtgtggctgtgcccccatcagcatgtggtcattccccatgtctgagggcactgcttctctcccctccaggaaacgaagctgcctgagagacatggactccactgaaatgtcttcaacctccttctgcagcactcaacacaggcagtaggacagggggaggagacagaaagtggaagtaattccttgcggagtagtcaacatcaatattctcttgtcttcaaaattgtccaaacagtaaacaaagacatggaaaaatgttcaacctactagtaattcaagaaacgcaaaatcaaaacatcagagacaaatttttcaactagcaaccactgcagagaaggaaaatcacaaaacccaatgctgttgagggtgtggtaaagccatactactatgtatctgtctgacatgccagaaaaggaatttggcaataagtattaagagccataaaaatcttaccttcttgactgattagccgtttttggttctctagctatggtgggcagaatagtggcccccaaagatgtctagttcctaatctccagaatatgctaccttaagcagccaaaggggctttgcagataggatcaagggtacaagaatacaaaaaaaaaaaggattaagggtgcagaccctgagatggggcagttttcctggattttccaggtgatccatccaattgcatgagcccttaaaagtggaaggggagaggccgggcgtggtggctcacgcctgtaatcccagcactttgggaggccaaggcgggctgatcacaaggtcaagagatcaagaccatcctggccaacatggtgaaacctcgtctctactaaaaatacaaaaatcagctgggcatggtggcacatgcctgtaaccccagctactcgggaggctgaggcaggagaatcacttgaacccaggaggcaaagggtgcagtgagccaagagcaccactgcactccagcctggcgacagagcgagactctgtctcaaacaaacaaacaaaaaaagtggaaggggaggccgggggtggtggctcacgcctgtaatcctagcactttgggaggctgaggtgcgtggatcacctgaggtcaggagtttgagaccagcctggccgacatggcaaaaccccgtctctactaaaaatagaaaaattagctaggtgtggtggcgaacacctgtagtcctcctagctactccggaggctgaagcaggagaatcgcttaaacccaggaggcagaggttgcagtgagctgagactgcaccagtgccccccagcctgggtgacaaagcaagactccatctcataaaaaaaaaaaaaagaaaaaaaggaagggtaaagccagacaagagagctgagaagtgaggaggactcaacctgccattgctggctttgaagacgaagtgtccccaagccaggaaaagtggggacctctagaagccaagaaggccctcaactgacagctagcaaggaaatgggactgcaactgccagggactgaattcttctaaccagagtgagcagggaggcagatccccactagggtctccacaaaggaaagatgccctgaccgcaccctggttttagcctggcaaggcccatgtcagaggacttatgaatgcagaataaatttatcttaagttgctatgtttgtggtgataggttactgaagcaatagaaaactaatgtgctggcccagaggatctcacaagcagaggacctgttaaaagccagatcgccaagacccaccctcagggcttccgaatcagtgggtctgaggtgcctcgtaacacagcgttcccaggtgatgcagactctgttagtctgagaatcacactttgagaactgttgcatgaacctaaggaaataatccaaaatacctgaaaagctcaacaaagcaactattacttgtcatgttatttggaatagttaaaacttagacacaagaggggatgatgaagattgagtgttaatctggaaaatgcccaggacaaaagtcactgagagaagcagaatgggatatgggatgctcttttttgtttgtttgtttgtttgtttgagacaaggtctcgctctgttgcccaggctggagtgcagtggcaccatcacggttcactgcagcctcaacctcctgggctcagttgattctccctcagcctcccaagtagctgggaccacaggtgcaagccaccatgcctggctaatttttttttgtatttttagtagagatggagtttcaccatgttgcccaggctggtatcagttcctggactcaagccatccacctgccttggcttcccaaaatgcagggattacgggtgtgagccactgtgcccagctcagaatgggatgctctttgactacaatcaggcagaaaacatacacggtcaatgctgaaaatggtcatactgaaaaacagtactgcaggggcctgattatgaatgcttttcctcacccttctctattttttttttttttttgagatggagtcttgctctgttgcccaggctggagtgcagtcgtgtgatctcagctcactgcaacctctgcctcccgggttccagcgattctcctgcctcagtcttcccaagtaactgggattacaggcgcccatcaccgcacctggctaatttttgtatttttagtagagatggagtttcaccatcttggccaagctggtcttgaactcctgacctcgtgatccacctgcctcaacctcccaaagtgctgggattacaggcgtgagccaccgcgcccggccacccatctctattttttaaagttccggcaatgtggttatattaactttataataaaagttttgttctgttgttttgttttattttgttttgaatagagacagggtctcattctgtcacctaggctggggaacagcggtgtgatcatagctcagtgaagcctccaactctgggctgaaacaatcctcccacttcagcctcctgagtagctgggactacaggtatgtgctgccagcctggatctaaaagttttgttgttgtttttttttgttttttttgagacaaggcctggctctgtcgcccaggctggagtgcagtggcgtgatctcagcttactgaaacctctgcctcctgggctcaagccatcccccaacctcagcctcccaagtagctgagagtacaggcatgcaaccacacctggctaatttttgtatttttgtagagatggggttttgccatgatgcccaggctggtctcaagctcctgagctcaagtgatcctctcgccttggcttcccaaactgcttggattacaggcatgtgccaccacatccggcctaaaagtttttaagagtaataagcaaaggtagatgtgtatgtgtgtgatactgtcatggtgacatttgtccaaacctatagaatgtgccaagagtgaacactgtggactctggttgatggtgatgcatcaatgcagtttcaacaactgtgacacatccacccctctggagcgagaggtctgcagtggggaggctatatgtgtatggggggaaaagggggtgtatggaaactgtaccttccacttaattttgctgtgaacctaaaactgctctaaaaaatagtctatttttaaaaggcacatgattcaattacattttccatcaataacaactgagaggcttgggaatgatgacgggtgtggactgccccgggccccactcacctggtgcacgtccctcctgtatccggcatcgttgttgctgcccccgatcacatacagcttgttgaggagggttgccatgccgtgccaggcgcgccgcacaggcccatcagccagtgtgtgccaagtgttgctgcctggatcgtagcagtgtgtctctttcaggtaatcctcccctctgcggccgcaggtgatatacatcttcccctccagcgtcgcgcctgcgtgggcatacacctgtgtggagccaccaggagaaatggcgtgagagggcagtgaggaagggtggctgggtactctgtcaaggccaatcaccaccccacacctgcctgacaacgctgtgaggcttcaccacttcccactcacatacagacaagaatcctccctcgattctcatgggacatactgtcctagtcattgacctctaacctcttcccaatagcggatacatctatagactcagaaatgaaatgtagcctttgtctttcctttgctcctaaagttaacatctgcatgggggaactccaagaaaataaaagcattttttccaagccagtctggaagaagccacagaaccctggggaccgctgacccaccctcagtggcctccacccctcccccactcccactggacatgcaatcctccgggcctgctgaccctgcttttaaaatgtttgtaaataatatctgacactaaactcatgatgtggggagaaaaatacacatggttcttgattctggtcctgaaccttctgtgggctttttaccctccctctgttgggctatctccatagggcccagcctgcccccatcatgggcacctcttaccctggccctaccacttccggaacccacccactcacacccagcaggccaacagaaggccccaaggcaaggccctgggtgttttgagggtagaggagcccctcagggtgtggaggctccagagctatgttactgggcaagtcactaacactgaggccatgcgggtggcaaaaacacaagagtctagagaggtggacggagcagtggggaggaagaacacacaccaagggtttggtttgggtcttctcctatcaccagtaggggtctggggaggtttttctttttttttttttttttgagacggagtctcgctctgtcaccaggccggagtgcagtggcacgatctcggctcactgcaatctccgcctcccgggttcgaatgattctcctgcctcagcttcccgagtagctgggattataggcgcccgccaccatacccagctaacttttgtatttttaatagagacagggtttcaccatgttggccaggatggtctcgatctcctgacctcgtgacccacctgcctcggccttccaaagtgctaggattataggcatgagccaccacgcccagccgaggtttttctttttaattaaacttttcattttgagataagtgtagtcacgtgtagttggaagtaaaaatacagaggtctcacgtgccttctttcccccatggtaggagcctgtgtcactatatcacagggtcaccaggatgctgacgtggacacagccacagaactgtcctatcaccaccaggatcccgaggggctgccctttagggtgacatccactcacctcccttaccctaatcccttccttaagccctggaaaccaccaatctcttctctatttctacagttttgtaacttcaagagtgttgtctgaattaaatcagtatacaaccttttgacattggctttctaccccaacccaggttctaccaggttgttgcatgtacaggttgagtacctccaaaatctgagactttttgagcacaaacacggcactcaaaggaaatgcatttcagacttttggataagaaatgctgaaccagtaactataatgcaaagattccaaaatctgaaaaaatctgaaatccaaaacacttctggtccccagcatttcagataaagggtactcaacatgtaccaatagttggttccttttctattgctcagtagtattccatgggtatctaccacagcttgtttaaccattcactgttgaaaacacctgatttgtttccagtttctggctattaccaataaagctactattaacattcatgtacagataagttattttttatttttttgagacagggtcttggtctattgcccatgctggaatatagtggcacaatcttggctcactgcaacctctgcctcccgggttcaagcaattcttgtgcctcagcctccggagtagctgggattacaggcacgcatcaccatgcctggctaacgtatacagagtagttttcatttctctgggataaatacccaggatggtaactgccagatctgttttccagagtggctgtaccatttcacattcctatcagcaatccatgagcatagtttccctgcacagtcaccagtatttcgtattttcactactttttattttagtcatcctgaggtagttctctcactgtggctttaatttgcatttccctgatagctaataatgttacatatctccttatatgcttatttgccatctatacatcctcttcagtgaaatgtttcttcaactcttttgccttctgttttttgttttgttttgttttgttttgtttgtttttttttgagacagagtcttgccgtgtcgcccaggctggagtgcagtggcacaatctcagctcactgcaccctctgcctcctgggttcacaccattctcctgcctcagcctcccaagtagctgggactatagacgtccgccaccacatccagctaattttttgtatttttagtagagatggggtttcaccgtgttagccaggatggtctcaatctcctgacctcgtgatccacccaccttggcctcccaaagtgctgggattacaggtgtgagccaccgtgcccggcttcttttgccctctttttaatggggttatttgcagtattttgccaaggttttttgtttttgagatggagtctcactctgtcgcccaggctggagtgcaaaggcacggtctcggctcactgcaacctctgcctcccaggttcaagcaattctcctgcctcagcctcccaagtagctgggattacaggcgtgtgccaccgcgcccaactaatttttgtagttttagtagagatggggtttcaccatgttggccaggctggtctctggtctcgaactcctgacctcgtgatccgctcacttcagcctttcaaagtgctgggattacaggtgtgagccaccacacctggccgtttattgagttttaagagttgtttatatatgtatttatttaatactagtcctttgtcagataggtggtttgcaaatattttttaattttgatgaagtccagcttatcaatttttctttttatggctcatgcttttggggtcaagtctaagaattccttgcctagccctagctagatcctcaagattttcttctggtcatcacgtcgcgtggccgcagggagcagacccggacagctccagagcctccgggccggggcggcggcggcgacgcttcggctcctcctgagccacctgctggacccgcaccccactccatccccacaggctggggacaggccctggcgcggctgtgtgggatcagaagcagagttgcagaatccaaggacctatttttgttctttctccgcactgctttatgggaggcattatggcccccaaagacataatgacaaatactcatgctaaatcaatcctcagttcaatgaactccgttgggaagagcaataccttctgtgatgtgacattgagtagagcagaaagactttcctgcccatgagattgtgctggctgcctgtagtgattacttctgtgccatgttcactagtgacctttatagaaggggaaaccctatgttgacatccaaggtttgactgcctctaccatggaaattttattggactttgtgtacacggaaacagtacatgtgacatggagaatgtacaggaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgacacaagcagctgaggtttttagccagaagaattttcctgaagtggtacagcatgaagagttcattcttctgaggcaaggagaggtggaaaagctaatcaagtgcgatgaaattcaggtggatcctgaagaaccagtctttgaggctgtcatcagttgggtgaagcatgccaagaaagagcagaaagactccttgcccagcctgctacagtatatgcagatgcccctgctaaccctcaggtatatcacagatgtaatagatgctgagcctttcatccactatggtttacaatgcagggatctggttgatgaagcaaagaagtttcatctgaggcctgaacttcagagtcagatgcagggacccaggacaagggctcgcctaggagccaatgaagtgcttttggtggctgggggcttcggaagccagcagtctcccatcgatgcagtagagaaatatgaccccaagactcaggagtggagctttttgccaagcatcacttgtaagagatgttatgtggcctcagtgtccctacatgaccagatctacgtcattggtggctgtgatggtcgttccagccttagttcagtggaatgtctagactacacagcagatgaggatggggtctggtattctgtggcccctatgaatgtctgatgaggtcttgctggagccaccaccctgggagatttgatctatgtctctggaggctttgatggaagcaggcgtcacaccagtatggagcggtatgatccaaacattgaccagaggagcatgctgggagatatgcagacagcccgggaaggtgccggactcgtagtggccagtggagtgatccactgtctaggaggatatgacggcttgaatatcttaaattcagttgagaaatatgaccctcatacaggacactggactaatgttacaccaatggccaccaagcgttctggtgcaggagtagccctgctgaatgaccgtatttatgtggtggggagatttgatggtacagcccacctttcttccgttgaagcatacaacattcgcactgattcccggacaactgccaccagtatgaccactccacgatgctatgtaggggccacagtgcttcgggggagactctatgcaattgcaggatatgaaggtaagtccctgctaagtagcattgaatgttacaaccctatcatcaacagctgggaagtcgtgacatccatgggaacccagcgctgtgatgctggtgtgtgtgttctccacaagaagtgaccattgttggagcaccatccagagctagtgaccagtccagtggacagttagtgggagaatcaagaatcctttctagaatgtctgtttctcactatgtgcacagggtgattacaggcaccagtgcagtgatgattgtacttatttgacacatactccccctcgtcctggttgttgttcctgagaagggtgggtaacagatactccagggaaaagaatgcacattgaatggatgtgagagaccacattacctctcccactactttggggagcactttcctgtcatttctaacttaccacgtgcttggtgtactatatgtatgttgtgcctcatatgttgcaaagaactaaggtgagtatagcctactagatgtgagcaatatccagcctagatgattggaaagataccaatttaagtaaacttggtaaaatccaagtcttttttttttccaggaacaaatacattttctaatctacaggtagctaggggcaacacagttccattctaaagggaaacaaaagggagagccccacaaaactttgggggcaagggagagatactcatctgacacttcttttggaggtcagggtttgtatatcagaattgaagttagaatcagtgaattaaactgaatttgatggaatgtgagtgaacctagaacagcactgaagtattacataacctggaagactgagaagggtatattctttgaatgatctttttatttccccaaggtctttcacactggagacagcataaaagagtgaaccaatgttgggatgagagaagatgacataaatgtgggagttcagtataactggggataaactagaagtacctgtgattttacagtcatcttattgcctgccaggggtcatctagccatggcagtgttaaccttgaatgggggtgaaagcctttctttgttgaatcaaatactactacactattacacttccacactatttatttggggatggactgggagtgacagtagcctagtagttcagctacctgattactgccccattcttttagaagcacacttctgccaaggagtggtttgtactgctgtgattggtacatttagtcttttttctgctataagttttccttacctgtcctttagtgtagattttattcattacaggacagaataatcaaggacaaccaaaatccttttgttagtttcagtacctcagctatcaacatttctgagctatcattcaatgttcctctgtgtcatggagtgaaattcttgttttatgggtattgggagtgtgggaatgtgataacctaaacaacctttgctctgaaattccatttttccctctttccctgaagtgtactgacctgtactacagagttaatttcttttgtatttttttaagaaaatattaaaaatcaatggtctcaaaaaaaaaagattttcttcttctttttttctagaagttttatggttttacatttaactccataaaccattttgaattcattttggtatatggtatgagacttgggttgatatccatttttttgccgacgcatgtctaattgctccagtactatttgctgaaagatatctttcctccactcaattgtttctgcacctttgtccaaaatcatgtgtaacatgactgggcatatttactcaggtctgtgggttttccattctgtttcactgatctatgtgtctatcactgtatccataccacagccttgattactgtagctatgtagtaatcttgaaattgggcagactcctcccatcttatcgttctttttcaaaattatttgagctattctagttcctttgcctttatatatacatttcagaataatctcatttacatctaatgtcacaagtaaaatcaaatcaaaattaaaaaatttattttatttattttgaaatttattttattattattttttgagacagtctcactctgtcgcccaggctggagtgcagtggcgcaatctcggctcattgcaacctctgcctcctgggttcaatccattcttgtgcctcagcctccccagtagctgggattacaggtgtgtgccaccacacccagctaatatttgtatttttagtagagatggggtttcaccatgttggccaggctggtcttgaactcctgacctcaagcgatacaccatcctcggcctcccaaagtgctgggattacagacgtgagccactgcgaccagcaataaaaaaaaattttaggctggatgtgatggctcacttctctaatccctgcactttggccgaggcagacagatcccttgagaccaggggttcaagaacagcctgggcaatatggtgaaaccttcatgatactaaaaatataaatattagctgggcatggtggtgctcacctgtaatcccagctacttgggaggctgaggcaggaggatcacttgaaccagggaggcagaggttgcagtgagccggggtcatgccactgcactccagcctgggtgacagagcgagactctgtctcaaaaaaaataaaaataaaaaaatttttaaaaagcttattgtgcatgtaaaagaagagttcatgaaccaggaaaccccaaactggaagtggtatgaagccccaattcacagcagttacaacacagtttataaagcatgaatgaggaagaatattgttccctactgtgcatgtggagctgcataagctttctttgtaaagctatcacactgagggaggaaagcttaagtttcagttacatggctacaggcagttggcctaggggtatatccaaacctcagcttcaattttcattttcccttaatagtacaaaaaaccttcctgaaattttgataggaatactagtattcctgtattaatactatatcaatatgaggaattctgtattaatatatgtattattaattgggttgggaaagaactgacattcttactattcttactcttccaatccatggacttggtatgtctctccatctattcacatcttcttttatttctttcatcggctttttgtaatattcagtgtaccaatcctgtgaggttttttgtttgtttgttttgagacggagtcttggcagagtcttgctctgttgcccaggctggaatgcagtggtgtgatctcagctcactacaacctctgcctcccgggttcacgccattctcctgcctcagcctcctgagtagctgggactataggcgcctgccaccatgctcagctaatttttgtatttttagtagagatggggttttaccatgttggccaggctggtcttgaactcctgacctcaggtgatcccccccgcctgggcctcccaaagtgctgggattacagacgtgagccaccgcgccctgccaacatgacctatcctttttcattccccaacatctgatccatcagcaagcctgatcagtttacctccacgctacactctgaaccctcccatctccctccagctccacagctgtgtgccagcacaggctactgctgtcttcagcccagaccacgcaatgacccagggccagcctcgcttgctctgctcttgatccttgggcttccttcttctacaagcatgccccatgcttcctctcctgctcaggaaaagctgtgagcccctctcctgccctggaaggtccttctgctagactaggcagatggttagatatgagcagggaagtggactccaggttggcctcagcccctagcatggccagagggactatgacctctgagacatgttaaccacacctggggtttcaaaagtcccaacccctctttcagttaagcttatccagctcaagtaggaactaaccccacaaggaactttccacccccgggagcctgtgttgtatagtttgccccagttttgcttgcttcgaaagtaaccttttgttcactgcagtggtaaaaaacacacctcctgggtgaagatttaagatgctaatgagacatgcgataaatacactagcacgtagagccacagtgcatgcgctgctagaagaccacccaaacaaaacatgcttatgagtaacacctcttcccgcccatttatgaataatcatgtaagcctcctgtaagggaggtttcccatgccagttggggcgatcttattctggagcagcctgctctgactcggccttcagaatgtaccttcacttttgcaataaactgccttacacttatcttcgttaatgcatgtctcttgcttaaagtcttaaccaagaagacaagaaccgaggacacattcccagtaacatttcctccctctgtaaatggcaggtctaattgacatctcctcagatggacattccccaaaaagtccctctagattcatcctaccagagccccctccctggaaatcctccagttcagccccctcttcatttcacttaccataattgtaaccactttactgatctgttttctggttaagagtggtttctcctacaaggctgtaaacaccatggagtggggagtctttctcatttcttgtcaccactggattcccaggacttggtacatggtgcttagtagttgcggaatgaatgcgtgcatgaaggaacaccggcagccacgatgcagctggttgaaagccaaggctgcccctctgtggccaagctggagaactgctgcttccccagctgccgcagacaaagaaactgctaagcccctcccacaacacccacctaggaggcttcccccaacacccttcctggaacagaacccaagagccctccttgtccacttggtctcaaggacctcctgatcttctccatgcaaaatctgctcctttccccaggatgggggtacggagtgtccttccaaagaggcttccttctccccaaagaagctgagagcaaggagcaggccacagcttgcagctcacagctgcccaagagacagaaatctgtgtgggctgtgtgaatgacctggataaagaagagctggatccattgaggagacactagccctgacccctgaagtcaaagtctaagtccctgggggaattgggggtcatgagagatactggaaagaggcttacaaaggccagagctcttgctaaactccctgaggcagtgcaggtagaacctgccccccataccatcctctgcctctcaggtgctcggttatccccaaaggtgtacctggcccatagcaggtgctccacaaatgctatgccagtactagcggggtgccctgctagggtacccctagtactgctagggtatgccctgttctcggaggctgagacccaggaagtagggggccagcaaggcctgttccttccctgggatcccatgtctggttgttacaccaggcctgagtaccccaaagtcgtaagataaaagagaggcacctccctaaaacatcatttttccataatgaacataattttaaacatcttcaaattggaataaaccaaggtattatataggatgcacgtgatttttttttcaagttgtcccaatattcaaacataggatttaatataaaaaataaaaccttagagtgtttcttggctctggaaggcgccacccttcaggggacctagagggaagaggtctgaggataggccagtgagctctcagggtcccttcctgtttaacatctctggaagtgtcccagctcgtctcagctgcacaaagagcaaatgttctatccacatttgaactacaaggtttaagcagcttgccagggccaaggtggtgtgacaaggtctcagcatgtaagactcacaagtggggcacaattctgagcaatggggtctggatccttgatgagcctccccaggtggactggctgaacctcatggggcctcatcaatgcattcaatgcagggtctctggagaagcatggattctgctcactgagcctgtttctctgacctgggacaggccttgacacctaggcctctcactctttgcacatcctggggaaggaaattaggcaggagaaggcccctcttcgagggcttccttacctccctcttgagtggggccacgtatgcccaggagttggtggcagggtcgtagcgctccacagcattcaggtcattgtggtagtcacggcccgccacagcgtagatgtacctgcctacaacacacacggacaggtcggcgtgctcctgctgcagggactggatctggaaccagcggttgtgccgtgggtcatacctgtgccgagacatgaggaaagcacagcactgactaggcagggaggctgctccgcaggcttgcacctcttgttctggtcccatttctgctttgcctcagcccagcctgaaccctccccaactaccccacataccagtgcacaccgatctacagccaggcccacaggctgttacacacctgagcacaggtgctccccaccacacagcatggaaggaatggccaggagcctcctgtgtttccacctaactgtccacctgggctgtccaatggctctttttttttttttttttttttttttgtggagagaggtctctctgtcccctaggctgaagtgcagtggcacaatcatggctcactgtagcctcgacctcctgggcttaagtgatcctaccacctcagtctcctaagtagctgggactacaggtgcgcaccacaacgcccgctatttttttttttttttttttttttgatagagacaaggtcttgacacctgggatatggacttaggcaatcctcctgcctcagcctcaatggctgttcgtacagccacttccatctcacttacctcatctcatcatccacatagccttgctcccactcaggagggcctccaaatacagcctctccactggatgggtgccatcagccccctcattggcctccaagccttgaacttcccccagcactccatcaggagtggtcttctcaggcacgccctgcacacagcacccatcataccctcagctttgtcaacagccgcacacacaaggctctggtcatcgtactttcacctcctcccaccatgctgccagccccgcgtttcctgacctcccctccactcaaggtctccctctctgggaaagtggaaagggttaactcccaccctggactgcaggctctgtaagggcagggtgtgtgagattccagggacccccatgggagaaaaggcactagactggttgcggcaggcccacgagggtggaggagtctggccaggacccaaggagggctcctgggctgagcaccaacagggagcatggcctgcaatgtggagcagagatgatcacagagccatgaggggccaggacccagtgagctcaaagccagtatctgaagtgtccttgcccaacagcccacagatagttacagcctctttcagacaagtgtttttatttctgcagaggaagacctattccaaagagaacaagtctaacttcaactggctcacaagagagtaaccaaagttttctttggcctgtgccctatgctggttagtgaaaagatcagtttcatcctttgcttcctgcagcccctgcagtgtggccagcccctccccgccgcctaccaggaatgcagcaaacaggagcctcagaaggcagggccaacaagagagggaacacacacctgggtctccctgacctggtgtgaatcctgggctcttccctgtctagctgggtgtgcctgggcatcagttttaatctcttgggattcgctcagttctgcacctgtccaatgaggtgatatcacctgcctagaaaagctatcaagaagaatcataaaagacgagcatgaaaagtgtccttgttaacttgggggttctgatggatcatggttcatttctatattcctagacctcagtgtagcctctggctcaggacagattatgttctgtctgctgaatgaattaaacaaaggagtaagattaccagcaatgaatcattcattcactctaccaacattcccaggtctcccactgtggatggggcacagtgctcagcactacatccagagggagcctcaagaggtcagggccctgccttcccctgcagaatggaaacaggctaaccagagcaaatgagtgcttaatataatgacagacactgtgaaagaaagaaagggaggtaagaagatgagtgacctgctggtcagcggggcctggggagggcagagctcccttgcagtgatcaggaaaggcctcctgagaaggcagggtctgagacctgcatgacctggggcacaagccagaagaaggtctggcaggggaccagcagtccaggattggggcacagcactcacaggggccccgtcaactggctgggatggtgctgttcactgcctttcctgtgcgccttcctcctttatatacaagtctctcctctcttgtgttcagtctggctcaatcaccatctgcaccccaagtgtctgcaaccagagtgagataggaccctccatgtgctcctgtttgctccttcgagtctattgtcctcacagctttttaagctgagttcatgtggatttgtggcttcaaatttaaagacacacacagggccgggcgtggtggctcacgcctgtaatcccagaactttgggaggctgaggcgggtggatcacgaggtcaggagttcaagaccagactgtccaatatggtgaaaccccgtctccactaaaaatataaaaaaattagccaggcatggtggtgtgtggctgtagttccagctactcgggaggctgaggcaggagaatcacttgaacccgggaggcagaagttgcagtgagctgagatcatgccattgcactccagcctgggcgacagagtgaaactccatcccccaaaaaaaaaaaaaaaaaaaaaaaaaaaaaaaaaaaaagacaccaacagtgataccatatgtcaataatttagacatagccaaagttacactgatttcttatttccctgttgtgtcctgtatccctcttcttctttattgaattaattttctactttatgagaataagtcctcaagtaatatttttctaataaaaataagctttatttttgcatataaagatataaacaattttacttattgctatggactagatgtttggattcccccaaaacccctatgttgaaggcctaacccccattgtgatggtagtgggaggcatggcctttgggaggtgatcaggtcatgagggtggagccccatgatgggcttagtgcccgaggctacagctctttctctccaccatgtgagaacacagacggaaaggaccttaccgggactaaactggccaataccatgatcttggacttcccagtatccagacagtgagaaatagaggtatgttgtttaagtcactccatctatagtatttgttatagcagctgaaactgactaggagagtcactttaactcagatttgtatcatcctattgtaaactcagacatgaaccctagagttggtacaaaaatattctggaattcttgttaaattcattagactgtggccaggcacggtggctcacgcctgtaatcccagcactttgggaggctaaggcgggaggatcatgaggtcaggagatcaagaccatcctggctaacacggtgaaaccccgtctctactaaaaatacaaaaaattagccaggcgtggtggtgggcgcttgtagtcccacctactcgggaggctgaggcaggagaatggtgtgaacccaggaggtggagcttgcagtgagctgagatcacgccactgcactccagcctgggtgacagagagactccaactcaaaaaaaaaaaaaaaaaaaaaaaaattcagtagactgtttttcttctatatttccatgacttaagtattttcatgactattaatgttttaatgtctattaaattttttaaataaattaaatgtactgaccgggcacggtgggtggctcatgcctgtaatcccagcactttgggaggctgaggcaggcggatcacctgaagtcaggagttcaagaccaacttggtcaacatggtgaaactccatctctactaaaaatacaaaaaaatggccgggcgtggtggctcacacctgtaatcccagcactttgggaggcccaggtgggcagatcacctgaggtcaggagttcaagaccagcttggccaacatggtgaaaccctatctctactaaaaatacaaaattagccaggcatggtggcgtacaccggtaatctcagccactcgggaggctgaggcaggagaattgcttgaacctcagaggcggaggttgtggtgagccaagattgcaccattgcactccagcctgggcagaaaacagcgagactccatctcaaaacaaaaaaacaaaaaaacaaaaaaattagctgggcgtggtggtcggcgcctgtaatcccagctattcaggaggctgaggcaggagaatggcttgaacccgggaggcagaggttgcagtgagccgagatcgtgccactgcactccagcctgggcgacagaacgagactctgtctcaaaaaaaaaaaaaaaaaaattaaatttactttaaaatattagcagccatgaaatgccgaaggaaaaattacattattatttaaaaaattttttttagagacagggtctcactctgttgcccaggctacagtacaggggcatgatcatagttcaccgaagtctaaaactcctggactcaagcgatcctcctgcctcagccttccaagtagccagggctgcaagcacgtaccatcaggcccagctaattttttttttttttttttggtagagacgaggtctcgctttgttgcccaggctgatcttgaactcctgggctcaaaagatcctgctgcctcagcatcccaaagtgctgggattattgacatgatctgcacatagcctaaattattattttaagtagggtcagggcacatagcaacatgtaaccagctactactaggtataccatgtagttggtgttcagtaatccacagggctatggctatgggaaaggtacaaggaatgatgcagataatatagatgcaaagaaagaaggaatgaaagagaaaaagtagtatattggagacaaacaccatttgctccaagagaggaaaggtttttaaatatgcggtttctgcaccaatgctttaagatataacctggtaagtaataactcctcaaaatgcaaagcctaatttactgcaaaatcttgtttccttatattctaaaagcctatagcttttagaattcaccagttctaaggctgatgaaatgagaaagcagagaaagaaccaaatcttagaatattcaaattaaggattcatctggaagttttgagtccactggaaggttaatgatgccttcattctggagagatgatacatccctgggttaaccagtagggctgtggtccttcctgccacctccactctgtggatacctactctctcaaggcaggtcttgccgaccccacttgccattgtgatcctactctcagacaggagtttgggactggttattggttacagggtctaatattagcattacccagagttcagctttggtctcacaccccttcacaaggggaaattcagactcctactttaagtgaaagtgagatcaatggcccatagcaggtggacagaggacaggggcaggcagaatcccaagctgtcacccccctagggacagctctgtggaaacatccagcattactgccaagcacacagctgtctctaccttctgctaagggccagaagccaaaacactctggagagattggctttgcaggtctgtaggttactctcagcagggtggtctggccttggccccccaactgggaaaccgagccccctaaaaaagaaggtttaaggtttggccaaagggaagtctaaacctagtgtggccacacccactgggggcacaactttgtttagagaggaaatgaaggtagctgtttccttttttctgaaacctgcccttcctcatatttaaccacaatgtgttattgccaacctctgagtctcatcagcttaacaaaggagatcacttcctggggccagcagtagagaggtcgctgagaaatggccttctcctccttggccaggatcactatgcttgattccaagtggcatggccaggccaggccctaccccaccctgaccccagaaaatagaaacatgaacatgaactcagtcagcatctagctcatggctgctggaaatagttggcaatctctctctctccaacacagctccatctttcagcatgaagggtagggagatttctcacatgcaccaaggtaaggtggaggggtccctggaaatctaatggtagctgagtcttgtgggcctgaaccactgtcccttgctctgcccagaaatggatttgtgagatcacagcctaagtgactgatggagccaggcgcatcctacggaccacagcagtccacaaaactctctcttgggaaaactgcctcttcccaggggaaattgtgccaagtgcgtggcagactgcagggcagagcggaaatgtagcatgaggctcggtgatgcttgttggcctttaccacgcccctgggctgaagaccgcatgctgctcaggcacagcagcaggaagcctgttccaccattagcaagcaggtaagagagaagagcaaagctgactggtgaagggaaactgaaacaacatgcatcaaagctcagagagagcatgatggagggcgaggctgctcagctggcactgctcctaggtcctctccatcccagtccgactgcctttcctgctgtgggctcctctcccctcccgtctcctcctgcacaatgcactcgcaacctagcctaccccaaagaggctgagcaagggtccagggtaagtgggtttctgaggagtaggggacatgcaggaaagaaggcgatccacatgtccccttctcttatctcactgctgtccaccttctctgaattcacctagacttcattccacaatggcaagtgatgctcatgtgaaaggctggggggaacctgaccagctctctcagcccatgacttccacaccctctcatcacctgaagacaaagggaccagctagcaccctgtcctacctccagcatcgggactctgctcgaaatccttggacattgttgtcccctccaatcaagtatacgaagttgttgagcaccgcgatgccctggttggacatgcggggggccagggaggcagtgaagtgcttccactctcccagtaaggggtttagatacttggcctggtcgctgaggacagtggacggcgtggagtgaatgcccccgaagcccacaacgcactggaagtccgaccgcagctccgtttgcgggctctgcaggctgggctgtaggctctcgttccggtggtacatgagggcgctggccactgtgtccctcaaagggctggggtccagcttgtcatgcagccgctgcaggacctcagcttccatcagcggaaaccgcactgtctcaaggagctttgggggctcgtgcagcgagatctggtcagcctgcacctgctccaggctataatggtagagaagggccccctcatatacctcggtctcgcaggagacctccaggcgattgctgctgaggagggagtagaccttctccaatggaagctggcggtacttgtcagtccgagagaaggccacaaagtttttgaggatataggtgtccagttgctcagtcaggcggctcaagtcaaacagctctgccagccggtagacatcgagaatgttctcttcgtccacccaggacatgaggaaatcacagcagaaatggataatttctgggatctgcagagagaatgacacccattcaagcctgggctggtgaacagcatctgggggtgggagagagaatgatggcagaaatacgggctgttgtgggccaggcaaagcagaagggaagtcctccttaattgtccccgaccttttctgacacactggagactggggcttactgcagactaggtttaagtcctggtttggaaacatactgggtgacaggatatacagcatgtttttttttggttttgttttgcttttctttgagacaaagtttcgctcttgttgcccagaatggagtgcagtggcagaatctcggctcactaacacctccccctcccgggttgaaatgattctcctgcctcagcctcccgtacagaatgtttttaacctctctaagcctcagtctcctcatctataaaacggggatcattaaagtgaagaggaacatgatgaaaatgagagagcacataggagtggacccttgatatatgtcagttccctcttagatcaaaagtactggctcggccgggtgcggtggctcatgcctataatcccagcactttgggaggacaaggtgggtgtatcacgaggtcaggagtttgagaccagcctgaccaacatggtgaaacaccgtctctactagaaatacaaaaattagctgggcgtggtggcgcgcgcctgtaatcccagctactcaggaggctgaggcaggagaatcgctggaacccaggaggcggaggttgcagtgagccgagatcgcgccattgcactccaacctgggtgacagagcgagactccgtctaaaaaaaaaaaaaaaaaaaaaaaaagaagtactggctctccagaaaagcaggaagcagcacaaatggtcactgtgtcatatatctgtggtttggaaaggacctaagaccatccccatccctaccctaggattctctggaagagcctgcctctccaaaagcgctgggaccagaaacaaacctggctttttcccccgccagaacatccaccctggttccctagaagtgctcagagcctctcagacacctaaccaatacccacccaggaacctgatttagaattatttttcttttttctttttaaaatttgagacagggtcttgctctgttgcccaggctgcagtgccatggcaagatcatagctcaccgaagtctcaagcttctgggctcaagtgatccctgactcagggttcttgaggttcccagctgggtcaagacccacttgactccagtaagtgcaggggctcccaggtggccatatcaacccttcccagccatggggaagcactagtggtttgaaaggacggcaagagagagaatgacactggagggaggtgggaacaaggccacaaccagcaggctgttaaaggccaccctgtgaacagacaaccaaatcttgggagaataggagacaaagggaagggccctagggaaaactgcctgggagaacaaaccaggtgttgataaattatttaggaaagcaggattttagagtttcagtggggccccccagtgcccacctcctttctttccatgttcagattgaaaatgacgagtaccttgacctctctgtgacccagacagctgcaggttctcccagcaggcttgaacccaaaccaggcccttgaacattcccaggcactgataaaggcatcaaggttgttacccaaaacactgaaggaaaaactggttctggccctgagacaaattccttaaaccctcatagaaactccatacactaacccactctgtgggcaagcctgggtaaagcctctcttttcccttgtctgtcttgaggacatgctacatcactctatacataagttcccctaataaacgctctggccagatcaccctggtgtttgatgcttctttctttggaatcccaaaacggctccatttcaggatgctgtggggtcccctcttgtgggaacccccttgctaccaactccagccatgtgttcaatgcaataaatcagtttctctaaaaatgggaatacctggcttatccaggatcatcaataaattaaccattacacatggaataattctgctggtatttatgtatttatttatttattattttgagatggggtctcactctgttgcccaggctggagtgcagtggcacgatctcggctcactgcaagctccgcctcccgggttcacgccattctcccacctcagcctcccaagtagctgggacaacagacgcccgccaccacgcccggctaattttttgtatttttagtagagacggggtttcatcgtgttagccaggatggtctcgatctcctgacctcgtgatctgcccgcctaggcctcccaaagtgctgggattacaggcgtgagccacggcgcccggccaaggtatttaaagcttatcaataaacactaactataacttttttaaaattcaaaagacatctaatattgcttgcaaggtgacatgctaagagctggatgagacctaccaaatgtcaggcaggtatgtgccctacatgaggtatccccatggtgctttgctaggccctgaccagcttcacttgaccttcttttttccctttttgccagtcttctgctttgccacttcttcccaaactactaggttttcctaaaattctggtttgtcatgggccagggtcctgaagaccaagttttgggcagaatgtgagcacaaacagccctgaagaagcctgggcagcagcagctccttgagaggaccctgctgactctcctttcagtcctatttttagagcagtgggccttctgttcagtgaaatctcacagaggaaccagcctgggctcaggatgtgcaaaagccccatacgaggctcacagaagggactgcatttgcttggggtaacccaataggacagtgttactgggaatcagactcaggcctctggggacaccgtgaagaatctggtcccaggcctactgcagggcacaacacatgggggaagcctccaaaagtcactagctatgtgaacatacatgattctacaggcctatggacttgacatggttatgccaagtaaaacctgctataaaacaatattgtgaagaagcctgtttttttttgtttgtttgttttttgttttgagataagctggcatgtagtggtgtggtgatcacagcttactgaagcctccacctcctgggctcaagtgattctcccacctcagcctcccgagtagctggaactacaggtgcatgccaccatgcccggctatttttaaagtgcttctgtagaggtctcgctttgttgcccaggctgatctcaaactcctggcctcaagcaatcctctcaccttggcctccaaaagtgctgggattacaggcatgaacctccaagcctggcccagaagcctgatatgttaaaaaactaagataggctgctgcctctgagatgacctctgaggcactgggggagatgacccagggctgtcgggagcactggccaaaccaacagagagagactgcaggcctccaagctgactggtgagagagggaaagtgatgttagaaagatgatctggtttcagtgtgtgtgatcactgcagggagaagaaagaaatggcagaaacatacagatggaggccaggcaaaagggaaggaaatggaaacacagaacagagatggctacaagcaataccgagaaggatgacctgtcctcacatggacgcagggaattaagaaggtggacgggctcaaggagccactgaggttgagcccagggaactggcaggatggtcacaggacacacagagcagggggactgacaggggagctccgggagagtggcaggtgtggaggaggagataggacagctggacctgagccatgctgggggagatgtttcagaggcagctgaatcaggagttaactgctgccagggtggagaattggatgagggttcccaaagcaacaatgacagggatgtggggacagaagagatctctaaataaaagaacagggggaaattcttttgttgtaaaagccaactccatctactcaccatgcaggtatggtgagacaagtcagtcatctcagatcaacccacccagcatccaggtcctatccaccaatctgagaacagggcacagggaggctgccagggccctgtcacatggggtggcacctccacatgcccccgaacaggttggttttcctgtgacttgagttgtttttttttaattgcgtcaaacctgctctcatgggaagaaaggtcagaatgatgaacttagcatagcattttgtttcacttttaagaaatgtgggaagaggtgactgtcaactcctatcaggcctctgcctgatagctcaaaggcacctgcaggcccagtcccgtgtaactgcacccacaccactgagaataatcatccaaaacataagtcacactgtcaaagcctcagaaaactttttgaattctgcaggaaaacaagtacttaaagttcaataacaggttgggtacagaggctcacacctgtaatcccagaactttgggaagccaaggtgggagtatcacctgaggccaggagcttgagaccagcctgggcaacataacaaggccccattcctataaaaaaatatatatatatataatatcagctaggcacaatggcacgcatctttagtcccagctactcagaaggctgaggcgggaggaccacttgagcctaggaggtggaggctacagtgaactatgatcatgccattgcattacagcctgggtaacagagtgagaccctgtctttaaaaaaaaaaaaaaaataggccaggcgcagtggctcacacctgtaatcgcaacactttggaaggctgaggtggatcacttgaggccaggggttcaagactagcctaagcaacaaagcaagcctctatctctataaaaataatttaaaaattagccaggtgtagtggcacatgcctataggtcctagctatttgggaggctgaggcagaaggattgctggagcccaggaggttgaggctgcagtgagctgtgatcgtgccactgcactccagcctgggcaagagagagagagcttgtctccaataaattgaatgagtggatggatggatgggtggatggatggatggatggatggatggatggatgcatgcatggatggatggatggatggatggatgcctgccaccatggatggatgcatgcatggatggatggatagatggatggatggatggatggatggatggatggatggatggatgcatgcatgcatggatggatggatggatgcgtgcatgcatggatggatggatggatggacagacaaatagatagataaagttcagtaacaaaacacataagttttcaagagactgaagtggcccagtgaggggacaggcaggaagggccctggcagcaatgctggtggatgctccccattgccagaccccagagcacacaggacgtccacatgcagcctcgggtcagcctacctgcttatgtgcaggatgctttcaatgacagggagactcagacagtggggaaacaaccagcaatagagaagagggcaaaggcagaggcctggggtgtctagagcggctctgcttgagctccaggaacaactccagagtcttccccacttcatggccttcgtcactgcttggtctcctcacattcctgacccatcttcaagccaatgctagtgcccggcaggcatcatgggcatctcagggaaccccacctgggtgtgggtctgccttgctagatgagacatgcctcacctgaagctggcaggcagccaccagtgtctcttgtacattgctcaggctgagctccagctcggaggtgtatatgaaatgtaggatttggcacatagcattgtaggacacaccgtggatcaggacctcttcctgttccatctccttcaatcccccagcaaacattcctctgcaaagtgaagacacaagaaaatggagttataccaacagggacttaagcccatgttgccaagagtgacagcattcagagaagaacctggcgctggtggcagggccctggtagtgggctgacccactctgtgctctgagtgaactgtgtgcatgcatgagccatcccacaaaaggatcctgacgaagtctgggcagccatcctggaaattgtcctgtttcccttttcatgggcccaaggagtcccatgtgagcttcgggaggtgaggccacaagcagcttgcttctgctgtgttcatcagtgcagttcctggatcggagcagtagcaactccagagcacatttcaaagcaatgaattaattaatgggaaactaataaaagtcatttcattcaatgtatatttatggagttcctaccaaatgccaagtatcattcaaagagcagaaggaggccaggcacggtgactcacacctgtaatcccagcactttgggaggccaaggcaggcaaatcacttcaggtcaggaattcgagaccagcctggcccacatggtgaaaccgcgtctctactaaaaatacaaatattagccgggcatgatgttgtgcatctgtagtcccagctactttggtggctgcggcacaagaattgattgaacctgggagacggagggtgccatgagccaagattgcaccactgcactccagcctgggcaacaaagcaagactgtctcaaaaagcaaaacaaaacaaaaaacaaagagcaaaaggagttatagtgaagtaaactggtaaaatagctgggcgcggtggctcacgcctctaatcccaaccctctgggaggccaaggcaggcagatcccttgagcctaggagttcaagaccagcctaggcaacacggtgaaatcctgtctctacaaaaattacaaaaattggccgggcgtggtggctcacgcctataatctcagcactttgggagggcaaggcgggcagatcacctgaggtcaggagttcaagaccagcctggccaacatggtgaaaccccgtctctactaaaaatacaaaaattagctgggtgtggtggcgggcgcctatcatcccagctactcaggaggctgaggcaggagaatcgcttgaacccgggaggcggaggttgcagtgagccgagatcacaccactgcgatccagcctgggtgacacagcaagactctgtctcaaaaaacatatatacatatataaataaatgctaagaaggaacccagcagggcatctgacctgagagtcactggttagaagaggggtaggtggaatgatgagaaggagcagggaaagccccatctgaggaactgagacctaaggataaggctgagagggtgtaggcagccggggagggagttccaggtgaaggagacaggtgtacaagttctggggcaaggcagagcttggcatgcaaggcagccaagatgatgacgaagtgagcagaaagtgggatgggcaggcaggccttggagccaggtccccctacctctagggtaggtacagtccagattgaaatctgagcattatgggatgctcttgaggaatttacccacagagtgatgtgaactgactggctttccgactcaggtgctggaggaggagcccctggaagaccaattaggcctgagattcctgtgggcctggaggccaagggtgaccctggccctggggagggcattgcagctagaaagcagtagctgagactaccctgggacacggcacagagaacctactgacagactgaatctaggaggacctgggaggactcaaggccctctgctgggccgaagaggaccctttactgatggaagaaaatctggacagctgggagtcccgtgattgtgtgatcagtgtgagatacctgtgaaacctccaagtgtagacactgattaggtgtttggaggtaagaggctggcaactggggctgaagtttaaatatgacagcaacatgaagattataagagaagctatttttacattttatttatttttttgactaggtaatacatatacatgctaccagatttaaaatacagtataggttaggccgggcacagtggctcacgcctgtaatcccaggactttgggaggccgaggcaggccgatcatctgaggttgggagttcgacaccagcctgaccaacatggagaaaccccatctctaccaaaaatacaaaattagctggtcatggtggcacatgcctgtaatcccagctactcaggaggctgaggcaggagaattgcttgaacccaagaggcggaggttgcagtgggccaagatcgtgccattgcactccagcctgggcaacaagagtgaaactctgtcacacacacaaaaaaaatacagtataggttgtggtgaaagtccccttgcctctgctcccagaccatcagtcagttcccctcccagggccacactatcctcagggcagtcatattccacatctcacttggcttttttcttttttttgagacgaagtctcactctgttgcctgggctggagtgcagtggtgcgatcttggctcagtgcaacctccgcctcctgagttcaactgattctcctgccttggcctcccaagtagctgggactacaggtgccccccaccacgcccagctaattttttgtatttttagtagagaccgggtttcaccgtgttagccagaatggtcttgatctcctgacctcgtgatctgcctgcctcggcctcccaaagggctgggattacaggcgtgagccactgcacccagcccggtttttacttaacaatatagcttggagactgatccatgcccatgtacgcaagactgcctcactctttgcaaaggctgtctcactttttttattttattttatttttttaagatggagtttcgctcttgtcgcccaggctggagagcaatggtgcaatctcggctcactgcaacctccgcctcccgggttcaagcaattctccaaactcagcctcccgggtagctgggattacagtcctgcgccaccatgcccggctaatttttgtatttttagtagagatggggtttcaccacgttggccaggctggtctcaaactcctgacctcaggtgatccacccgcctcagcctcccacagtgctgggattacaggcatgagccaccgcgcccagccagctgtctcacttctttaacccatttctacaggggtatatttaggttacttgtaatttccagttatttcacatgatgaacatcctcacccttacaacatgctgagtatgcatatgccaggattaagtcccacaaatacagttgctgggtcgaagggtttacatacatttatactttgatagtattgtcaagttgctgtttttatatcattcctgatagcagggcctggtgcctgcaccctctacccccaacccaggaagacaccagctctaactcaccaccacaaaagggaaaaaccttatcacataaggtacagaaaatctccttatatgttaaagagccatttccattttcttttctgaacagttcagattcttagtcagttttctgttagactgtcttatcaatttgaagaaatctgccctttctttgatgaggagtttccccgatcttttgattttgtattgcttttttgccatgcagaaatttgtcttttttttttttttttttaaacaagtctagtcaactgcagtagtgagaaggtgaaaaagtagaacctggagttggatctgtgactgtgaacaatcaactgaggtaactcacactaccttcggaccaacctatcttcgttttcaatgttgtcaaatttaccatttacttgcctctgagttttgtgtcaaacttagaaaggctttttctttctgagattattcagaaaacatttccgatattttcctctagtgtttttattattgaatctttcacatttaaaactgttgatccacctgtaatttattttggtataaggtatgaagcaagggtccaactttgtttttctagatggcaactctgtcgtcttccctccttcctctaatttttttttttttttaagacgaagtctcactctgttgcccaagctggagtgcagcagcgcgatctcggctcaccacaacctccacttcccgggttcaggagattctcctgcctcccagcctcccgagtggctgggattacaggcatgtaccaccacacccggctaattttgtattttcagtagagatggggttatcactatgttggccaggctggtcttgaactcctgaccttgtaatccgcctgccttgggctcccaaagtgctgggattacaggcgtgagtcaccgcacccagccccttcctctaatttttgaggctatctttatcacataggacaggaatagtctcctttcgttacttttgttttcgacaatttcctggccactgctagctttttacatttgaattttagaatcaagtttctgtaattgccccaaataaaccctcttggtattttagggggttatgttaaacatctaggttaatgtagagataaatagcatttttataatggacacagtggatctttttaactgtccagccatcctctgggtccatttggaagtcttataagtcatcttcctacagatctggcacatatttgttacatttattcccagacatttcactccatgcatggccaagccctcggggcactttcccatgctctttacagtggtctgtctggctctcctggactttccaggactgtgctcgtgcatgtacttctgtctgattcttctgctggcacctctgggactatattggcagcagtggagatggcaacatttcaagcactgcccgccctgagcagggtgtgggtgcttggattgacacagatttttttttttttttttttttttttttgagacgaagtcttgctgttgcccaggctggagtgcagtggcgcgatctcggctcactgcaggttccgccccccggggttcacaccattctcctgcctcagcctcccgagtagctgggactacaggtgcccgccacgtcgcccggctaattttttgtatttttagtagagacggggtttcaccatgttagccaggatggtctcgatctcctgacctcatgatccgcccgcctcggcctcccaaagtgctggtattacaggcgtgagccaccacgcccggcctttttttttttttgtgacagagtctcgctcttgttgcccaggctggagtgcaatggcgcaatctcggctcactgcaacctccgcctaccacgttcaagcgattctcctgcctcagcctcccaagtagctggaattataggcatgtgccaccacgcctggctattttgtatttttagtagagacagggtttcaccatgttggtcagactggtctcgaactcctgacctgatgtgatccacccacctcggcctcccatagtgctggattacaggtgtgagccaccacgtctggccggacacaaacttttaccattttaagaaaaaaaaaaatcttataatcctttcgggggccaaggcaggaagactgcttgaggccaggactttaagattagactgggcagccaggcaccatggctcacacctgtaatcccagcactttgggaggccgaggtgggcagatcacttgaggccaagagttcgagaccagtctggccaacatggtgaaacctcatctctactaaaagtacaaaaattagctgcatggtggtgcacacctgtaatctcagctacttgggtggttgaggcatgagaatcacttgaacctgggaggcggaggttgcagtgagctgatatcgcaccactactctgtgacagagcaacactgtgcctcaaaagaaaaagaaaaagaagggaaaaaaaaagaccagatggggcaacacagaaagaccccatctcttaaaaaaaattagctgggcatggtggcacgcatccataattccatcaatttgaaatgctgaggtgggagtgttgcttgagcccagtattttgaggctgcagtgagctatgatgacaccattgcccagcctgggcaaaaaagtgagactctgtctcttaaaaaacaaaacaacacaaaaaagttcactgcatggatcatgaatggagggaggagaaagaagatatgagacattgtgggtgcaattaggaaaatctgaacgtggactcaatgtcagatgaaattatagaatgattacacatttctttttcatttttatgtttttagagacagggttgctacgttgctcaagttggacttaaactcctgtgctcaagtgatcctcccacctcagcctcccaaatagctgggactaaaagcactcgccatggaacatggctcaatcataaattttcttatatcatgatagtattacaggtatgtcaaagaatctcctcatccttagagaggcgaactgaagttgttagagataaattgtcatgatatctataacttactctgaagtgaatatgcaaaatgttaactgatgaatttaagccaagagcacagttgttcactatacttaactttcaacttttctgtaggatttaaatatttcaaaataaaaatcagagagaaaaaagagcccaaaagaaaaataaaatatatagtcactcctttttattgtttttctttttcaccaaaaattttaccaaatttaatttttttttttttttctgaggcagagtttcactcttgttgcccaggctggagtgcaatggcgcaatctcggctcaccacaacctccagctcccaggttcaagcaattatcctacctcagtctcccgagtagctgggattacaggcatgcgccaccacacccggctaattttgtatttttagaagagatggggtttctccatgttggccaggctggtcttgaactcccgacctcaggtgatccaccctcttcagcctcccaaagtgctgggattgagccaccaagcccgccccaaacttaattcttttttttttttttttttttttttgagatggagtcttgctttgtcacccaggctggagtgcagtggcatgatctcggttcactgcaagctccgcctcccaggttcacgcctttctcctgtctcagcctcccgagtagctgggactataggcgcccgccaccacgcctagctaattttttgtatttttagtagagacggggtttcacagtgttagccaggatggtctcgatctcctgacctcgtgatcctcccgcctcggcctcccaaagtgctgggattacaggcgtgagccaccatgcccagcctcccaaacttaattctttaaacattcatttttggggctgggcgcggtggctcatgcctgtatcccagcactttgggaggccgaggtgggcggatcacctgaggtcaggagttcgagaccaacttggccaacatggtgaaaccccgtctctagtaaaaatacaaaaattagctgggtgtggtggcaggcgcctgtaattccagctacttgggaggctgaggaacaagaattgcttgaacctgggaggtggaggttgcagtgagccgagatgatgccactgcactccagcctgggcgacagagtgagattctgtctcaaaaaaaaaaaattcatttttggctcacggcagcctcaacctcctgggctcaagtgatgcttctgcctcaacctcccaagtagttgggactataggcatgcaccatcatgcctggccaatttttaaaaaaatatattaaaaaaaaattattactacttttctgtaagtcaggaattatgtcaaaataaagacttaaaagttttaaaaagttgttcacacctcatatccattaggatgaccactataaaaaaacaacaaaacaaacaaacaaaaagtaggccggatatggtggttcacatctataatctcatgtccataatcccagcactttgggaggctgaggtgggaggattgcttgagcccaggagtttgagaccagcctgggaaacatagtaagattctgtctctacaaataatttttttaaaaaactggccaggcatggtggtgcatgcctatagtcccagctacttgggaggctgaggcagaagcattgcttgagcccaggaggtggagccatgatggtgcccctgaactccagcctaggtgacagagcaaaatcctgtctcaaaaaacaaaacaaacaaaaaaccagaaaataacaagctttagcaaggatgtggagaaactataacccttgtgcactgttggtgggaatgaaaagtggtgcaactgctatgttcctcagaaaattgtcaatagaatgatctagcaattccacttctgggaatatagccaaagaactgaaagcagagtctcagacatttgcacacccatgttcatagcagcattatacacaatagacaagagatggaagcaaaccaagtatcccttgataggtgaatagacaaacaaaatgtggtatatccataaaatggcacactattcagccttcaaaatgaaggaaatcaggtcacatgttataacacacatgaaccttaaggacacgatgccaaatgaaataagcaagtgataaagggctaatgctgtatgattctacttatgaggtacttagaatagtttaattcatagagacagaaagtagaatggtagctgccagggcctgggggtaaaggagaaaagggagttgtggtttagtgggtatagagtttcagatttgtaagataaaaaagttctggagatctgtttcgtaataatgtgaataatcgtaatattactgaactagatggtaagtgttatttgtgtttattattttagaaccacaattttaaaaaattgttcaccaagtacccagtagcaggggaatgaccaaataaatagaggacatcgacagcacggaacactccacagcacagagagtgagggccatctctactgctggtgcctgggacctccaggatgtcacaggtacagaatggcaaaccagtatgctgcctctggtgtgagatgggggagaaaaatatttcttgggtcagcttgttcaggtcctcgatcccttgtccaaactctttaaatcaagtgtattttagaattcagaaggttccaacgtgagaaatactgtacacatgccacataggatcttatatcccacgggatctgggtcggtgcctcctcttcaaacaccttaatatgccccccaaaaaagtataaagactcacactaggataaaaaatataattagcctcgaaaataattttgagttttgggtgggttccgtggcttaatgagtttacgccaaacttttttttttttttttttttttgagacggagtcttgctctgtcgcccaggctggaatgcagtggcgcgatctcggctcactgcgagctccgcctcctgggttcacgccattctcctgcctcaacctcccgagtagctgggactacaggcacccgccaccatgcccggctaattttttgtatttttagtagagacggggtttcaccatgttagccaggatggtctcgatctcctgacctcgtgatccgcctgcctcggcctcccaaagtactgggattacacgcgttggccaccgcgcccggcctacgccaaacatttctttaagacgtttggctgggccaaagttagctgagttatttcagttgattgttcatagtcagtaacagatcaaactcattcgtctctgtccccccttctcactactgcacttaactagtctaaaaaataataatagataaaaataggccgggcacggtggctcacgcctataatcccagcactttgggaggccaaggtgggtggatcacctgtggtcaggagttcaagaccagcctggccgacatggtgaaaccctgtctctttcaaaaaatacaaaaattagccgggtgtggtggcatgcacctgtactcacagctactcaggaagctgaggtgggagaatcacttgaacctggtaggcggaggttgcagtgagcagggatcatgccactgcactcccgcccgggcgacagagagagactccatctcaaaataaaaaaaaattaaaaaaaaatttttttttcttttgtaaacggagtcttgctctgtcgcgcaagctggactgtagtgggaccatcttggcttggctcggctcactgcagcttcaacctccaggctcaagcaatcctctcacctcagcctcccaagtagtggggactacaggtgtgtgccactgtgcccagctaatatttgtattttttgtagagatagggttttgccatgttgcctaggctaatctcaaactccaggactgaactgatctgcccaccccagtctcccaaggtgctagggttataggtgtgagccaccctgcccagccccaaaagttttttggtttttgtttgtttttgagagatggacccttgctatggtgtccaggctgcagtgcagtgacatgatcccactactcaacagcatgggagttttgacctggtccatttccatcctgggccggttcacacctctttttaggcaaccctgctccaggaaggtcaccatattgatgccaaatttagtgtggataccctgttggcatggcacactgcaacccagaacttctgggctcaagcaatcctccggcctattctcccaagtagctgagactataggtttgagccaccacgccctgctcaaaaaactttttaactgtgagaatggatgctgaatgttatcacatgcctgctcaccatgtctgcagatatgctatatagacacgtatgcagatatgttgggttgtcatgaattgatggaatgccatgattccctggcatgtaactagtaagacagattccctagcatgaaaccaattttttttttttgagacaaggtcttgctgtgtcacccaggctggagtgcagtggcacactcacaactcatggctcactgtagccttgacctccccaggtttaagtgatcctcccacctcggcctccccagaagctgagactacaggcatgcctggctaatttatgttttgttttgtttgtttgtttttctttttttttttgagacggagtctcactctgtcgcccaggctggtgtgcagtggtgcgatctcggctcactgcaacctccgcctcccaggttcaagcggtacttctgcctcagcctcccaagtagctgggattacaggcatgcaccacaacacctggctaatttttgtatttttttttgacctctgaactttttattggcctcctgctccccaaaggataccctgcttctggtggcttaatgtctcagaactttggtgtcattggtctcagacaccactttgccatccattatctggcaggtggtggtcttttggatggtttgcatggagttgctgctgtccagggcatcaccaagactgaagtcctcgccatcttccagcaggcggcagtaggtggtgatcttagcctccagcttgaccttaacgttcaccagggcgtcctactcctaggcctggcactgtccctctgcccggatttgtgccacctctgactccaggtgcagcaggatcccattgagctgctccatctacagggcatagaaggcctccacctccctgaggctgttctacaagctggccttcagatttctcaaggagtccaggttgatctccaaggactggacgtacgtctcaactccgtgattgtcatctcagcagttccaacctcagtggactgcatggtgaccactgtggtgctctcctcaatctgctgagaccagtacttgtccagctcctgtcgtttcttccgagccagctcatcatattgagcctggatgtctgccacgatcttggcaaggtcctgagatttgggggcatctacctccacagtcaacccagagctggcaatctggtcttgtaggccttttacttcctcttcatggttcttcttcatgaagagcagctcctccttgagagcttcgatctctgtctccagctacagctgagggacattggtgtcatcaatcactttgcgaagcccatgtatgtcgctctccacagactagtgcatgggcagttctgtctcatacttgactctaaagtcatcagcagcaagacgggcattgtcgatctacagaaagatacgggcgttgtccacagtatttgcaaagatctgagccctcaggtcctcgatggtcttgaagtaatgcctccagtctctgatctgggtcccttcttctccaagtgcttctggattttgctctccagcttccggttctcggtctccaggctcctcgctctgtccaggtaggaggccaggcggtcattcaggctttgtatggtctccttctcattctggatgcttcccattcctgccagatccccagccatccccgcggccaggcccccagaccccatgcagccctggaagctggtggagcgggacacgaagatccaggaaccagagccctcggtgcctgcatagacgctggccacgctgctgaccagccaggcgccatagctgggagcctggacagagcccagggaccagtagttggtggagaaggtagagcgagtggtgaagctcatgctgtccggggaggagagcaagaggacaggactcaggctttgctgatgacctaatttttgtatttttagtagagacggggtttcgccatgttggccaggctggtctccaactctggacctcaggtgatccacccgcctcagcctcccaaagtgctaggattacaggcatgagccaccgtgcccagctttgtttgttttttgctttttgaggcagaatctcactctctcatccagtctggagtgcagtgacgcgatctcagctcactacaacctccacctcccaggctcaagcgattcttgagcctcaccctcctgagtagctagaattacaggtgtgcaccactacgcccagctaatttttgtatttttagtagagatgggtttttgccatgttggccacactggtcttgaactcctggcctcaagtgatctgccggccttgggcacccattgtgctgggattacatgcatgagccactgtgaccagctctaatttttgtattttttgtaaacatggggtttcgtcacgttgcccaggctggtctcgaactcttgggctcaaacaatctgcccaccttggccttgcaaaacgctgggattataggtgtgagccactgtgctcagcctttttttttttttttttacgagaaaagaggtctcttactttgtcatccaagcgagagtgcagtggcatgatcatggctcactgcagcctcaacctctcaagctcaagctatcctccctcctcagcctcccaagtagctgggactataggccacgccaccatgcccagctaattaaaaaaaatttttttttctttttctgaaactgctctgaaaaaatttaaatggcattggagtcttttcataaaaggcacacctaccctggaaaacatctgggctttgtgttttgtggggaatacaactttctctctcttttggggataaagtgctattaattttttaaaaataaaatcatcaattgtatccaaacttttaaagtaacagacattgagttcagctaagcagtcttttataattcacagatggaatgaaaactaagggagggacgaggtgacccatggaggttgtataaaaaggacagagcctttgggctcttcagactataagggtccaggaggagaggagaaaccacctcagaagcatacaaggttaaagcatacaaggtgggtgtagggtcaggggagccaaagtaagtgtgcaatgaaaagttattaacaaaagtcaaaaaaagaaaatgcagtctggccatccaattcctaaaccatgtacagagtacacagaaagagcacaggaggcttcctgcagcagggcagtacagctctctgcccttcaggaaaactgagattcctccacctgggaaacagcaagggacaattagggaaagctctccagaggaggaggcatctcaggtgggccaaagaagaaaaatttccacaggacagaaaaggcagagaagaggccaggcatggtggctcacgtctgtaatccgaacactttgggaggccaaggcaggcggatcacctgaggtcaggagttggagaccagcctggccaacatggcaaaaccccgcctctactaaaaatacaaaaattagccgggtttggtggcacacgtctgtaatcccagctactcaggaggctgaggcaggagaatcacttgaacccgggaggcagaggttgcagtgagccgagattgccccactgcacttcagcctgggggacagggcgagactccatctcaaaacaaacaaacaaaaggctgggcgtggtgtggctcacacctgtcatcccagcactttgggaggccaaggagggcaaatcacaaggtcaggagttcgagatcagcctggccaacatggtgaaaccctgtctctactaaaaatacaaaaaattagccgggcgtggtggcgcacacctgtagtcccagctactcgagaggctgaggcaggagaattgcttgaacccggaggcagaggttgcagtgagccgagatcacaccactgcactccagcctgggtgacagagtgagattccgtctcaaaaaaaaaaaaaaaaaaagaaatttatgttctttgtaaaataattcagacaatgcagtaaacagaagaaattcagcctccctctccctttgccctttgctgagtccccacggtgcagcaagatccttccagatcttcatggttgggatcatcttccaccaggtcctgaggtttttcactccctatcagtagacacaccacactgcccagtttgcaagtagctccattggataacacagaaaggctctgtcctgcaccatgtctcagcactgggtgcatcgtcccacaggaatgacacctagacacccaacatacaactgcagggccctaaactatgggccagcccacccctaaatgcccttctctctacccttgcccatatcaaatattacaagcctctcacacatatttaccagtcatactgggaaaaaaatagtcctttatcattttaacatttcacaagtaactaaaacaaataataaacatgctaacacttgggaatggtctatttcttttctttttttttttttttgagacggagtttcattcttgttgcccaggctggaatgcagtggcgcaatctcggctcactgcaacctccgcctcccgggttcaagcaattctcctgcttcagcctcctgagtagctgggattacaggcatgtgctaccacgcccagctaattttgtatttttagtagagacagggtattgccatgtgggtcaggctggtctccaactcctgacctcaagttatccgccctccttggcctcccgaagtgctggaattataggagtgagccaccaagcctggcctctttctaggctcactgcaacctccgcctcctgggttcaagtgattctcctgcctcagcctcccaagtaactgggattacaggcatgtgccaccacgccccgctagtttttgtatttttagcagagacggagtttcactatgttggccaggctggtctcgaactactaatctcaggtgatccacccgcctcggcctcccaaagttctaggattacaggcgtgagccactacatccagcctcttttttgtttttttgaaacagggtcttgctctgtcacccaggctggaatgcagtggcacaatctcggctcactgcaacctccgcatcctgtgttcaagcaactctcctgcctcagcctcccaagtagctgggattacaggcgcccaccactacacccagctaatttttttttttttttttagtagagacagggtttcaccatgttggccaggctagtctcaaactcctggcctcaagtgatccacctgccttggcctcccaaagtgctgggattacaggtgtgagccaccgtgactggcctctatttcttatttatacatacacacacacacccccctgtgaaatgactctgggctcttccaataatgttgccactctcccgctccccttcccaatggaagtggagggatgcagggggtgttagtgatgcattgtaatcatcccggagagcaggacacctctcataagaggtttacccaaggggggctgtggaaagggctagaaattgctcctggaggacgtggaaagccacataaggtttttgacagattagcgaaaggctgcctacactgtcatcttcagaaagagtggtatgacactaaatcaagaagggctgagagggtgagcccaggggatcccataggctccacagcctctggccatcctctcctatacaggtcctaagtcccctgcagggggccctcagctcctctaccctacccactgtcctgtatgttatcttaatgcttattaaaggcctcagctgaatttccctggtgaactgaaagaattctgctgctcctggacacatctgcaccaagccaccactgggtcacattctccaaaactccttttggagacagaaggcacttaaaccatacatattttgcttgatagttcctaattaaaaaaatagagagagataaagagaaagagagagagagagaactacaactaagccttgaagacaaaatgattgaacagaatcagagctagaatggaacacctcaggcttggagtcccatgacaaccttgctggggaccacgagtggccctcagtccttctcaggctcatgccacctatgtgaaataagggtggtgacacccacctccttgagtgcagagcagtgcagacaacagggcaaatggtgtattgatctgctatctgtgtacataaatttattcatttaagccatgggtattgtttgaatatgtgaaaaccatgtcaggtgctagggataagagacagattccaacccagtggaaaagacagataagccagtggttcctcacactgtgccaagtgctgggatggggtcacgaaggaggccataagaaaccccagaggggccacagagctcactgggagggccagaggctaacacctgagggatgagaggtgtgagccagaaggtgatgcatacacagcaataattactgacggaggggaggaatggtaagggaggggaggagagaaaggaggaaagaaaagagaaaagaaaagagagagaaaaggaaaagaaaaggaagagaagagagggaagagaagaggaggcaaagcccaagaaacaggatcactgaatgaaaaatgaactctaagacccccttctgtctctcacacttgttgactaagtcatagccacaaggagtaggggaggctctgaggtgagcaggagaccagccactgtcaccgccagtacctttactagcagagccaggattacctttgttattcttcttacaaacagctctagtgaactcacctgaagtaatcgcaggacgcagccagcaggatgcgatgggcctcgatgtgtctgccctccaccaccagcacaacatcgaagaggattccgctgtcccggagagccagcagccctcggagcagagcctgggagtgctgtgcgctgcggtaggtgttgttcacgcagtgtgggtgtgagggctgtgcaggcaacttgcagagctgggtgaactcctgctcctctgccatcctgacagccacaagatcccttacaactgtggcctgacagttggcaaaacaggggacaggggtgagcaggcaggcatcagccccaccacacacagactggccagctctgttgctccccttgctcctgtgcctccctcaggctcacctgttttccctctatttccaaatcccctaattccttctcccctcccacctctagtccaacttcctgatggccttcttcctgatgacctgtgtgccatcatgcccaagactcttcatctcattgtatcttcttcagcggcaaagtcaaacagaagggttttgggaaacagactgacctgggttggagcccaactccacagggacttacaacatgaccaaactgagcctcgagctccccaattttaaaaagagagataaaagtacctaccccattggggtattctaaaattggtaaaacaatgaacatgaagcataagcacacaccaggttctcaagagctcttcctccctcccattgaatgaacaaaattgggttcttcctcatagtaatggatgcataaaaatggcaagacctgagtagtggtcaggagacacacagccaggagtctgggaggtgggtgccaagggggtggcatttccagggcctactttcctttactgaaattctgagagtcaagcacagtaactgtgattgaacctgatgcatttaaattcatctgcattgccttttaaattaaagattatcttctaataattgagtcagtacgttcaaaaaccgcaaactgatttgaattggagcctctaaaacctaatcagtaaaatgaacctactgcaaatgcacttttgccatggagcaaccaaaagtgactgtggatagccagctgttcaggtcagggagtggccagtcccacactgtgaggcatggccaagctgcaggctctgtaggcacagcacagtcagctacaagatgtgaacatctgtcttctccacctcacttcatcctactttcctctccccaaaatatgtttattctccaattacctccagtcatgcatcacttaatgttggggatacattctgagacttatatcgctggaggcaatttcctcagtgtgtgaacatcaaagggtacacctacacaaacctaggtggtagagactactacacatctaggccataaggtacagccaattgctcctaagctacatacttgtacagcatgttactgtagttctgaatgaaaaaaacacactgtttttcctctcctcttataccacaacaacaaacacaggagacttctgtgaccaaatgtgtgagggtttttccccattaacaagcaagcaatcaattctgccacagataccagctgggtgtcttctaattcagcagtccccaatctttttggcactagggaccactttcttggaagacaatttttccacggggtcggggaatggtttcgggatcaaactgttccacctcagattatcaggcattagctagattctctttcggagcacacaatctggacccctcacatgcatggttcacaacagggtttgtgctcctatgagaatctgatgccacctctgatctgacaggaggtggagctcaggtggtaatgctggatcaccctccactcacctcctgttgtgccacctggttcctaaccagccacagactgatacaggtctgaggcctgggggttgcggacccctgctctaattcaactctaacactacctggagacagtgtctgatcccacaggttgagggctgagtctcccaggttgtttcacctgtgcttctgaccaataggctataaattgggttcccaagatccccttcttgggttcaactaatttgttagagcgactcacagaactcaggaaaatactcatgtctactggtttgttataaagggtattgcaaaggatacagatgaagagatgcatggggccagacatgtgggaagtggtgcagagcttccaggccctctccaggaacatcactctttaggagcctccatgtgttcaactatccagaagttttccaaacccagtcattcagaatttttatggaagcttcattatgtaggcatgactgattaaatcactggccattggtgatgaacttaatcttcagcctgtctcccctctccggaggttgagaggtgaggctgaaagtcccaaccctcttatgcctgccttggcctttcctgtcaccagcccccatcctgaagctacctaggggctgctggccagcatacaaaaaggcatcactctggaaagtccaaagattttagaagttgtatgccaagaaatgagacaagaccaaatatatatttcacaatatcacagtactgaatactataggcaactgtaacacaatggaatttgtgtatctaaacacagacaaggtacagtaaaaatatgggaccaccatccttcatgtggtctggtctgtcattgacggaaacatcactgtgtggcacatgattatatatctttaaaagaaaaaatgaaaaatatatgctgatataaaacttgccaaaaagaagaggtctctctcttcactactgaggctcagggccacccccaaccccatcccctggatgctctactgcttcccatcaaacacactcagttatctgtgcctgcccctgagtctgcctccaggacctgggacctctatccagccacccacccattcctttccccctcctgggctggctcatctttctcaccaaggccccagagatggccacagccaaggtgtataccccatgaccacctctcacttaggattctcttgcctggaaactctgctctatgataattctcccttttctgacctctctctttcatcccacacaccctgctcgagcccatccttctttcccagtggttcacattcccagtttcacctacagctcagtgcctaatctagctagtagccctccaacttgtctaattttactatcaaagctaccatttccatcttggaaacctcactgttttaatatttttcctttctaacccatgtgccctatgaacctactagttctgattccttcacctctcctccatctcagacagccaccctccactcctccagggccaccactctgggtcagaccacagcagtgatgcccctaccagtttccctacctcttgtctcatcctccccaggctgctctccttcaagccttacctactcagccccatcagcagtccttagtccaaaagggatacctgtcatcccctgaacacctttagtcacccatctaggccattctgtctctcatagtcccatattggtcaaggtctagctcgattacttctccctctatcattgtacagagaacatgacaaatatgccccaccattcaaacctgcccttttttttttttttagacggagtctcgctctgtcacccaggctagagtgcagtggtgtgatcttggctcactgcaacctctgcctctcaggttcaagtgattctcctgcctcagcctccccagtagctgggattacaggcgtgcaccaccacacccagctaattttcttgcatttttagcagaaatggggtttcaccatgttggtcaggctggtctcgcattcctgacctcaggtgatccatctgccttgacctcccaaagtgctgggattacaggcatgagccaccgcgcccggcccaaacctgcctatttacccacgacaaggagattccggcttcttgaggggtgaggttttatctcacaaacatctcaaaagcccccatggctggctgtaccacttgctaatgacagactctgggcacttgtctcatatacccacgcctcagctttctcatcaccaccatgaccaccgcagagtcaagagggcctccttctctgagggtgacctccacaactaccccaatagacatcaagcccccaggtggatcctcaccttccgtgagcatagtagtgcctctgctctcttgggaagggataaatggcagctactccctaaacccatactgcaaaaacaagtacggtaaaacagaaagacatcttccatgggcaggcaaagcacatttaccaagtccaatttaagaaacttagctaggggctaagggggatatgctgaaaaatgaatcaattctctgctgggaaggagcacagcacagggtgcaacatttaaaacatttaaaaccacatctatacggttttaaatcaccaaaacgtccaccctcaggagaacagatgtcatggcacagtgatctgacagaacattaggcaacagtcaaaatgcgcaaagtggccgggcgcagtggctcacgcctgtaatcccaacacttcgggaggctgaggcggatgaatcacgaggtcaggagttcaagaccagcctggccaacatagtgaaaccccatctctactaaaaatacaaaaaaattagccgggcatggtggtaggtgcctataatcccagctacttgggaggctgaggcaggagaatcacgccactgcattccagcctgcatgacagtgcgagactccgtctcaaaaacaaaaaaacaaacaaaaaaacaatgtgcaaagtaggctgggcacagtggctcatgcctgtaatcccagcactttgggaggccaacgtgggaggatcacctgaggtcaggagttcaagaccagcctggccaacatgaggaagccccatctctactaaaaatacaaaaattagtggggcgtggtggcgcatgcctgttatcccagctactgggaaggctgaggaagggggaagctgaggcaggagaatcgattgaacccaggaggtggaggttgcagtgagccaagattgtgccattgcactccagcctgggcgacagagccagactttgccccccccccaaaaaaaaaagtgcaaagtaggctgggcatggtggctcatgcctgtaatcccagtgccttgggaggtccaggtaggtggagttcaagaccaccttgggcaatatagcgcgaccctttctctacaaaaaatttaaaaattaactaggcatggtggtgtacacctgtagtcctggctatctggggtgagacagcttggggttcactgcagtctcaagctcccaggttcaagtgatcctcccacctcagcttcctcagaagctggaacaacaggagctcaccactgcgcccggctaatttttcaaattttctttgtagagaagaggtttcactatatggtgtaggctagagtgcagtggtagggtcttggctcactgcagccttcatctcctgggttcaagcgattctcctacctcagcctcccgagtagctgggattacaagcacgtgtcaccacacccagctaatttttgtatttttagtagagacggggtttcaccatgttggccaggctagtctctcctgacctcaggtgatctgccagccttggcctcccaaagtgctgggattacaggcatgagccaccgcgcccgcccccagtctcatatccccaattttagtcatcacaagccaagttccccgttttgtactgttcgaagtttcagtggggagaagaaaggaagcttaatgtgccacatagctacaaactgaaggatacaagatgaatttttatgaagtgatggatggcagagtcaaaatcatttcagaggaactttcagttcggtacgattttactgagtagataccctcagccttctgtagggcccccgaacgagcagtatcccctcaaagaaactcaatccttggcagcatgaagcaaggtcggccacaaaggcaaagggggcggctgcggtagaggagagggagtgggtgctgattcccagcggggcagccttccaaagggtgcgctctggaagaatctcccagggagccgtcttggaggcactcggccccgcggagggccggagcgagggcgcccagtgaggagcccaggcggaaggtggcggtgccccgctgcccgccccagatccactcggctcggcccgcaccggatctaaaatggtcagaactggcagccgacgcttcgcgctctggtgattttgcactgacagcgcgatctccggctcctctcaggaaaccgggagagctggcaaggctgggctcctacggctgcagtccccgggcccgatcgagggaactgaggctcgtcaggccggccccaaatcgcccgcctgttgcaaggccgcccgctccagcgcggagggtcgcggccaggaaggccgcattcggacctgccgcaggcaacagggcccgcccgggtgccaggaggccggcgcgccagcagccgcgctgaggaggcctcgcaccctggcccctggccgagcgccagatcccggcccctacgcgcccgcgcccggggatcccgccggccgcgtccccgccacgtcaggccgcgggctctcctcaggtcgccgcccccgagcctccggcccgcgcccgcccccgcgcccctcggactccgcgccgctagcttgtccccggcccagcgatgcctgcttgccgcccgacccccgcgttcgctgccgcccggcccgttcggctcacgcctcgcagctgacctggtgccgccgccagccgaggccgcactcgcagctggagggaggcgggaggcgggaggcgggaggcgcgaggcgggaggctgggcgagaggagccggcggggcgggggcctgggccgtcacgtgggtgcgccgcgcaggcgccgggcgggccagacgtaggcccgggggttcccggcctggccgggtagcagcgcgggggcggccctggggcggggagacagggggcggctccactccggcgctctgcggaggacagcagcgatcgccaaggctcagtgagtccccgcactagcgcggcacctggcacttggcggggccgaaccaacgaatgagcgaatttgccgagagtcgccccgtctgaatccattgactctttccttgcctcggtcctaccctcattcctcgactcacttcctcctgcccttcctcactatctccctccccgctcatatcctccctctcctttcctcattcccttcttcactctcttctctcctctcttactccccccctctcattccctccctccttcactctctcattccttcccttcctatcttacccaccattcccttcctccctcactcattcactccctccctgtctccccctctcatcccctccctctctcattccctttccctccctccttaactctcgttctctcctccctctctcattccttccctccctgtctcatttccccccttctttccctccctccctctcctcttctcccattgcctccctccctctttgattcccttctttcctcctctcctccacttgttcccttcgtcacgcgctcattccctccctcccgcggcctgctccttccccgctccctccgcggtcggtgccgctgaccgtagcgcgccccctgcgggatatcggggagaatcgcttaacaccgccagagtgaacaggtgctagtttgtgtgcccgttcctttactgagattttgcagtaaatctaattcccagtcttaaagcctggtcccagaggtccgtgcgcgggtcttggcattcattgttctccacctcaccttcgagcaggtcccatcctccgaggcgtatccgtaatggctgcgcccagagcttggagccacagagcctcctgatgggataaggttggagtgtcccacactgtggttttgagagggactgtgaagggtggagagagtggtagggggaggatgtggctggagatggctcatggttaaaaagaaaggtggggccgggcttggtggctggcgcctgtaatcccaacactttgggaggccgagacgggcggatcacgaggtcaggagatggaaaccatcctggccaacatggtgaaaccccatctctaccaaaacacacacaaaaaaactagccggtcgtggtggcgcgcacctgtagtcccagctactcgggagcctgaggcaggagaatcgcttgaacccgggaggcagaggttgcagtgagccgagatcacgcgccactgcactccagcctggtgacagagcgagactccgtctcaaaaaaaaaaaaaaaaaaaaaaaaaaaaattggtggaaggggaatgtaaaaggaggaaaatacacggaagagaattgctgtcctggctgagtccagagagataactgagggtcccagacaaggatcaagagaacgggattggcctccagaggcagaggttccaaatgggagtgggcttcctcctagaaagactttctggaggagacccccctactgtgtaacagaggaggactttgggattaagaaaagcattccaggaagccgacagtgtcagcaaacgtggaggtgagatccttcaaagtgagtggtgtggaggtttccagaattttctgagcctgaagggaaggttggagagcagaccctgccctttggaggcttgacttagccctgagggcaccctgtagccagggtgggcagatgccaatatggtagagacgaagactgagtagggagccagccacagtgctgtggtctcaggcagggagtgaagaccagagtggagcaggctagaaacctgggaaggaagcaggttccccagtataagcccagtgatgtgtgaagaatgagcccaggagatgggtggggaagtaggcccaccctgcctacaggggagccagagcaagagcaggtctgggggaagatgaggccccccttggctccaggtaggggaagactgacctccaaggcccaatgggaccaggtgtacgggtggacccagagaggagaggaaaaggaatcctggggcagcaacaagaaggccactgtggtctgaatgtcggtacccccaaaattcatatgttggaactgaatcctcagtgcgatactattataaagtagggcctttgggaggggtttaggtcatgagggtgaagtcctcaccatgggatcagtgtataaaagaggttcgaaggagctcatcccccacttttgccaggtgaggacactgtaataagcaccatcttcaaggcagagaatcggctgggcgcagtggctcacgcctgtaatcccagcactttgggaagccgaggtgggaggatcatgaggtcaggagatcaagaccatcctggctaacatggtgaaaccccatctctactaaaaatacaaaaaattagccaggcatggtggtgggcgcctgtagtcccagctacttgggaggctgaggcaggagaatggcgtgaacccgggaggcagagcttgcagtgagctgagatcgcgccactgcactccagcctgggtgacagagcaagactccgtctcaaaaaaaaaaagcagagaacggacccctcactagacactggggcttttttctgaaggctactgtgtcatataaaatttatattaaataaattgatatgcttttctcttgttaatctgtcctttgttagaggggtgtcaaccaggaaccttgtgatgcgtgaggaaaaaatattaccttttccccctactctttctggcacccaacaaacaagtggggtggcaaagacaccccacttgggacaactggcaaaaggtaagcattcttaccaaggttaactgtcccatatcactgcctgtagtactcagctgagagtggaaggtaaaaacttcttgtcccttcctttccaaattcaaattagcagaagaaaacattgtgtctggattgtgactcttgcttaaatttggttgaggggtaactgtttgttattgatcctttcctcccaggcacagctacctctttcctgtttgttttatttgtgtcctgagagcttggctttatgaccagtgagaatattctccctgatctctgaatagccagtgggtgcaagtgacagcttgctttaggacagcttgcgttagggttgcaagtaacagcttgcattattacaaactcctctgtcccggtcagaaaaagagaaagtttggtttttgtttgtttgtttgttttttgttttgttttaatagtcttgctctttcgcccaggctggagtgcagtggcatggtggcatgatcttggctcactgcaactgctgcatcctgggctcaactgattcttctgcctcagcctcctgagtagctgggactacaggcacacactaccacgtccaggtaattttttttgtatttttagtaaagagggggattcatcatgttgcgcagggtgattttttttttttttttttaattcttttctgagacggagtcttgctctgtcacccaggctggagtgcaatggcgggatctcggctcagcctcctgagtagctgggattacaggcacctgccactacgccagctaatttctgtatttttagtagagacagggtttcaccatgttagtcaggctggtctcgaactcctgacctcgggtgatctgcccacctcggcctcccaaagtgctgggattacaggcatgagccaccgtggctggcctcttttatttttaagatacagggtctcacccaagctggtcaggaactcctggcctcagtccacctgtctcagcctcccaaagtgctaggattacaggcatgagggaccacgcccggccaaagagaaggttctgaaccttctctttttctgaccatgacagaggagtttgtaagtgggccaagtctataaggggtttttgttgtctcagtattcattggtgtgatagatgagccagtccatgactggagacgtgacagtgttctgtacaagatgacatccttagtcacctgtgtcaacaaaggtgccttctggctaggcacggtggctcacgcctataatcctagcactttaggaggctgagccaggcaaatcacgaggtcaggagttagagaccagcctgaccaacatggtgaaaccctgtctctactaaaaatacaaaaaaattagccaggtgtggtggcgcatgcctgtaatcctagctattcgggaggctgaggcaggagaatgggttgaatctaggaggcagaggttgcagtgagccaagatcgcgccactgtactctagcctgggtgacagagcgagactccgtctcaaaaaaaaaaaaaaaacccaaaggtgccttctttcttttgactgtctttgcaaggggtctggatttgagagtgctgaatctttgtgcaccctctttggagtgtgtctttctctctctctctctctcttttttaagagacagagtctcacccagactgatcaggaactcctggcctcaggtggtcctcccaccttgacttcccagagtgctgagattacaggcatgagccattgtgcccagccttgaggatgtctcttttgtccatggttaagtcataaaatgcttattggtcttggttctgagttgcttggtaggtacctttggtttacaagaagaaaagtggtgggtgggcagggtggtagtagggaagagtgttcagtactgccaggaatatgtactatctgttctggctgaaaactgacaatgagatatttgaaaggattttttttttttttacagctctatgatcagaagatggcataagtggggctgggcacagtggctcagtgcccagctgggattacgcctgtaataccagcactttgggaggccaaggtgagtggatcacgaggtcaggagttgaagaccagcctggccaacatggagaaaccccgtctctactaaaaatacaaaaaattagccgggcgcggtggcaggtgcctgtaatcccagctactcgggaggctgaggcaggagaatagcttgaactcagagggcggaggttgcagtgagccaaggttgcgccactgcactccagcctgggcgacagagtgagactccgtctctaaaaaacaaaaaagaagatggcgtaatcagaagttgatattctgtctattggatcctgcttctcccctggggtcttcttggttccctgaagcccctcttccggagtccctgccctctatcggctctgcctcctgcttcttttctgtattgccatgatttttgctaaggataaaggacaacttcattggcttctttgggaaacttgcaatctccccaaacaggcccctctgagatttctcctttccatttgcttctgctcccccttcctccttttgccaccttcgatattttctccagtttccttgattcctttgatacgtccccattcaggccactctggccctccatccaacctgccagaactttttccacttcagcacttcagtcacttaaacattagggctccctgccctaaagggactcaaaatcctgcaaaaacaaccacctaaggataaaaagagaaaaaatgaaactgtttggaaactgggcaaatgaatactcttttaaaagtctttttctgggggccaggtgtggtggctcacgcctgtaatcccagcactttgggaggccgaggcgggcagatcacaaggtcaggagttcaagaccagcctggccaatatggtgaaaccccgtctctcctaatgatacaaaaaaaattagccaggtgtggtggcattcgcctgtagtcccagctacttgggaggctgaggaaggagaatcgcttgaacccgggaggcggaggttgcagtgagccaagattgcaccactgcaccagcctggcgacagagcaagaagactccatctcgaaaaatatatatgtatgtatatatacgtatttacgtgtatatatgtatgcatacatatatatatatatagagagagagagaaaccagtgagtttgtattactgtgttttactgactcacgactaccattttggaatgaaagctataagatctttgtgtttttacgtttatgtgtttatatttgtgtatatctatgtatgtatgtttgaatattatatataatattttttctatctccatattcagtattactaactgaatttttttttttttttgagatggagtctcactctgtcaccaggctggagtgcagtggcatgatctcggctcactgcaacctccgcctcccaggttcaaacaattctcctgcctcagtctcctgagtagctgggactacaggtgcgagccaccatgcccagctaatttttgtatttttagtagagacgaggtttcaccatgttggccagcatggcctctatctcttgacctagtgatccacccacctcggcctcccaaagtcctgggattacaggcatgagtcaccacgcccagcctaaattttttaaatcccttaaaggagttatattcaaattgtaccctcctttgaagatgtctcttttgtctgtggtgtcttaaaaggattattggtcttagagggaggtaaataagcattcatacaagctaaatattaccaaaaatttaagaaaaatagaaactaatccaactgctttttagtttacatgatctggaatattctttagtaaataaagctagtttgaaaattgatggactacgccgggtgcagtggctcaggcctgtagtcccagcactttgggaggccaaggcgggcggatcacgaggtcaggagatcaagaccatcctgactaacacggtgaaaccctgtctctactaaaaatacaaaaaattagccaggtgtggcagcatgggcctgtagtccccagctacttgggaggctgaggcaggagaatggcgtgaacccaggaggcggagcttgcagtgagctgagatcacgccactgtactccagcctgggcaacaaagcaagactccgtttcaaaaaagaaaattgatggactagtcaaacaagttttatgttatcactactgaatggtaaagataataaaactatcaatccaacctaagagcaaaatgtgcaataaaaatgaattgcggctgggctcacccctgtagtcccagcagtttgggaggccgaggcgggcggatcacctgaggtcaggagtttaagaccagcctggccaatatggtgaaacctggtctctactaaaaataaaaagtaaggccaggtgtggtggcgggacctacctgtaatcccagctacttgggaggctggggcaggagaatcgcttgaacctgggaggtggaggttgcagtgagccgagatcgtgccactgcactccagcctgggagacagtgcgagactccatctcaaaaaaaaaaaaaaaaattgggcacggtggtacaagcctgtaatcccagctacttgggagtctgaggcaggagaattgcttcaacctgggaggcggaggttgcaatgagccaagatcgtgctgctgcactccagcccaggcaacagagtgagactttgtctcaaaaaaaaaatgaattgcatggcttggcgcggtggcccatgcctgtaatccagcactttgggagactgaggcaggtggatatttgaggtcaggagttcgagaccagcctagccaacatggtgaaaccccatctctactaaaaatacaaaaaattagccaagtatggtggcgtgcgcctgtaatcccagttacctgggaggctgaggcagaattgcttgaacccaggagctggaggttgcaatgagccaagattgcaccactgcactccagcctgggcaacagagtgagactccatctcaaaaaaaaaaaaaaaagaaacaataaccactccctccctacctccacatacataagtgattacaggctccaggccaaacacacagaggagttacatctggctggtgctaggatggaaggtggggcaggtcaccacctcccagggactgagtgccaaagcaaggaggaagattggaggtgaggctgtatggagacagccacaggctcacagagcttgtgctgagctctctagggggaagcttgatctgcctgggaagcttccagctcctacctcctgcagagcccagaatggtgtccaggaaatatgtggccattgagtggaaccagccttggcatggtagcctgcaggaacccgcaggctagagacatggccacatgagcagtgaggatctcccccgagatgaggatccccagaacatagtgtgggatgcaggtctggcctctgcataccctcggcttcctccatcacttattctcagacatctaaaccactaacatccagactggggatcccaggagggtctacagtgtcaagagagggcaagtccacttcaggatcaaccttcctgtggccccttactttccttggtccacctttccaggtcacccatccagactgtcaccagggatcactgccctgggcaccaacccaatgcggggacaagtagaaaaagagctctggggaaaataccaaagggaatagtcactcaattttactgtgatgataaactcctggcaaagttccaggcctctctctgtctgtgtctgtgaattatgtgtctgtgtctccatcaaccatagtgcagaagggggagggttgtcctaagtatcctattaacatgtttgtttgtttgtttgtttgagacagagtttcgctcttgttgcccaggctgcagtgcaatggcataatctcagctcactgcaacctccacctcctgggttcaagtgattctcgtgcctcagcctcctgagtagctgggattacaggcacacaccaccatgcctggctacttttgtatttttagtagagacggggtttcactatgttggccaagctggtctcgaactcctgacctcaggtgatccacctgcctcagcttcccaaagtgctgggattataggcgtgagccaccatgcccagccagaacacaggactttcaaaacttaaacctggggctgggcacggtggctcacacctgtaatcccagcactttgggaggccgaggcaggcggatcacctgtcaggagttcaagaccagcctgggcaacatggtgaaaccccatctttactaaaaataaaataaaataaaatacaaaaatgagtcgggcgtggtggcgcactgtagtcccagctactggggaggctgaggcacgagaatcacttgaaccccggatggcggggactgcagtaagcgatcacgccactgcactcaagcctggcagacctagcgagactctgtctcaaaaaaaaagaaaacaaggctgggcgtggtggctcacgcctgtaatcccaacactttgggaggccaaggcgggtggatcgccaggtcaggagattgagaacatcctggccaacatggtgaaaccctgtctccaccaaaaatacaaaaattagccagatgtggtgccaggtgcttgtagtcccagctactcaggaggctgaggcaggagaatcacttgaacctgagaggcggaggatgcagtgagctgagattgcgccactgcactccagcttgggcgacagagtgagactctgtctcaaaaaaaaaaaaaaaaaaaaaaaaaaaaaaaccaagggccgggcgcggtggctcacgcctgtaatcccagcaatttgggaggccgaggcaggcggatcatgaggtcaggagatcgagaccatcctggctaacacggtgaaaccctgtctctactaaaaatacaaaaaaattagctgggcgtggtggcgggcgcctgtagtcccagctacttgggaggctgaggcaggagaatggcgtgaacccgggaggcggagcttgcagtgagccaagattgtgccactgcactccagcctgggcaacagagcaagactccatctcaaaaaacaaacaaacaaacaacaacaacaaaataaaacaaggaaaaaaacactaaaaccttggatgtcctgggcaaccccggtcaagatgatcactctagatagagtttttaaaaattagttttcagcctggccaagatggtgaaaccctgtctctactaaggatacaaaaaattagctgggcttcgtagcaggcacctgtaatcccagctacttgggaggctgaggcaggagaatcacttgaacccgggaggcagaggttgcagtgagccgagatgtcaccacagcactccagtctgggcaacagggcgagactccatctcaaaaaaaaaaaattagttttgccaccgggcacggtggctcatgcctgtaatcccagcactttgggaggccgaggtaggtggatcacctgaggtcaggagttcgagaccagcctggccaacgtggtgaaaccctgtctctactaaaaatacaaaaattagccaggcatggtggggtacgcttgtaatcccagctactggggaagctgaggtgggagaattgcgtgaacccgggagacagaggttgcagtgagccgagatggcaccactgcactccagcctggccaacaagggctaaattctatcccccccccctcaaaaaaaacaataacgattttgggagtattagagcagaaaacgtttgaaaacatgaacagctctcacatcaacacaagacatgaaactctgttggcaagagaggcctctttggggagagtgctcactcctctcccacccactctctaccaccttcaacctcctgtctggggcacagtaacaaggggtgtaaggggtgtacagtgcctagcaggggcctggcacttaggcttcagtaggtgccagtccacagtctcctgaggcccatgttggttggtgtccacctggtgcttattgaccacttgggctccagattttcctcacgtcacctccctccccagggtagcagataaaggccccatagttccaaggaggcagaacttttacattcctaaaagcattctcaggcccccataacccctcatcccaccttcagctcgctcaccttcacctatcaaattcgtttgacatctggcctccagcaactagctaggctgagttctccatgaaggggacgtggctgctggtcaaaagggaaagcccatgtctaaaaattaattaacgtggtttaggggcctcacattcccaacccccaaatacagccattgtgagatgtgagattcaaaaaatcgaagagtgaagcggtgatgagagtccatctggtcgctcttcggatgcggcgctagcaggcagttgcatgaaagcagatcccagatcacgttgcactggcacacagtaggtacccacacatatttgataaataaacactctctccctagcattactatagatagctggcagcttggcctggcatcccggaggggtctggatctcagggactagataaggccagcacactgaagagttgcagaaaatgcaggcggtcaggcgcaggtctgctgcgggagcacctgccgtgtccgacagctgcactggaagaggggcgtgtgtctcccagccgggcggaaccgagaccgcttcgtccccggcggggaacttcatttcccacaagcctgtgcgcgagactccatttcccacaagccctccttcacttccggctcggccgaggcactgcggacggcttccgggtttgggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatgtgagtagtggtcggggcagggggctggattgtgggaccttcctccttagcgtggcgggcgaggccagggccggacccgtgagaaacctacggcgccgggagacagaaggcgccggggacttgcgtgggtcccagggctcgggcccccccgtctgtcccctccgttcccgacatggactgctcgtttgctttcctggggccgagctctgcaaaccaacgagccctggcttatgaatcatcgtcttgagctttctcattcgtcatttgtgtgctttgggtgcagactttcccccgctttttgaaccacactgaatagggaaagggagagaagcagccggctgtagtgggtttagcagggctgggtgcttcatggtttctcttccagaaaagcgcatcaacggtgaaagaaagtgatgggaggagggtggatgtaagatgagattgggaaggtagttgtttggggtgtgggcggtgggacggaggatctgagggtgaccccccgaaggaatgtggactttgccgaaggatggcaggaagccgctgtcaggaagcgatcgtcgtttctggaggagagcgtgaagagctggggtcagtggccccgctcagaggaactctagcccctcaccaccgactgcttgtttctgttagcagtttttttcatgcgcgtccgtgtgaagagaccaccaaacaggctttgtgtgagcaataaagctgtttatttcacctgggtgcaggtgggctgagtccgaaaagagagtcagcgaagggagataggggtggggtcgttttataggatttgggaaggtaatggaaaattagtcaattgttctctggtgggcagggatggatctcacaaagtacattctcaagggtggggagaattacaaagaaccttcttaagggtgggggagattacaaagtacattgatcagttagggtggggcaggaacaaatcacaatggtggaatgtcatcagttacggctgtttttacttcttttgtggatcttcagttacttcaggccatctggatgtatacgtgcaagtcacaggggatgcgatggcctggcctgggctcagaggcctgacagtttttaactgagcttattggcgtgttgtgctcgccacagatttgcctgagacacagcccctttcctgagggatggtaaaggaaccgtcacagcgcagtcttgtcagtctgtaatgtgtatactgcaggggtttcttgcgaagcggcggttaacttgagcagaccaggggcagtctagtgagtaggtgacgaataaattgagtcctagaaagacaagtaggagtgtgaatagccaccattccaagctgaggagttaggaaacatgagcatttactgcgtggagggaggatcttgtaggctgagagttctggggctcgaggagtaagagagcccaggagatgatggaatgagggtgagcaggtactagcactttagtgggggtgttgtgccaaggaattgagcctgtgtttggcatgtggcattctttggagtagtgaaatgccagtgttgggaatatgcctagagtccctgtccctggagatggatgcagggcagagaagagagaccagttaagctattaagagagtttgaacatttggagggagtagggaacctgtcctttttcatccttatattctcactgctagctcactgcctgccacattgctccgtaaaatgattgtggcatgacctagtcgggcgggagattataaaggcctgcattagacagtggtagaaactgaaagaggaagacagattccagaggagggggaacgtagacaattcttgatgactaactggatggaggggggtggggtgtggggtgaagcattgtggaaggaaggaagccgggctgaatgctgggaaacctttcagtacagtggaaagagtagggactgtagagttagtagctatgggctttgggaagaatagccttgggatatttctggggatattgcacaatcagtgaacagtgttttactgataaaatatagttatctgtaggtgaaaacttgagagatatcccacttcagggttcctgcaagaaaagtccccagggcaagggttcttctctgggaaagcccagaattaagaactggaagggtgagttgtcatcaaagaaaatgggggtaggggaagtgttaagagggctgggagggtgattgaagagtttatgggtgttgagtgactggatacttcataactcagctttattttgcttccgggagaattgagttctttatttttttcgatattgctgtttgtgtgtttttctgttgccgctctaacaaattaccacaagtttagcatcttaaaacaacacacctttagccaggtgtggtggctcacgcctgtaatcccagcactttgggagactgaggcaggcggatcacgaggtcaagagactgagacccatcctggccaacacggtgaaaccctatctctactaaaaatccaaaaattagctgggtgtgatggcgcacacctgtagtcccagctactcaagagtctgaggcaggagaattgcttgaacccgggaggcggaggttgcagtgagccgagatcgcaccactgctatcccgcctagtgacagagcgagactccatctcaaaaacaaacaaacaaaaaacacacatttatcatttggtagtttctgtaggtcagaggtccaagtaggttccactaggtctcctgctatcaaggcctatcaaggctgaaatcaagacgttggcagggtgcatttcttactgaatgccttggggtggaacttgcttgcaagcccatttatgctgttggccatattcagttccttgagcttgtaggactgaggtgccctctttccttactggctgttagccaggagtcagtctttgttcccagaagctgcccgaattccttctcatgctttttatgtgtctccctccagcgagggccagttcttctgccacatctctctgatttcagctagagaaaatatcctgcttttcagggctcagattagatttagtgcacacagagaagccaggataatctctttattttaaagtttgtaattttaattacatctgcagaattccttttgacatgtaatgtagcatattcacaagttctagggattaggcacgagatgggcattctcctaccacagccgggaagagcagtttcagaggttgccttccctaggtgatgtgggtgttctcagttctcaaatttgtctgttttctctctagggttcactttctctctagggttcacgttgaaagtcgtgattcttggtgccttgatttattgtgctcatagggttaaaaaaagatttgcattagaattctagacatacctttaactcttaacttcctcccatgtttttacactgttgtttaaatttggccattttgggaaatgctttatacccaagtaatttatagttgatgaagggatagagaaagtgtcttgcttgtggcaccgtgactcacacctgtaatcccagcaccctgggaggctgagatctgggactacttgagtccaggagtttgagaccagcctaggtaacataaacaaatacaacaatcagctgggtgtggtggcgtgcactcgtagtcccagctactctggaggctgaggtggggggatcgcttgagcctgggaggtcgaggctgcagtgagctacgttcacaccactgcactccaacctgggccacagagcaagacccttctcaaaaaaagaaaaaaaaaaagcattctgagttttgacagagaagaaaacatttgatggttacttatctgtctctaccaagagcctagggaacaatgccccagagcatgagctggtatatagtctagtctcctggctcccactgagaaaaagggattttgagttgaggctggctatgactagacagccattgcagggactctccagttcagcctcttagccctccactgcctccacctcatctgggcccattctgggctgtggtctcctgctctcttcccagtcccatccttcttcccccaacagcacaagtgagggtgaggcctaaagtgtagccactgccctgctgcagaacaatcagtgacttttcttagcattagaataaaactccagatgtcccaccctcccagcccctcaccctgacctggtatagtcatctcttctcctacccccaccgtgttctgacctctctggtctttcagcttcttgaacattctaagctttttttttttttttttggagacaagatcttgctctgtggcccaggttagagtgcagtggtacgatgatagctcactgcagccttgacctcccagggtcaaacgatcctcccactgtagccttctgagtagctgggactacaggcacacaccaccacgcctgactgatttttatattttttgtagagatgaggtttcaccatgttgcccagactggtcttgaactcctgggttcagatgatcctccctactagccttccaaagcactgggattacagatgtgagctactatgcctggcccctgagctctttctttttaaccaatttattatcaagtgtttaaggtattgaaaaatgagtagactcctccccaccactgtattcatgactagctccttcttttaggtgtctgctcagtatcagatactcagaggatccttccctgcttgatctaaagttggtcaccgcctctgatatgttttatctcagccctttttagtttcccataggacctcatacctatgaagcttggtacctggtatacaaaacacttgttgaggagtggaatagtattttcttgggggctgtgtgagtcacctcttttttttttttttttttttttgaggtggagtctcgctctgttgcccaggctggagtgcagtgtcacaatctcagctcactgcaagctccgcctcccaggttcacgccattctcctgcctcagcctcctgagtagctgggactacaggcgcccgccaccacgcccagctaattttttttttttttgagacagagtctcactctggagtgcaatggtgtgatctcggttccttcaacctctgcctcccgggttcaagcgattctcctgcctcagcctcccgaatagctggggttacaggcatgcgccaccaggcccagctaatttttgtatttttagtagagacggggtttcaccatgttggtcaggctggtctcgaactcctgacctcgtgatccacccgcctcggcctcccaaagtgctgagattacagacatgagccaccacgcccggccgggtcacctcttgtattacagtggtattctttatttttttatttttttaagagacagggtcttgctttgtcacttgggctggagtgcagttggtatgatcatagctcactgcagcctcaaactcctggactcaagtgattctccagtgcagtggtattctttacctgaaccagtgtacattgtgaagctctggagcccctgctttctccacttgttacacttgttagcctttctttttctttctttttttttttttttgagacggagtctcgccctgtggcccaggctggagtgcattggtgcgatctcagctcactgcaacctctgcctcccgggttcaagcagttctctgcctcagcctccagagtagctgggattacaggcacccgccaccactcctggctaatttttgtatttttagtagagacggggtttcaccatcttggtcaggctggtcttgaactcccaacctcatgacccacctgcctcggcctcccaaagtgttgggattacaggcgtgagccactgcacctggcctagcctttcttaatcgtgtccctcatcaatgaaatggtagaaagccaatctgttttacaggtgtggtagaagggaaaaatgaagagacctctgtacaagcctttgcagaggtcttgggactcagtggtgagctccctgccaccacctcctgtgcccttgcaggagtaggagatctatagtcttggagaataagggtgataccccaataccccaagcctggttagggaaattgatgacccttattggagcctgtggggaggtagttgggaaattgttagtagcttcatgttggcattttcttttttgaaacagaatcttgctctctcctccaggttggagtgcagtggcatgatcttggcccactgcaacctctggctcccaggcttaagcgatcctcccacctcagcattcccaagtagctggtactacagacgcatgccaccaggcccagctaatttttgtattttgtgtaagagacagggtttcaccatgtctcccaggctggtcttgatctcctgggctcaagtgatccacctgcctcagcctcccaaagggctaggattacaggtgtgagccaccgtgcttgcctttgttgactctttattgaacatctactctccctgcagaaactgcaggataagccacccttagaaccaatttaactggcctttttggggcttggaccttcctcatgggattgctgggttaatgttgagcctgtctctgggctataggctctcagagaacaagagtgcatctgcaatgactagtgctgcacctgtcatacaggtttgtagaaaatatttaagctgtgaatgaacaaaaggaccttatcagctattttctttcaattctttttggtttttctgtgatcctattcttgagacttttatccctcccacccctctgtacagcagattgcacatataaagatgaaataaatagatgtccattgggcaaaacaatacagagaggaggtgacacagctggggaaggacagtccagtatctgatgaagtgccagaaggggcttagggggagcatggaatggagctggaactgccaggtcagccacctcttctagtgaagcctccagagagacgtgagctccaagtaagacaacacaaggaacaaaacatacaactgaacagcaacttccaagggtctggagaggtcttcagaaggatagggagtgcccttaaacttgcaagcccagattctgcctgtgggtcatggtcgtgccataggcagaagccagtgagtcagccttggcggagctttttctgtggcttttcccactcacagctctgtgcccttctggtgcagctccagcccttgttttccagcttcatagcctggttgtcacataaatggctgcactggcttacaggtgtctgtgtataacctattgctagaatgtccattccttgaggctaggggccctgtctgtccctctcttcactttcatagccccagtgccccatagggctgctcctgatgggcaaataggaagtggttgttgagcctctaggccagtcgtgacagtgacctgaggggacttgagccctcagtcatctgctcaggagttcagggctttctcaacagcagctgacgtgcggcaggcatgctatgccaagccctgttgcaggagttgacagatgttgactcatcccctcttcatgctttctttgtcagtagatgtacatgttactcacatttataagatgaggaaaatgagacctagaggagaggccactgctgcttagagttactctacatgttgtaaatcaggggtgtccagtcttttggcttccctgggccatgtaggaagaagaattgttttgggccacacataagatacactaacactaatgatagctgacgagctaaaaaaaaaaaattgccaaaaaatctcataataaagtttacgaaggctgggcgtagtggctcacgcctataatcctagcactttgggaggctaaggtgggtggattgcttgaggtcaggagtttgagaccagtctgggcaacatggtgaaaccccatttctactaaaaatacaaaaattagctgggcatggtggcgggcacctgtagtcccggtggggaggctgaggcaggagaatcgcttaaacccgggaggcagaggttgcaatgagccaaggtcgcgccactgcactccagcctggcgacagagtgagactcagtctcaaaaaaaaaaaatatatagaccaacctggccaagataataaaacctcgtctctactaaaaatacaaaaattagccaggcatagtggtgcacacctgtagtcccagctacttgggaggctgaggtaggagaatcgcttgaacctgagaggcggaggttgcagtgagtcaagatcacgccacttcactctagccggtgacagagcaagactctgtctcaaaacaaacaaaaaaaattaaaaataaataagtaggttgggcgcggtggctcacacctgtaatcccagcactttgggaggctgaggcgggcggatcacctgaggtcaggagttctagaccagcctcaacatggagaaaccctgtctctactaaaaatacaaaattagctgggcatggtggtacatgcctgtaatcccagctactcaggaggctgaggcaggagaattgcttgaacctgggaggcggaggttgcagtgagccgagatcacgccattgcactccagcctgggcaacaagagcgaaactccgtctcaataaataataataataataataataataaataagtaaataaatgaatggttgctgaaccacagcaggacaagacagacaaaccccttttatttgtttttgttttttggaccctaacagcagaggaagagccagccagcaagccccttttgatctttggcctctgccaaccagtaccccccagaccttaacccccagccctaccaggtcccttttgtaagtgaccccacatgcctaccacagttgcaggccctgacatccaccctgaccagaggtcttccagctattactggtgtttgtgatgctgtggctgtggccagtcaaggacccatgctgggcatcccgaggtaggaaggaccatgaccacgtgattatctccctgccactatcatggcagggctgtggggtactagcctcctttaaagcattccttaggacagtaatttctgttaaatatctggagggcaaacattttaaggaattttaatgaatttttaaaaattcaaaatgaaaaatttaaatcataaaaccaaatagaagaaagacccctatgtccatatacgcaccactctgcttcagtgattatcaactcttgtctcatgtacttgacctccacacaattattattactattttttgagaaagggtcttgttatgttgcccaggctggagtgcagcagtacaatcatagctcactgcagccaactcctgggcttaagtgatcttcctgccttagcttcccaagtagctgggactaagggtaggcgccaccatgctggctaattttcttattttttttttttttggtagagaccaggtcttggtttgttgcccaggctggtcttgaactcttggcctcaagtgagcctcctgcctttgcctcccaaagtgttggattacaggcatgagccactacgcctggccatccccagttattttgatgcccagactgttttagtggctgcccactgtctgtggattctgttcttagtcttgatccttcgtgcagtgtctgcacctgcctgccagttccttgacctgtgctccatcataccaagctggcagtggatcctcagacaatctcagttcttactccctgctctgtgtccagtttgtttgcctacctaaaagatccttccttttcgtggctgagcagtgcagccgttctccaaggagactgggccttctgctgcccccaccaccctgctcttttcactgcccccaccccgctgctcttttcacaggcttggtgaggagtttccaggttgcacttggtttgtttgaaggcttatctcctcctagtctgaactcgtcagggcaggagcttgaatcaatcatttcctgcctctcaggactgctgtagcagggggattcctagatctgtccagtgccagtttcctgagtactgctgcaggcccatttcagctgctatggtgatgggggctgtcctgaggggacattcacctcaggtagagatggcagaaacaccacaggaagatgcaaccagtcagctcagctgggggcacttaaattagatccattttttttctggaaggccttttggcaatactgtttatcccagtaccttaaaaatgtcgatttcctccaagggcgcaatcaggaaagtattcaaagcctgatggtgatgagggtgctcattgccgcatcattgtctcaggagtgggatttgtgaaacagaccaacagtgggagcttggttagagttgtagctgcaggtgatgggctctgtgctgctgttgacattgacgtgagggactgccataatgcgtcaacatcgacaagcgcttgttaccaagcaggatgcgtggtacaggctgagttttattaaacagatgtctttaactggtatgaatgattttaattttttctttgtttgagatggagtctcgccctgtcgcccaggcttgcgtgcctggtgacttctctcacctgggccctcaatgccagaccagccttcccaggatgattccatcctttccatccctgcaagggagcttgaggccctttccctttcagtttgatactgtccttccaagttacctttcttcatgttggcacgagagctttgtgccacaccatgccctttctggatgctgtagtgtctggctcttcctctgtctctgtgaccctcttccctggtgaagctttgaccttggcttcatcccctccagatgacccctgatggttagctcagcctgtggtggctccagagccctcattgagtgcatcctgacacgaactgaacagattaactattttttgccttgccaacagcattggaaattccttgagtgtgggacctggactcatagctctatgtctcttatagttcttagcacaatatcttggcctagatgaagtacataataattatatgtagggttgtggaaagcagtgctggctttaattaaagcctgccatggttttgtccatcagtgctgcctaaaccgttctgaacttctcattttgaacttttttccctcacagcttgtgatggttgattttctttttgagacattcatttatttgtttgtttatttggcagggtctcactctgtcactcaggctgaagtgcagtggcgtgattgtggctcactgcaacctccacctcctgggctcaagcgatcctcccacgtcagcctcccaagtagctgggaccacaggtgtgtgcctccatgcccggctaatttgtgtaattttttgtagagtaagggttttgccatgttgtccaggctggtctccaactcctgggctcaagcgatctgctgcctccgcctcccaaagtgctgggattacaggtgtgagccactgtgcctggccctgagacatttatttaaagacaaaggggagtacaggctagagaacagaggggaatagaatagcagccaaggcataattacctctaaaccatcaccccataagggagatgttcgcctcaactttagtaatgactctctttctagtctaggtgcagggctgttaatagaggccctgtgattgggttaagggcttgaggtacaataactctgttatttagggcagtgagtccttggagaagatgctttaccttctttccaagccccatgtctccttattttgagggtgtttttttttttttttcttgagacagtcttgctctgttgcccaggctggagtgcagtggcctgacctcggctcactggcctgaccttggctcactgcaacctccgccttccgagttcaagtgattcttgtgcctcagccttctgagtggctgggattacaggcctgcaccaccacacctggctaatttttgtatttttattagagatggggcttcaccatattggccaagctggtctcaaacttctgacctcaggtgatctgcctgccgcatcctcccacagtgctgggattacaggcgtgagccattgcatccggcctgaggtttttattttgagaatatttcaaatgtacagagagttgcaaggacagtaaaagcactcaggcatcctcttccctgggattcaccagctcattctcacttttaccatcttcccatactccctgggggcctcctccttctgggcttcgtttccttttatttgtttctgtctttttaattttaatttttttttaactagcccttctctttggcaggatttgttcacttttaatccttggccccagcagcttctctgagctctgcctatgaatctgggggagagataggggctcacacaagagtgaagtgtgagctggagggctgaaggggaatgagggacatctgggccaaaggcaggggaccagcaaggcccccacccctggaacttctgttcttcccagcctacgtaccccttgcttcttcttatgttggtgggctctgggggctgggtgaaagcagtgcttgtaggttaagaagtgactcatcccacgtgcccgctgcccttctcttctgttctttgctctttccaagcttcctttcagtcctcctcatcagacatgacctttgaggaagtgatgagtctgctatgtgtgagacagagcccctgttgtgaagtagaactcagggttcgtcctcagaagcctcggtgggtcaccatacgtcctgcaagtgctgtcagtctgctttgattcgtgtgagggagaagtccctgccaagtgctctgtagtaggcattcaggccaaccaaagaacagggcagggtcctgaggcacaggctcagagctcttgcttatttcatggggtgtttaaattgaggtataatccctatcacagtgaacgacacgcatacttccaatcttgagtgtgccaccagagaactgttgatactccccagatctgcacccagccagggcaaactgtgcaccactcttctgacttccatggccagccgagacatttggaatctctgtgcaatcacactctgtgccatctttttttcgagacagggtctcgccctgttgcccagggtagagtgcagtggtacaatctcggctaactgcagtctcgacctcctgtgggctcaagcaatcttcccacctcagcctcccaagtagctggtactacaggtgctcaccaccatgccctgctaatttttgtgttttttgtagagatggggttttgccatgtttcccaggctggtctcgaactcctgggctcaagcaatccacctgcttcagcctcccagagtgctgggattacagtcctctgtgcaattgtgtgcatcatgtgtgaaatttatcctcatttatcctcacaggcagcagttgttctattttttttttttttttttttttttttgagatggagtctcactctgttacccaggctggagtgcagtagcacaatcttggctccctgcaacctctgcctcctaggttccggcagttctcctgcctcagcctcccgattagctgggattacaggcacgtaccaccatgcctagctaatttttatatttttagtagagactgggttttgccatgttggccaggctggtctcgaactcctgacctcaggggatccacccacctcggcctcccaaagtgctgggattacaggcatgagccaccatgcccagcctgtgtttttgttttttttgagactgagtctcactctgtcgcctaggctggagtacagtggcgtgatcttggctcactgcaagctctgcctcccgggttcacaccattctcctgagtagctgggactacaggcgcccatcaccacacccggctaattttttttttttttttgtattttttttagtagagatggggtttcaccatgttagccaggatggtctccatctcctgaccccgtgatccccctacctcggcctcccaaaatgctgggattacaggcgtgagccactgcgcctggccttatttatttatttatttatttatttatttatttatttatgtatttctgagacagagtctttctctgttgcctaggctggagtgtggtggctcaatctcacctcactgcagcctctgcctccagggttcacatgattctcccacctcggcctccagagtagctgggactacaggcgtgcaccaccatgcctggctaatttttgtatttttagtagagatggggtttcgccatgttgggcaggctggtgttgaactcctgacctgacctcaggtgatccacccgccttggcctcccaaaatactgggattataggcgtgagccaccgtgaccagcctgttcttgtttatgacgtgttattccatggaggactctgttccagataactcttttattttgtgcctaatgaactttggtgttagttccagatgttggctacatgaaggcaaccccaggaatggctttggtcatgtcttctggtaaatatatgcacttaattctctgggctgtgcacctagaagttaaataaaggactgggtcagaggatgtgtctcttagcatgttctgctgaacagtgttcccaagtggtaccagtttacgttcccaccagcaaaatgtgagggagttccacttgctggacatccttgccaacacctggtattgtcaaggaacctgtctgtaacaggcactctcgttgattttgaatgcacgctgaaatttactgggtgcagtgacagtaggaagggaaaggatgattaaaaaaagaaaaaaggaatggaaaggctgatctaggagggaggaagctcataaggaaataagtggtaggatttggtgattccatgtgtgaatgctcgtattccgtgtgcatgcgtatatgagcttgcaggagaaagggaggagggaggcactggtatgcactccaccagttctcctgccacagcctctctactgatctgagggctgggtgtaaggtgatgatgtggggagtgggtgtgggtgaaatttccaacagtcagtgggagatgggggaagcaaacctgggaagagcagcctgctgcaggagcaagtgggtgggccgtcctggaggctggatgaaacctgtctgcctaggtggggatggcagaagtggcagagcagagaactccagagcagggctgtggtgggcagagcagatgtgaaggaagactgtgggatgagaggatggggcacggtggagccccatcagcctccagtcacagcagccccggtcccgtctctccctcctgttttggtcagtaccttcaggacttgtgggtgtagtacttcgttccattccggataacattgtagaagactgaaaaacaggaaggtgttttccatactctctccagagctggctgttactgacatattgatatatttccaccagtcttgtgtgtgcttatagcttgatatgtatgcattttaaatatgtaaatatatatacacatgtatttttaaagtgaaactaggctgagactgtgagttcagttttgagttataggtttcccatggcttaggttgtgttctctccctggatggagtctggctgggacctgcatgctcacagcccaggttcacatgaggtgtggatcatgcacaatcatcccacgggcttgagataagcatttgacttcctttttttttaaaaaaaaagttcattatggactttttcaagtgttcccagaagtagagataatagaaaagtggtctcccaactactttgagagttagcaacatatggccagtgttgcttcacccacccttcctcatcacctcctggactattttaaatcacatcccagacaccagatgatttcaactgtgagtacttgagtgcagatctctaaaagatcgagcttccccacccccaccaaataccacagagccatgtgagatcagcatttgggttggcagatctcctccttgccacatgcttgcctggtggtgaatgggacactttcaggcgagacctaggggagccccaggccagcaccaggacagagatctcgaggcctttccaactctgctggttcttcagaagtcaaaccaacagattggagtatgtgaaggaagctcgtgtattcttctgaactagcttagacaacagtacacagtttgaagggcagcagccttttctgcaggttagttctttcaatgatcttgtttactgggagttgagagaccttgaggatagaggcaagaaagcgtcatcaagcagcccagaggggtgtacagtgtttgaagtctcctgtattggtatgattcgagattttcattctgcaggaccaaaatacccattcctacatgtgggtggagagttaaattctgaagtatatatttttatcttgttaaaaaaacacttttatgtttctttaaaaagtaaaagaaccagaatgtagaagtttcagtaaaggaaaaagttacagtttgtttgggatacagtttgacaaatgtgctcccagctgcctgagagatagagaggccagatgtttgctttggttacattgatgactgaacaatcggtatctcatcatttcctgccttagagatgaaagcacctgggcactggggcagtaaattggttgcaggattggaagaagtccaaggacagtgtgggatgccaccctgtagctgtctagagacctagtgaaggtcagaaggctgggtgagaacaagccctgcactgatggaggacagggaaggggcttttctggctgggagtgtggtgaggcatttgagctgcagccagaaggcacctctcagattggtggggcttggggtgggggtgggaggaactgctttgcctgtgccgttggcctcactcatcctgaggtcccttcaaactccatccatactctgactgtggggccacttgcagaaggaatatgtggcaggttttttttgttttgttttgttttttgttttgagacggagtctagctctgtcacccaggctggagtgcagtggcacgatctcggctgactgcaacctccgcctcccgggttcaggcgattctcctgcctcagcttttggagtcgctgggcttacaggcgcctgccaccatgcccagctaacttttgtaattttagtagagacgggatttagtagagacgggatttcgaactcctgacctcgtgatccgcctgccttggcctcccaaagtcctgggattataagtgtgagccactgttccctggcctgtggcaattttttgagacgctcctgggggtccaaattgctaatagaggagaaacttactgtccctgtgttgactgagacaggaaggtttagataggtgaaagtggtctgggcgcagttgctcacacctataatccagcactttgggaggccaaggtgggagaatcgcttgatgccaggagttcaagactagcttgggcaacatagtgagatcctgtctctataaaaaataattttaaaaaattagctaggcctgtagtcccagctactcgggagactgaggagggaggattgcttgagcctaggagtcggaggctgcagtgagctgattgcgccaccatactccaccctgggcaacacagagagcctgtctcaaaaacaaaagaaaggtgaacatgagtttttttgttttttttttgacatagttttgccctgtcccacaggcgtgggccaccacgcccagctaatttttgtatttttagtggagatggggtttcgccatgttggccaggctggtcttgaactcctggcctctcaagtgatccacccacctcggtctcccaaagttttgggattacagacatgagccattgagcctggccaaacatgacctttctctttttttttttttttttttttttgagacggagtttcactcttgttgcccaggctggagtacagtggcacgatctcagctcactgcaaactccacctcccgggttcaagtgattctcctgcctcagcctcctgagtagcagagattacaggcatgcaccaccacgcctggctaattttgtatttttagtagagacggggtttctccatgttggtcagggtggtctcaaactccccacctcaggtgatccacctatctcagcctcccgaagtgttgggattacaggtgtgagcccctgcacccggccacgtgacccttcttaatagctattgttcgctgagtatttctctacgacactctttatgtgcattttgtcatttaattttaattttaattttctttttttttttgagacagggtcttactctttcacccaggctgtagtgtagtggcacgattttggctcgctgcagcttccgcctcctgggctcaagaaatcctcccacctcagcccccgagtttctgggactacaggcatgcaccactatgactggctaagtttttgtattttttgtagagatggggtttcactatattgcccaggccaatcttgaatcttgaattcctgggctcaagcatgagccaccacactcggcctcatttaatttttaattactttaaattttatcaacataatatatcacataaactgtaaaaagacaagaaactactgtggttcccattctgccagttctccccagaggtagcaactgcctttacatctgagctttcttccggcatatacctctgattctaggtaataggcacatgctgcttttgcaacttggcgttttacaaattatgttggcttgctctgtagctcccttccatcgccattatctctgcttctcctccctcattcttccagtattctactttctgcataaatcggtaatgaatgtttacattttctgcctacacaaatgatattcacagctgagcatagtggtgtactgcaattgcttgttatttttttcctaggaaagaattgccttttcaacactatgcccagttttctgtgtatctattcttattcttcctttattttccggttgcctctcagtacagttatcttcaggctcagtgctagtgagctgtcagtttcagttcaaacccctggcctcaagtgatccatccacctcggcctcccaaaggaggtgggcggtgaccctcttggacctcccttctggaaccctctaggcagtggccgcaggtgtggtgtgacagccctcagcgtgcttgtctgcccagactgggactgttgtcttcctttgttgggtcccttgttttctatatcctgtgtctcatcctttgtgatttattccctcattctgccagcttcctgagaagggactcctgggaattaactttctggagaccatgccagtttgagtgcatctaggccccctggtgggacatgctaactggggaatttaaaatgatgttacactgcgctgcccttgtgctggcttgtgcttctgtctcctgaggtgctagctctcagcctcatatgacttgtcttgatccctaaacccaagtcctgctctacttgggaagttcctttgagtcatttcaggggaatctcactccctacacttcctgtgctggagtgtttaatgttcactctttgggcctctagttttatcttttatctcctgttttctatctcttttacttttagctctcctctctaagtgatttcctcaattttttctttgacctttcactgctaacatgcttttatttccaagaactccttctttttccttttttgtaatctgacttttccctttttatagcacccattcctgttaaatggatacaatgtagtataatatttatatatattataataaattctaccgttttttttgataaattttcactttattgcccaggctggaatgcagtgatgtgttcatggctcactatggcctcgaactcctgggctcaagtgatcctcccacctcagcctcccaagtagctgggactgcaggcatgcaccaccactcctggcaaatatttttgtttttcgtagagatgggatcttgtgatgttgcccaggctggtctcaaactcctgacttcagctggacgcagtggctcacacctgtaatcctagcacttttgggaggccgagggcaggcggatcacaaggtcaggagttcgagactagcctggtcaatatggtgaaaccccatctctactaaaaatcaaaaattagctgggcatggtggcgcgcgcctgtagtcccagctactcgggaggctgaggcagaagaatcacttgaacgtgggaggcagaggttgcagtgagccgagatcgtgccactggactccagcctgggcgacagagctagactccgtctcaaaaaaaaaaaaaaaaaaaatcaaactcctgacctcaagtcatcctctcgcctcagcctctgaaagtactgagattacaggtgcgaaccactgcacctggcctaataaattctacatttccttcttcttgctgaatttctgttaccgctaaattactcttttcttgtggggtctttattggccatgttatggcgtctggctgcccttggctggttgctcactctgagagggaccctccaaagcctaggagtctcttccagcacgtggagcttgtcgactgggaacttcattgaaggctcatctggctgcagattctgagtccttcctccagaacaatggtccccaacctttttagcaccagggaccggtttcacagaagacaatttttctacagaccggcagatgaggatggtttcaggatgaaattgttccacctcagatcatcaggcattagattctcataaggagcatgcgacctggatccctcacatgcacagtttacagtggggttcgtgctcctatgagaatctgatgccaccacttatctgacaggaggcagagctcaggcagtaatgcttgcacaccctctgctcacctactgctgtgaggcctggttcctaacagcccacagacctgtactggtctgtggcccagggcttggggaccctgccctagagcatggtcttccagacactgggctgtgggtgaagacctggctgccagcatgctgctcactgcgatggaggaggctgatgggccagtgggtctcggcagttagcgtgcatcgatctagtcacttagaccagagcacagatgaccacacaacccacctctctcagtgtcctacctgtgccttttcaactgggtgggttggccccctagtccagtgactatccgtttcatgcttttccagagagtaaacctcctgtggtcacctggtgctggagtagctacccacagtgtaaagttggggagtgagggatgcagggatatctttcaccctctgtcccagagcacttggtgcagcctggcctcaacctggcaaagacctagggctgtcactgggtgggcgcaccccctcctcactgttacttaggactctggtttcttggtcctcttgctgtgtacgttaccactgggccatcagctttccagcttctaaaaggctgttgaggccaccatttccattcttcctggtttttttttctgtggttttagtcaggttttaagatggaagggaattaaatgtgcaggctttgttcctcatttcaacttggaggttcatatctgttatttatttatttatttagagacagagtctcactctgttacccaggctggagtgcagtggtgctaccttggctcactgcaacctccacctccctggttcaagcgattctcttgcctcagcttcccaagtagctgggattatggccgcacaccaccatgcccagctaatttttatatttacgtatatatttttttgagacagagttttactcttgtcacccaggctggagtgcaatggcttgatcttggctcactgcaaccttcacctcccaggttcaagtgattctcctgcctcggcctcccgagtaactgggattataatgcacgccaccatgcctggctaatttttgtatttttattttttatttttgagacagagtttcactcttgttgctcaggctggagtgcagtggtgggatcttggctcattgcaacctttgcctcccgggttcaagccatcctcctacctcagcctcccgagtagctgggattgcagcgcccaccaccttgcccttttgtatttttagtagggatggggtttcaccatgttggccagtctggtctcgaactccggacctcaggtgatccacctgccttggcctcccaaagtgctgggattacaggcgtgagccactgtgctcagctaatttttgtatttttagtagagacgtttcaccatgttggccaggctggtctcgaactcctgacctcaagtgatccacctacctccgcctcccagagtgctgggattacaggcgtgaaccaccacacctagtccaaatcttttttttaatatgggaaaatcttttttcctttatagtgtctgcttctggtgacatgcttaggaaaccatcatcctgatattgtataactctccttctgttgtcttgtggtcctctgtgatttaggtttttaaacacatagggtaaagggtcccacatacaagctgtgggctcctgtcccaggtgggcaagcaggctgcacacacaggcagcaatttactgggaggcttcttgggtggggtgaagtggagctgccaaaaatttattctgccctatgagagttcacttgattgatagatgttgtgtttctcaaaattagaaaattagaagaaactcacagaagtttccttcgagcagaacataaatcggctgagaggaatcatcctgcccccctgaggtcaggagggtgaatctgtgccccagggaggaacgcaccttcctgctttagacaccagcagaggacagagaagctggctgtcctgggaattcatgccctcattcagcaatgggaaagcagttggaccagggaagggggcctggcagtgtggcagggggagcagtggtaaagagggtggggtcaggggagaggcctcactgagaggggagagggtccttggtgggaaccagggcggttgtggaaggaagagtcagggcgtggagcagagcagagcgggagttggggtggggaggccagttcatgcctcatcaacatgcctgtgtgagtgtccttcttgcgggcggtggagctggcctcagggtacactgcaggtgactcagagctccaatgggagggtggctctgcctgagggagctgcacatgctcattgggccatcgtctgctgaggagggggcaacaataacctcaacacatggcggaggtgttttgggatgcatcctattgcacatttgggcaggttgttgcctgacttatttctttaacgcatacctagcacttcctgtatgtccagtgccttataatattaactactatcatcctcagggctacccgtgaggtcggcactgtccccaccctttgtgcaaaggaaggatagggaggcgctgccagatgggttgagggcagaccggggcagcttgcctcaggcctccctggccttagcaggctttaagtttgatgccctgtgctccttccctaggaagctcagtttgccagttttttgctttatcttagtctcattcagattacaaggactgggactggactcctgttgccagtttctcaatttggaataggaaggaggtgaggaacaacaggcccatgctgggcagaagccctgcagaccaggccaacagtgggcctctcctcactgcctggccctgtctgtgcaccttcgtcctggccacagcctctcagagcccctcctttatgaagaggttacgctttaggggagggagtgcctctcccaagacccagagctggtgagtggctaggttggaatttgagcccaggtccctcctcccctgtctgcttcctgccaggcccagctgcctgccccagcacacgccttctcccaggcaccctggcctccactgccaggacgtgcctgtttgaggcctggattcccccatggctgccacgctgattctccgttctgcacgtcgtgtcccatcaaaatgcatgacagtaccactccttgtgttaaaaagagccagttattgtgcctggcagtgatgactgcccactgcacacaaaagtggacgccgttgtctctgctctcagggtgttcttagtatagtggggctggcacacagaaaccagagattcctccaggaagtgccacagacatgggtgaggtggctacagggtttctgtgcagccgacagcaggggtgcctgggtggaagcagggtgggaggccctaacaggcctgatgggatagtcaggcaatgtgccaggtagtaggtcatcatccctggggccctggggagagtgtgtggggcaggcgcaggagcaggctcctcagtgggctcctggacaggctgcctgctctgctggtgaggagcgaggctcaaagcaagcaggggcctgggttgcttcccacactcagtggcagttgctcactggcagtcatgtgacctggggagctggcgagggcgtgggggtaggaatgggaacgggagacagaggccctttgggaggaattgccacagatgcagtgggagttggggcaaagatttgaactttggagaattaaaggtggcagtcagaaagtgaagggagttcccaagtttctgggatgggcacttggtgctgggagatgaagacacgaagagcttttcttgatgtatccctgctggctgctcaggcagggtcgggcaatgccattaagacacactgtgttctgggaacagttctggacagtaaggacatcctcagaccccttagtgggggagctccaagggcctgtaatgatgaatcggtcccctgggaggcttcagtctaagctagataccagttgaaccctgactgagtacacagacatagctatggcaaccagctagaccatggccaaaggcagagcattggagcccagttcacagcaagggactgtgtgctctgagccggtaacagtccttgtgttcagaggtctggctggtcgcaaccagggagtggcccccagcccccttcctcagctagagcgagcaccacccaggcagccttgggttctttggtggccgcctcataggcctgtactgtttgtgaacctgttgcttatgttggacaggactgtggcaggacagccatcaagggtcttcccttgtgagctgacaccagtctgctctttgtcctcctctggctggacaggccctcgtcttcccggcttgcttgtgtgggggaagagctcactgtgacatgtgggttctctgttctttgtctcaggctgtgctccttactccatgttgggggctgtctccttgtgtgatagtttcctttcatttcgtgacagtggctcgaagggttttgttttcaggagacagagactgaggagtagccattcgggtctggctgctcaggaaggcatgctggggatggcagcagagcccagctcagggagatcagaagggggctttgggagcagccagtgctgttctgaaggtgggcctgggtcctgcctgcagcctcccgcagcgggtgtgttaggtctaagggaggaaggaaggggacttgacctcagcaggagtgtgaaatgggtaccctcctggagtcaatgtccaggcaggggatgcctctgaaaagcgccaggccagctggagaggaaagggcaggcatctgcagggaagtgtgggggattagctgcagagttcctgggttctttttcgctttgtctctattttgtgacacttgatcttcaaactagaaacaggagcaaagacattttcaaaaatacagttgtcagaactgcaaaaccacacagggtctgttactggccaccaaacctgctgggcctccctgggtggatgctgtgggagagatgtgggagtgacatggcacagtgctgctgttctgagcggtagccttgctggaggagcgccttgccggaggagcaccttgctccttggccccactctgaccctccgaagctcatgtggaactggacatttaccccaactcggtttcctggtgttggcctgtcaagacttgcctgtttctggcctccagcttggtccatgctcctcaggctctgagtagctgacggtgcccacagtgtccatgtcatctgtgacattacccaggacaggacagggcccgtctgccagtacatcccctggtgtatggtgccaccttgccttcagctcaccaagcatatttcttcaacctggtcatcccaccacctcagagctattgcactaagctgtgtttctagatcttgtctctctgactgtgccaggtgtctctgctgcaccaagacagtgtctgtctggggcctgccagtctgctgacactctcaaaaacggccagtagcagctcaaaaggactgcttttgtatcaaagcctggctttgctctctgatcgctgctggtgggcacagagcccatctgtgtaactggttgtcactccccagactcttctgcacccttcttcctctctgactcctggccacatctgccacccacagcctccccactccttacacagccagcctccaggccgtcctgcttggcctgcaaatgctcccctgctgtttctactgctcttccctgagtctccctattggtcccagtgctttgggaggccaaggtggaggatcacttaaggccaggagtttgagaccagcctgggcaacaaagcaagaccctgtctctacaaaaaaagtaaaaaataaaaaaattagccaggcgtggtggcgcatgcctgtagtcccagctatttgggaggctgaggtgagaggatacttgagcccaggagtttgaagctgcagtgagctgtgtttgccccactgcgctgcacctgtgagagagtgagacattgtctcaaaaaacaaaagaagaaaaagaaaaaaggaaggtgggaagaacaagtatgcctttgaagggcatacctgccttgaggggcacagatgaggcaaccttcagaaaacaggcctgtgcagccacttctatcagaaatgctcactgacttcttggggcctagcagctatcgtctcagcctctgggtgtggagaccctgccccatgctaacctgagagcatgagtacagggtcctcccagcccacccatgcctcgcttccccaggactctgacccagtgccgcgcgtgagttggttgtcattatcctcctggattgttaactctctcatcttttgtggccctggtgacctttcttacttgtctgttccacacctggatgccttgtgagcagaaaccccttgctgcctcctcgcctcccttcaggcttcaggaagcagacagggaggtaggaactccaagagtgcaggagtctcattctgtcgcccaggctggagtgcagtagtgccatcttggctcactgcaacctctgcctccagggttcaagcgattctcctgcctcagcctcccgagtagctgggaccacaggtgcctgccaccacacccgactaatttttgtatttttagtggagacagggtttcaccacgttagccaggctggtctcaaactcctgacctcaggtgatccacctgcctcggcctcccaaagtgctgggattacagacctgagccatcgtgcccagcccaagagtgctttttgaatctagcagggtggtaggtcaatgtcattttgtttttctttttacattaagacagatgtatgcacctctcagcattaaacctcctttctgtgatgtctttaagaatcacagtcatattgctgtagccccgtctgtacattccttcagtttcctgaggttggctggttgctgtttggagtggtcagaatgctttctagcacgagctggactgggcctattcaattcactcagaggcaaggccccagagccctgacatgtttgcttgtttcttttttcttttgctttctttcttttttttttttttgagacggagtctcgcactgttgcccaggctgaagtgcagtggcgcaatctccgctcactgccagctccgcctcccgggttcatgccattctcctgcctcagcctcccgagtagctgggactacaggcgcctgccaccatgcccagctaattttttgtatttttagtagagacagggtttcactgtgttagccaggatggtcgtgctcgcctgacctcgtgatctgcccgccttggcctcccaaagtgctgggactacaggcgtgagccaccgtgctcagcctgcttctttctttctttttttttttttttttttttttgagatggagtttcgctctgtcacccaggctggagtgcagtggcgcaatctcggctcactgcaacctccacctcccggttcaagcgattctcctgcctcagcctcctttgtagctgagattacaggcatgcgcaaccacaccctgctaattttgtatttttagtagagacagggtttcaccatgttggtcaggttggtcttgaactcctgacctcagatgatccacccgcctcggcctcccaaagtgttgggattacaggcgtgtggcactgcacctggccacttgtttctttatcagcaagcccagggtgggaggccaggcaaggaagagacccatcccactggcaagaaggcaggcagtgagcacaccagagcagtccacccctgggagccacaggccaggcctttctaacagattcacacttgtttttgtctttctgtgtgtgagtgtgggaggtgggggtgggggtgggtggggcagcatgtgctgcattcgaggggtctccaccttaactgatgtacatggctctttatccccgtggagcagcagtgtgatgaaaaactcttcataggattctatctcttagtacaaaattgttggtaaatgggtttttaaagatatttttcacatttatgtggtctttctcttcttgtctctagctagaagtgaagttggagcttgtctctttgatcccacatataggacctgcattgtcccacatagggacagacccttgccttgggagggactgagagatgacttcatgtggccccttcattttataggagtaatcgagtctagaaccagggtgctaccatctggcagagttcatggggaacgcaggccactcagagagcaggaaatagaggccagctggccacccagtagtctaatgcgtacttccttgatcctgaactggttgtgagccatccctaggggcaacccctcccccgccccgtcccttcatgccagggctctctctttgcttcatggcgaccacctttcctgtcccttttttctgatcaccctgctcagtggcctgtcattgctctctgttgagtgccccttcccatatgcctctcctggacctcagccaggctggtgtgctggcgatagcaccttgtcaccaggggcagctgctatgcagggcctgttggccagggccctgcagcggtggagtcactggtgtgtgcaaacgtctcttctccttttgtgtttcagcgaggatgccatgaggaaagctggtgtggcacacagtaaatccagcaaggatatggagagccatgttttcctgaaggccaagacccgggtaaggccctagtaagtggagccactctggcagagagacttggagaggagagcatcacagactctggaacccctctgttgggtgtcctagggtgtaggggtggggtggttgctcatcgattgatcacaggcacagttggttttgcctgcagcagtctgggtcctcctgtgtgtccatggtacagggagggcacttgggttgcaggcccagcctctggccccagacctcactgccgtcaccttccatctgtggtcagcccctgtgaatcctacaggaagcttgctcaggcccctagctggtcctgtggaagggatcaatgccgtgagcaagaacctggtttgtcctcagcccctcctaggggtccttacctaagccctacagggccctgaggcatgggcccagaagcattcctgtccccttttgctaagtgaagaaggtgatgcttatctagaactcgccacaggtggagtggagaagaaggatttccactatatgtgggctttctccctgggtggggcaccacactgagggctttatgtgaccacctcctttaatctgtgtgtgctccctgggacagaaccgttttactagaaatgaacaaaacacatattcacttgtgtgcacgtgtgtgtgcaaggcagagctgcaagagcacagggactgaggtggggtagagtgggctctgtactatggacacgtgtgactgaagtgggatagagtgggctctgtattatggatacgtgtcactgaggtggggtagagtgggctctgtactacggatacgtttgataagctttttctttttctttaagagctttatacggttcaccctttaaagtttacatttcagtggtctttaggatattcacagagttgtgtggccatcaccaaaatctaattttggaacattcattaataaataaaaagaggtgcagcttccctgtgttgcccaggctggtttcaaacttttggccctacgccatcctcttgcctaggcctcccaaagtgctggggtcacaggtgcgagccaccaagcctggcctaattttagaacttttttttttgagacagggtctcactctgtacccaggctggagtgcagtggcgtgatctcagcctgctgcagcctcaatctcccgggcttaggcgatcctcctttctcagtcttctgagtagctgggactacaggcatgtgccaccacacccggctaagttttttattttttgtggagacgaggtcccactatgttgcccaggctagtcttgaactcctgatctcaagctatccccacgccttgccctccctaaatgctgggattacaagtgtgagccaccatgcccagccttcaacattttttaaagaaactttatacctgttagcagtcacactcccttttccttcaaccctcagctaccacttatactttctactgctgtagatttgcctattcggaattttccatataaatataattgtacaacatatgggttttttttgtttgtgcgtgtgtgtgtgtgacagttttcctcttgtgcccaggttggagtgcagtggcacaatctcagctcactgcaacctccgcctaccaggttcaagcgattcttccgcctcagcctcccaagtagccaggattacaggtgcgcaccaccacacccgactaattttttgtatttttagtagagactgggtttcatcatgttggccaggctggtctcaaactcctgagctcaggtgatccgcccgcctcagcctcccaaagtgcagggattacaggcatgagccaccgcacccagccacgtacaatatatgtttttattttgcagctggcttatttcacttagcataatattttcaaggttcaaggtccatgaaccatgtttggtatatactttattcctcttttgttttttttagatggagtctcgctctgtcacccaggctggagtgcaatggcacgatctcggctcactgcaacctccacccactgggttcaagcaagtctcctgtctcagcctccttagtagctgggattacaggtgtgtgccaccatgcctggctaattttcgtatttttagtagagatgggttttgcattggtctggggctatgttggccaggctggtctcaaactcctgacctcaggtgatccacctgccttggcctcccaaagtactgggattacagacgtgagccaccgtgcctggccaactttattcctttttattgtcaaatattccatttctggatggccatatcacatattttatagccattcgttagttggtggacatttacatagtttctactttttggttattatgagtaagcagaacaatagttaatgtataaatttttgtgtgggctgtgttttcatttctcttgggtatatacctaggggtagagttgctgggtcataccctacctctgtatttgaccttttgaggaattgccagatgtttcccaaagcaactgtactattttaaattctcaccagcagcttaaatgaggtttcaatttctcctcatcctctccaatacttgttattgtctattttaattgtagccattataatgggtgtgatttgcattgttttgatctgcatttgcctagtgactaatgatgttgagcatctttttcatgtgctttttggccatttgtatattttctttggagtaatgtctattcagatcctctgtccatttttaaattgggttgttagtctttttattgttgggttgtaatagttctttatgcatttggatataagtctgttattaaatatataatttgcaaatatataggggggattttatttatttatttttatttttgtttttttgagacagtctcgctctgtcggccaggctggagtgcagtggaagtggagggatgcagggggtgttagtgatgcattgtaatcatcccggagagcaggacacctctcataagaggtttacccaaggggggctgtggaaagggctagaaattgctcctggaggacgtggaaagccacataaggtttttgacagattagggaaaaggctgtgccactctttctgaagatgacagtgtaggcagcctttccattttgtgccaaaaataaaattttaaatacataaatcacagtagtttctaggacaactgggtaactacatacaaaatattgaggttgagccccaacttcataccctatacaaaacttaactcaaaataaaaaacaccagccaggcatggtggcgcgtgcctgtagtcctgcctaatcgacaggctgaggctggagggtcacttgatcccaggagtttgagattacagtaagctatgattgtaccaacatgttccagcctgggtgacagagtgagactctgtctctaaaaaactttttaaaaaattaactcaaaatgggtcaaaaacctaaatttacaagctaaaactataaatatcttagaagaaagcagaggcgtacatcttcatgaccttggattaggcagtagtttcttagatatgatgccaaaaaagcacaagctacaaaaaacgtagataaatttgacttcatcaaaattaaaaacttgtacatcataggacactgtcataagagggaaaaacaacccatgggatgggagaaaatatttgcaaatcacatatcaggtaagggtttaatatccagaatacataaagaactcctacaactcaacaacaacaacaacaacaacaacaaaaagcaactaaaaaataggcaaaatacagccaggcgcggtggctcacacctgtaatcccagcactttgggaggccgaggtgggcagatcacgaggtcaggagattgagaccatcctggctaacatggtgaaaccctgtctctacttaaaatacaaaaaaaggaaaaaaaattagccaggcgtggtggtgggcgcctgtagtcccagctactcaggaggctgaggcaggagaatggcgtgaacccgggaggtggagcttgcagtgagccaagatcatgccactgcactccagactgggtgacagagtgagactccgtctcaaaaaataaatacataaataaaataaataaaaataaatgaaataaaaaataggcaaaatacttgaataaacctatctccaaagaagagatacaaatggccaacaaccatgtgaaaagatgctcaacatcactagtcattaggggattgcaaataaaaaccacaatgagatgccacttcatttccattataatggctatgatttttaaaaaagacaataataagcgttggcaaagatgtagagaaattggaattctctttctttttgagacagtctcgctctgtcgcccaggctagagtgcagtggcacaatctcgtctcactacagccttcgcctcccaaattccggtgattttcctgcctcagcctcctgggtagctgggactataggcacacaccatcacacccagctaattttttttttttttttttgagatggagtctcgctctgtcgccaggctagagtgcagtggcgggatctcggctcaacgcaacctccgcctcccaggttcaaacaattaccctgcctcagcctcccaagtagctgggactacaggcatgtgccaccatgcccagctaatttttgtatttttagtagagacagggtttcaccatgttggccaggatggtctcgatctcttgactttgtgatccacccacctaggcctcccaaagtgctgggattacaggtgtgagccgctgcacccagccaatgcccggctaacttttgtatttttagtagagacagggtctcatcatgttggccatgctggtcttgaactcctgacctcaggtggtctacccatcttggcctccccaaagtgctgggattacaggggtgagccaccgtgcctggcagagaaattagaattctcatacattgctggagagaatgtgaaatggtgctgtggaaaacagtatgacagttcatcaaaaaattgaatgtagagttaccatacgacccagaagtttcactcccaggtatatatccaagagaaaagaaaacatgtccacacaaaaatatatacacaaatgtttatagcatcattataacatcataaatagccaaaaatggaaacaacccaaatgtctaccagctgatgaatggataaacagaatgtagaatatccatacaatgaatatcatgtggccacacgaagcaatgaagggctgatacatgctacaacatggatgaagctaaaaacattacataaatgaagcagtcacaaaggatgacatgttgcatttttataaaatgtccagagaatacgaagatctatagagatagtgtattagtttcccatggctgccataacaagttaccataaagttggaggctcctatctctgggtccatggctctgacttctgagcccatgtctctgccctcactttcttaaagggtagcacatgtttgaggctgcgtagttttatcagcctattcctgcttctaaaattttgggagttcttctttgattttgcctagtctataaactttctactccaagctggcagtgtttctgctggtagaacattctcaaaatccttgtggaacttctacatatatgatggaattcatagtattagatgaggtttctccacagatctttcctagataatttcatctctcttcctcacttctgtgagatgattgaggggattcatgagtcccatgtttaatctctttggcactagaaaaatttggaagatatgccacacccttggcattctctacagaacacactttcctaacagtaaatctcctagttttagcattttggttttttccaatctaaatagcctgagaatttcccaaatcattaagtctagattcctttctgcttaacagttcttccctcaatttctctctcttctttgtgtgtgtgtgtgtgtgtgtgtgtgtgtgtgtgtgtgtgtatttttaaaattctttttattgtacccttaatttatctctttcatgttgcttttttttttttttttttttttttttggagacggagtctcactctctcgcccaggctggagtgcagtggcgtgatctcaggtcattgcaacctccgcctcctgggttcaggtgattatcctgcctcagcctcccaagtggctgggattataggtgcccaccaccacacccagctaatttttgtatttttagtagagacagggtttcaccatgttggccaggctggtcttgagctcctgacctcaagtgatctgcctgccttggcctcccaaagtgctgggattatagacgtgagccaccatgcccggcctcctcttgcattttactacaagcagaaagaagaaaccaagctgagtccttttttttatttttttgagactgagtctcactctgtcgcccaggctggagtgcagtagcgcgatctcggctcattgcaacccccacctcccaggttcaagtgattctcctgcctcagcctcccaagtagctgggattacaggtgcccaccaccacgcccggctaatttttgtatttttagtaaagatgggatttcaccatgttggccaggctggtcttgaactcctgacctcaggtgatctgcctgcctcagcctcccaaagtgctgggattataggcatgagtcactgtgcccggcccaagctgagtcttgaatgctttgattggaagtctgctcagctaaatgtgcaaacttattgcttatgattctgccttccacacagctacaggacacaatccagctaaactttttgccattatattacaaagatcacctttgctctagtttccagtaacatgttccttgtttcctttgtttctttagaatcacctttaattttcatgtttctaacaacattctgtttttgatagtatatgtattcttgaagataatacagactttctgtatcaagttcgtcatttcctttaaggcagagtctgggtgacagtctttaacatccgcatttctacccacagcctgttcaaggaaacctaggccttttctatcatgcttctcacaattctactagccctcctttgttattgagttacaaagccactgccatatttttaggcaccctactcctggtaacaaaattcgtatgtttcctgtggctgctataacacgttactacaagcttggtggcttaaaagaacagaaatttaggccgggtgcggtggctcacgcctgtaatcccagcactttgggaggctgaggcgggcagatcacaagatcaggagatcgcaaccatcctggctaacatggtgaaacccccgtctctactaaaaatacaaaacaactagccaggcgtggtggcgggcgcctggagtcccagctactcgggaggctgaggcaggagaatggctgaacccgggaggtggagcttgcagtgagccgagatcgcggcactgcacaccagcctgggtgacagagtgagactctgtctcaaaaaaacaaacaaacaaacaaatttaatctcacagttttcaaggccagatgttcaaagtcagtaccatgggtaaaaatcgcagtggcagcagggaggctataggagaggaacctgtttcttgcatcttttagcttttggtcactgctggtactccttggcttgtggctgtatcactccagtcttcaagtccagcatcacgaggtaaatacattctctgtattccatcttcacgtcgccttctctgtgtgtgtgaactttccttctgcctccctcttaggaggatacatgcaattgcacttggggtccacccgcataacccaggatagccctccatctcaagatgtttaacttcatcatatctgcaaagacctttttctcaaataaggtaacatttacaggttccagggaataggacctgatttaaggactgttatttagcctgccacagacagaaagttgattattgattgccaagggtgctgtagggaaatggagttttcatttggagtgaagatgatgttctaaaattaggccaggcacggtggcccatgcctgtaatcccaacactttggaggccaaggccagtggatcacttgaggccaagagtttgagaccagcctggccaacatggtgaaatcctgcctctactaaaaatacaaaaatcagtagggggtgacagcgcatacctgtagtcccagctacttgggagggtgaggcaggagaatcacttgaacccaggaagtggaggttgcagtgagctgagatggtgccacttcagcctgtgtgacagagcgagactccacctcaaaaaaaaaaaaaaaaaaaagaaacaaaatgctttaaaattgattttggtaatgctgcagaactctgaatgtagtaccaaaaaccattgaatggcatgttttaaatgggtgaattgtatctcagccagcctattacatatatttttaatggaacgagtgaaaatgatgaataacaggtctgttttcccttggtggccaggtcagggccgtgtggtttccttgggtggggggcactgctggggctgccttgtccctacttggtttctgatggtgtgtcctgtgggctggggccaaggtcccatggggctatggatactatcatggaaccactctttctggaatttgatggtatttcaaaatctattaggaaaactctgagacatgaaagcacagaggcgtcatattcctctaatctggagtcagcagttgctgtggtttggtgacttttcccttggctgtctctgtgtccctcctgaagtgtcgagggcacatccccaccctcagggttgtatctctgctgagcatctccacactggcctgtgctagggccccacctgacaatcacatggagtcactattgtcatcaatgggaaggcctctttcaagtttcaacgcttttttcctaatagttggcttctttgaatcaggatccaaacgagggtcttttctcccctctggcccctcccagcctggtgaaggagcagcccagctgtcctgcagccctccccatgggctctgatgtctcccaagctgctgattcatcctgcctgccccctccttcttatgaactgggtgctaaatcggagagcagagagggtgccgtggtcttttagcaaaaatatatccgaagtattgccttaatttgtatttctgggcatcttgatattcccataagaccacaatttggaggtttggagagcaacaacagcctgacccttgtaaagctcctattatctttccgatggtttcatcatttaattagggcttgtagactaattctggcttttctcccacattcgttacatggagttttttttgtttttttttttttgtcaagaaaggttttctttcgtcagccagggctagatgattgtttgaaaccctgtgtgttcaggacctccaggaatgctgtttttctgatctttccagtctaaggagtccccccaagggccacagatgggttctctttgagtgacattttgagctcagggctgtgtatctggggtgttctggtccattgctgtcattcattttgatgcttagatggtcccatcctcatctagcaggagctcctgtgtctcttggggccctcacacaacctctttagtttttcttagtctgctggcatttagacccagattggctgctcctctagggagtgaaccctggggacttctgccggtaaagtggcatttggagcatgctacgtgggcgctggtctgttcattgctttgggcctttcagtgaacagaactaagaaaaaacatgtttttgaaataacagcaacaacaaaaacccataattttacactaatatttctaattcaaatttaaacttatatatagggtttttacttctttcattttaaacatgtgtcttttctgttactatgaatatcttggtttctaatattattagcatacttggttgctttactttaaaatcatttcagaataaacagtttatattaccactgataacaaaaggtagactaaacatttaagattaccttgaagttctaattgtccttaaaatgtatcccttttattgagaacattttgctttttgtttcatttttttaaaaagcctctcaaaagatttcttttctctatatgattctgccaccaacttaatattcagctcatttgttttagtttatttggaatgtttaggaattggacctttttctttagatttgctatacttttcattttagaaaaatattttaggctggctacagtgactcacacctgtaatcccaacacttttggaggttggggactgagcaaaagacaagccggccaacatggcaaaaccgtgtctctccaaaaaatacaaaaaattggccaggcgtggtggctcacgcttgtaatgtcagcactttgggaggctgaggtgggcggatcagaaggtcaggagatcgagaccatcctggctaacacagtgaaaccccgtctccactaaaaaatacaaaaaattagccagacgtggtggcaggcgcctgtagtgccagctacttgggaggctgaggcaggagaatagcttgcaccacccgggaggcggagcttgcagtgaactgagattgcaccactgcactccagcttgggccacagagtgagactccatctaaaaaataaaaataaataaataaataaattagctggacatggtactgcatgcatgtagtcccagctgctcaggaggctgaggtggggaggctcacttgagcccaggaagttgaaactgcagtgagcgatgatcgcgtcactgcactccagccagggcgacagagtgagaccccatctcaaaaaatatatatattttttagagaaataaaattcactgagttgcccctgagttgcccaggctgaactcctgggtgtaagcaatactcctactttatccttccaagtagctgggattacaagactgtgccactgtgcctagctttgatttgttttttttgttttttgttttttgttttgagacagagttttcactcttgttgcccaggctggagtgcagtggcgtgatcgcggctcactgcaacctctgcctcctgggttcaagcaattctcctgcctcagcctcccaagtagctgggattaccggcatgcgccaccaggcctggctaattttttttgtatttttagtagagatggagtttcaccatgttggccaggctggtcttgaattcctgtcctcaggtgatcctcctgtcttggcctcccaaagtgctgggattacaggtgtgagccaaggtgcccgacttgatttggctttatcttctcaatagtaaaagatttatgtgcttctgaagtgaaaacccataacactgtggatttagagagggcacatttccagcccagttcctgatacttgctgggttgtcgattttcaattttggtgtatctttccagtgtttctcatggcagatttaagcaaatatgtgtgtttacgttccacaggtcttatataaaaggtgtatgtcatgcagtgtatgtggcacggagcacgtgtttctatcctttctccttccttgtgttcactccacaatatgttgtgaggcacttgtgcaagatttccacatgtcaagcaagtgtggaaattctatgaagcttttaactttttgaggtggggtctcactctgtcgcccaagctggagtgcagtggagtggtcacagctcattgcagcattgatctcccaggctcaagcctcagcctcccactttgaggccactggcgtgtgctaccacaccagggtaatgtttgtttgtttgtttgttttgtagagatggtgtcttactatgttgcccaggctggtcttaaactcctggcctcaagggaccctcctgccttggcttcccaaaatgttggaataatagatgtgagcctccacgattggcctctatggagttttttaaggtttctgttttcttatctgtaaactggatgtgttagtagtacctgcctctgggtggttgggagaaatcaaggcgataatgcatgtgaattgatgactcctgtgtctggcactgtaaagtgccaagtgctagctgttactgtcatgatgttcattgtttatggtttgtaatactcagcctcaggtacagctggacacttatattttgatagccagcaggggagctggagcagaccaagtgaagatagggagtttcctgactctttagcccttttttctgcagcagttctaggggagttggtgtgctttggagcagaaaggggcataataatctgtccatctggatgggggtgggggtggatggtgaggagtcaggagtgaaagagcccagccagggggatcagaggcgcagtttcagatccagggctttctcccctggaaaggagttgttgtggttgacccattgcgttcagcccctagatgttcctagataaacctgcctttgggggaatgtaggaagtatcatcgcccacaagaaagctccttggctggcagcatgacagcttcctgtgcttgtttctcacatcaggcgtcccctccctccccgctccccactaagcctcctcacgctggtctggtagcagagctggagcagatggcagtggctgcgcctactgtgggtcaggagtggtgctgggcactgcaggatgatgatgcctgcccactgcattccaggtgctgggctggcagtgggtcttgctcagccctggtgttatgcagaagggctttggtgacatggtcctgagccttgtttgagtgtcttatgtctaagtaaaagtatcttgttgcttttgaaacctacttccccttgttttaccttttatggatgtggagaaaacaaattcatttaaagtatcgcagacctaaaaaatggtccagggccttaggagctgtgaggtgttgacctggctggcccccaggcccttctcccctcatacatggccaccttgcttctgttcctgagtgtcctcaggttcccacacctccattgcccccattctcataccactgtccttcagggacaggctgcctgtgggcccccttcacacgcacatcagctttcctatcagtaattgatggggatagccggaagctgggcgtgttgacagaactgccttggtgtccccttgttctggccaggcctcgctgcttatcccagcttttcctctcccctgggcctttcttcttcatgttgtcctgtgctaattccccgagctgaaaaaaagaagtggggtagagtttggagatagatgtgggatgataaagatttcaaaagtgtctttgtatttttacactcatctgagaccacttttcatcatccttccctctgccctgccatcttatgagtgtagtggatggactctgagtgtcacagtgactcaggaggaaggttgggtgagcagggcacggagccggggctttgccccttccaggctgccctgccagaaggatgggcacttcagcagaagacaaggatgcttctctgaaataagactttacctcagacatccgtgtattgaccacaagaccaactcacagtagtgatttccctgaaacacttgggagtgagtgtccttggggccaaagaggacaatgggtgggaggcagcccctgccagacaatctcagaaacacagcagcttgcatatagcgggccttggcagccagtggccttcacctcacctgagagtgggcttcaccctctgccttgcctgtgcgtaaatggagatgaacacagattctcccggaaagcgcagccaggggagggccgcccagattttcagcagatactgcgtcatcagtgaaaaggcagcaacaggctgggctgagaaatgaaagcccttctttacagatagtgcaaagacacagcggcccacccacggctgcctctgacaggccttgtgccctcaggccagcgcctcatcacccccaacctgcctgtcccctttgtgatgaagagagggcactcaagatggctcccagctctctcagctgagtgcctttccatcaggggagaggagtggccgttggaggctctctgtccccttcttgtttctttgtgcctgttattggccagcctagctgagcactgacggctctcttccgagaggcggattccagaggaggccgagcaagcgtctgaatctgccttgcaggatgggcttcagctcggtgccagcaggcgagggggcgggaagggggagtccgatgactgcgcttcttcatctggtattaaactgcttcctgtttttacttttaggacgaatacctttctctcgtggccaggctcattatccattttcgagacattcgtaagtaagattttgcatttctgggttgttgagatctctgtgagaggccagccctgacgctgcctcggcagagctttctgggcaggccgtggtgcctgagtcagaaggtctgtgtcacctcacttgcttctgggaagttcttcactgccttgcatttgactccagatccctccatcctcccagagccttggcctcaaaaatgctgattctagcatcatggaaatgctgtcctcaaagtggtctaaacgggttgctgcttcacttgctcacttaatctcccttttcatagggctgttgtttttacttctgggaagttctgtttaccctggaacagaaactctcttccctaaaagttgattttattgacccatggaggccagagacacttaggcatattttccctccagactagaagcttctgaggaggacctcctgagtctgcaccctggctccctgctgtgctgagggcccccgtgttaacctcacgttgtgcctcctctgattcagagggcccagtgtggttctgtcagccaggcagtggccccagctctacagaaatgagttgtcattgcatcctagggccagggtcttcgtgcttgtgtgtgttacgtggaagtatgtggacaccaagtgttcctggatggccacagcctgcgaaggaaactggggccagcagctgctctgtgttttcagccaacaatggctcctgcccactgccgctgcataaccaccagaggcaggcttctcttgacacaggcctgtcgttggagcatgtgcctggcgagtcctatttctattcccctgtgggttagggacaggcagctgtaccttcagtgtgttgctgggtcaaagggagacattgagcactccagagcctggtaggttttgcttctttccacactaacttttcaccagaatggccagcaaagtgaacttcactgatctcactctctgtggtgttggaaagtcactgggatgtgtaagaggagaaggagcagcccagatgatctggcccagatgcgctggcagactccgcatgttctgctttcagggacagtggcctggctggtgcacacagtcctgtggggctcatgaggtcatgggaagcagccgagcaggaggctcagggccccatgactgctacagaagttctccgctgggcactggggtcagctggactggcttccagctggccgtggacagcctcagtttcctcatctaggtaacagagacactgcctcaccagagtgggctgcaaagggaggcagtgtcaagtcttggcaccactccagccccgccgtgggttcctgtagtgttctattatttgtttgctcagggctgagctgagactctggacctgggaaaaaggaaagccagagtaggcccagggtccccaaccccagagtgcttcagccttgggggcagctccctaaggccccaggttgaccctggagctactctgcaccctctgcccccaggtctcttgtggggtcagcgctgccaagagtagaaacacttcccccagtagtggggagtactaggagctccgtggggattaaggcttgggcaaatgcctacagaactgacctacccatggaaatatgtggttatataaaactatgtttactttcgtttttttgtttgtgttttcatatagataacaagaaatctcaagcttccgtcagtggtaagagttttcccttttgagttaaagtttctcccaactttggatttgaggtggcaagaatgacatagtgcatgcctcatgtgcctgggttaacctgtcactagaggagaatgcttgcggagagaactctggagggaggaggctgaccagctgtgccctgacctctccagccttcgtcttcctgcagactgtgaagtcgcatgatcctccccatcccgtttcacacaaatgctgcctttgcccagcaaaaagataaacactcacaaagctattaagacattatccaaaagtgttgagctctctggtagagaattattatgctgttttcagtgtaataatatgtagtagcatttctgagaaaatgctgtgaattcacttttttaagttacaaagtttctttgtaaatttagaaatctggctgggtgctgtggctcatgcctgtaatcccaacactgtgggaggctgaggcaggcagatcagttgaggtcaggagttcaagaccagcctggccaacatggtaaaaccccatctctactaaaaatacaaaaatagccgggtgtggtggcatgcgttgtagtcccaactactcaggaggctgaggcatgagaatcgcttgaacctgggaggctgaggttgcagtgagttgagatcgtgccactgcactccaacctggatgactgagtgagactccatctcaaaaaaaaagtttagaaatccatatttttaaatttcagcgtttatcacatgaggggaattctgtcaattcagccttggtctctgctgactaagctgcaagggaaggggtttaacagatccaggctggccaactgcattctgccattgggaagggagtgcactgacctcacaggctgcacgccactgtctgccctgccctagacagtagagctgtacatgccagctgtctctgcccatgtgggtctcacctctcagccaggacagggattcttggccaactggggctgagcggcagcaagggcatgtggccagaacatctgggccccttggcattggagcatggggtcctgggtaccacccagttgtgtggcatggcggtcctgccaggacatacctgtctgtgggtagctgtttgctgtgaagtccacactgttgtgacaatggcatccttgtccttggttgtggcattgctcactgagctgctgacctggtgggcttgggacatttctcctcagtgctctgtggagccctcctctgcacccctaagctgttctggcatggtggccctgcacacaggggcccaggctgagttggactctgcaacagcacgagtggagctgtgtgtgcctgtggacttgtgccctccctgggagagcgtcccctggccactgtgttaccgcttgctcagaagggcccatcgtgctttgtacgctcacccagcaggagggctggacagccaggagaggcaggggttgccacctgccctcaaggcctcagcccatctttagtgtatctgcaggcatcagagaggtcatttgtcccttaacattaggactctggtccaggccaggctagaggtatgggtcatgcagtgaccaacacacctggcgtcctagccattcatatttgggagtctccaggagcctagtctcttactgcttggggctgtgaggggattgagcctgtaggtaggcgagatctgtgctctgtgagccttacgccctttgagccatggtcagtctggtaggccctttcctgagaagctctgcccttgtgttcccacagatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagagtgagtaccacacttcttggaggatttgccgctttccttgcaaacgacaacacattttattcctgtgcttatgatggtatcaagaaaagcatggagaagctccaaatcgctctggtttttttgttttttaaatctttgttgtatgtggagagaaaaggcttccaattttcgttgagctcccagaagggttaagtgatgctgggccctcctcctcctcctagccctgggcaggagggtggggatggcctgagactccatccaaaggtttgtgttttgtggctgaaatagatacagtgtgtttcagagggttctcagctacaaggcagggctgagtgccagcaaccacaactccactgtctgcccgagctctgggcaccatctcttctagtgctgcccttgccccttggtcaccatgggtgtggcttgcagccatattatcttctggcttcctttctgtgaaggagactctgtgtcctctccacacggctgctgtggtgggaaactgggctgtgatcaggtgttataggtgaaccaaagctgctctaaaggggaggcaaagaacctccctcttctttccaggacctgtcttttgagacggggtctcgctctgtgggccacattggagtgcagtggcacaatcacggctcactgcagcctggacatcctgggctcaggtgatcctcacaccacagcctccaaagtagctgggactataggctcacagcaccgcgcccggctaatattttgtattttttgtagagatgggacttcaccatgttgcccaggcttatcttgaactcctgggctcaagcgatctgctcacctcggcctcccaaagtgttgggattacaggcgtgagccaacgcgcctgcccttaggacctatcttgatgtatccttgagtcccatcaacatttcttagagtgtgctgtgcccactgcaaagtgctttagtgtttttttcccctttcatgtaactttttatttttaaaataggagtcacaggaagttgtggaatagcatagagagttcccacatgccctttacccagctctccccaataatagtatcttacatagaacattgtcaaaaccaagaaattaatgttgaggcagtgtaatcacctcagttagagacttagcttggacttcatcagttttttttttttttttgagacagagtttcactcttgttgcccaggctggagtgcagtggtgtgatctcagctcactgcaacttctgccttccgagttcaagcagttctcttgcctcagcctccgactacctgggactacaggcgcctgccaccatgcccagctaattttatatttttagtggagatggggtttcaccatgttggccaggctggtctcaaactcctgacctcaagtgatcttctctcctgagcctcccaaagtgctgggattacagacgtgagccatcacgcccagccgacttcatcagtttttttacactcattcttgggctacatatatgggtatgtgtaggtctgtgagattttaccacgtgtcaaatcaagtagccatcaccacaattggcatgcggagccgttccattaccaccaaccaactctcttgtgttacctctcagagatcgcgccctccctccagccttaagcagtgacaattgctgatctgttgtgtgtctctgtagttctgtccctttgtgaatgttgtataaatggaatcataccatatgtgactttttgagattggctttttaaattcaatctgatacccttgagacccagccaggttttatcagtaattcattccttttcatcactaagtagtgttccatggaacggattttccacagtttgcttattcattcacccatgaaggacatttgggttgtttcctgcttttgcttactattatgcaaacaaagctgctgtggatatctgtgtacaggcttcagtgcttcaatatatttttgtcacacatccctcatgataaccctatgaagagggcagcatcgccccctctgctttgtcagtgtagcagctgctaaggagaactggagtcacaccccaggccaagagctgggatcgaagctgctgcctgaccccatcctcacactcctaccctatcctgtgtcaggtttcctcttctttggggccataggcatcctcatttctacccactcctgctctggaatcttcctccatcccaagccaccttcccttctcataccttaattctcctcttacttcctgttgtctaactctcagcacgtgctggtttcctcatcctagaacaatctgcctggttcttcgtcccaagctctcattacctcactatttttagcacatcagataagtacaccagctgggtttagggaggacccacagaagtgccggctcaagttccttgtcacgttctactcttgtgtacttggtgcattttttttttaatcatgagcttatacttgataataaattgtttttaaatgtatgagtttagaatgctcacatgagttgccttgtcatcccacttcagagactttgtcttaaaccagttctttgtcagaagttcagtggtgaagcttgatatcctgcccacgccctccccagtctggccttggcccccacatcctgtttttagcttccaaggggactggtcttctgtgtggcactagttgaaagttacagtgggggctgggcacggtggctcacgcctgtaatcccagcactttgggaggctgaggcgggcggatcacgaggtcaggagatcgagaccatcctggctaacacggtgagaccccgtctctactaaaaatacaaaaaattagccgggcgtagtggtgggtgcctgtagtcccagctactcgggagactaaggcaggagaatggcatgaacctgggaggcggagcttgcagggggcgagatcgtgccactgcactccagcctgggcaacagagcgagactctgtctcaaaagaaaaaagaaaaagttacagtggattctctacttcaggatcttgttaccacctttgtcagaggccaactctccctgcccttcaccacttgcctccctggtctccctgaaactagtagtgttgtctgatgggcatttgataccccttcctgacacctttcccaaagactactgcatgattaaggccctttcagatcttcatctagtgccaccaagaggacagagcctgggtcagaggttttgccagggactctcaaagggtaggccaggggacattgtgatagttttcaggtgacccaggttagtcggaaaaggctgaaactgctggttgttcctatggctggggctgcagtacagagttggaagcaaagcttttcactctgcgcatttttgtttctcatgagttttatatgacgtgcatgtaaagccgactttaaaaataatttctactgccagttgtgtgatggactggggtgctgaggacatgttctcctcctggataactaggttctggttaggatgcactttggaatgctggcctgcagcagttggggaggctttgtcctcctgagcctcagctgctgcaaggtgggggaagaaagcttgggattcctgtagtcagccaggatttgtgctgggtcctgtgtcaccccccataccccccagaagcaggtgcagattggagcaggtgcggattggaggaacatgtccccagtgtaagacctgtgacagttgcacattaaggtcaagcaatcagcatacaaagatcaccagccttgaagggaaggagagacaccatgaaggtgaacagaaaaaatagacacatgtaggcatgcccagtgaccacacacacaggaactgttagttatgggccatggggtatataaagaaataaagtggagagccgggcacagtggctcacgactacactcctggctactcgggaggctaaggcagggggattgcttgaggccaggagtttgaggctatggtgaactatcattgcaccactgcactccagcctgggggatagaacgagacaccatctctgaaaaaatagaaaacaaaaaggaaaagaaagagcagaaattcaaatgaaaaagcatcatcaggagcaatgaagcagatttgaaacggaaccaaatgaaagctgtagaaatgagcaatataattattgaacgaagaaagtggatgaatgaacagcgcattagatacagctgaagaaagaatttgtgtaatagaagctacatttgaagaaattatctagaatgtagcacagagaagagcacatggaaaatgtgaaagcaagggtaagaaatgaggataagatcagaaattctaattggcatccaagcaaagccccggaaggatcaaatggagagaatggaagaaaacaatatgtgaggggataactactgagaaaagcccatctggccccaaccaagttagccatctcatctgctgtgagactgcagagcaccaaaggccagaggaatgtcttagaaataggcagttcctgcaaaggagcaatgagtacactcagcagtagagtcagaaaggtaatagaatattgttaaagcattgagaatagagctgccagtcacatttgtatgccagcaagactcaaggatgtggaaagcaagccatttttagataaacctagccttagagaccatcactaaaagattttctaaaggatatatctttttttatcctttttccaataagccttttgcactcttagatatattcttttgtttatcctttcctcttccctctcaggtgatacaaggtaaaatgggaaaagaaacgttgagcataggtgatagtaaatgtgtataaatctaaagcagtgattctcacccagggtgacattccaccacaggggatatttgacaatgtctggagacattttgggatgtcactactgtgggggtgctgctggtgcgtaatgggtggagaccagaggtgctgctaaccatcttacaaatacaggtcagtccccccaacaacatagaatcatctgggtcaagtgtcagtagtgaaaaggttgaaaatcgctggtgtaaataaaaatttacctctgtaaaataaaacagtcaggctaacctccatacagacttgccacattccaagcactatttcatttcttttctattattattattattattattaagatggaatctcgctctgtcaacaggctggagtgcagtggtgcaatgtcggcccactgcaacctcgacctcccaggttcaagcgattctcctgcctcagcctcccaagtagctgggactacaggcgcgcgccactacgcccagctaatttttgtatctttagtagagacggggtttcaccatgttggccaggatgttctcgatctccagaccttgtgatctgccctccttggcctcccaaagtgctgggattacaggcatgagcctccgcgcctggcctattattattatttatagagctagggtctccttatgttgcccaggctggtcttgaattgctgggctcaggcgatctgctctgccttggctatccaaagtgtgagattacgggcatgagccacagcacccaaccccagggactattttgagtgttttacttacataatagattatttaattcttagtccagtgtgtggagtaggtactattattgcattttctaacagggaaaactaaggcaatgagcagtgacagagttgaggttttgagtccaggcagcctagcttggaggctgtatccctagcctcaaatccatccagcctcttaatagaatgtctgctgtgaagagttaaaatagatcaacaaaatatgaaataaatgcaagtcagcagggagatagagcgtgaatatcggttctgtcgggtacatataaaacctactttaaaaagtagtaaatttgggaaatgctaaaatattgatgaggtttatactttaagttaaatatgcatgataaaattgaaaaattattgctaaaacaatggaaataattcataaaatttaagatcaatagaaaaaataggataaggcagaaatccagataatacaaagttcaatccaatcatccaacaaaaatgcaatcaaaaaagacaaagaagcttagaaaaggaaagacaaaggccgggcgcggtggctcaggcctgtaatcgcagcactttgggaggctcagtcaggcagatcacgaggtcaggagattgaggcgatcctggccaacatggtgaaacgccgtctctcctaaaaatacaaaaagttagctgggcatggtggcgcatgcctgtaatcccagctacttgggaggctgaggcaggagaatcgctagaacccgggaggcggaggttgcagtgaaccgagatcacgccactgcactccagtctggcgacagagtgagattccatctcaaaaaaaaaaaggaaaggaaagacaaatattaatagaaaataagtttaaaaatataagtaatcataataaatgtgagtggactaaacttttctgctgaaagataggaaatgtgagaacaaatggaaatgaaacagcacagttgttttattgttagaagaaacacacacctacaataaaacatgcggaaggatttaaaaataaaagatgaagaaaggccaagtgcagtggctcacgtctgtaatcccagcacttggagaagctgaggtgggaggatcacttgagcccaggagttcaagaccaacctcggcaaaataggagacccccatctctacataaaatttaaaaattacctgtaggtacacttgagatgctgaggtaagaggatcacttgagcccaggaggtcaaggctgcagtgagccatgattgcactattgcattccagcctgggctgcagtgagacccaatctcaatcaatcagtcaataaaattagctgagtgtggtggtacacacctgtagtcccatctacttgtgaggctgaggtgagaggatcgcttgcttgagcctggaacgctgagtctgcaatgagccacgatggagacactgcattccagcctgggtgacagagcaaaatcccgtctcaaaaaagaaacaaacaaaaaaaaggatgaagaaagatgtattgggcaattacttcaattacatctctttgttattgataaacagaccaaaaaattcatttacagaaaatttgaacaatgtaatgaacaacttaatttaagcatatgatggaacaatatgtttataaaaataaatcataaagcaagcttcaacaatttcagaaaatttaaaagtattgtcatactttttgttgttgttgttttgagacagagtctcactctgtcacccaggctggagtgcagtggcgcgatctcggctcactgcaacctctgcctcccgggttcaagcaattctcctgcctcagcctcctgagtagctgggattacaggcacgtgccaccatgcccgctaatttttgtatttttagtagagatgggtttttgccatgttggccaagctggtctcaaactcgacctcaagtgatcctcctgcctgagcctcccgaagtgctgggattagaggtgagaaccaccgcgacccgccggtcatacatgttttatgaatgtcaaataaagttagaaatctgtcacaaaataaattaaaaattttttacacttggccaggcacagtgacccacgcctataatctcaacactttgtgaggtcgaggcaggaggatcacttgaacccaggagtttgagatcagcctgggcaacaaagtgagactgtctctataaaaattttacaaattagttgggtgtggtggcatgcacctgtagttccagctactcgggaggctgaggcaggagggtcacttaagcccaggaggtcaagggtgcagtgagccacgatggtaccacttcagtccagactgggcaacagagtgagaccccacctcaaaaaaaaaaaatcttacacccatcagaattgctaaaatgaatagtgacagcctcaagtgttggtgacagagaaactgaatcactcatatattgctggtgagaatgtaaagtggttttaccttctttcaaaatgaaatatgcaactcagcagttacactcttgggtatttttcctagagaaatgaaaacctcgcataaaaacccatgcacgaattttaacagcagctttatttgtggtagcccaaatctacagttacccaaatgtccttcatgtagacggttaaacacactgtgaggtgcttgtaccatggaataccctggcagtactgttgctagaactacaacctgtatgctgaatgtaaaaagccgatcccaaaaaggttcatactgtatggttccatttttgaaatattatgtataattttgaaatgacaaaattttagaaatggaggatgctgcagtggttgccagagtttgcgggtcagggttgctgagagaggtggcaacacgagggatccttgtggtgtggggactgtgtagtgtattgactggtggtgactgaacccacccaggtggttaaattgtccagaacttagtacacacacccacacaagtgagcacacatcgtggttgtgataccttgtaagtttgtagaatgttaccattggaggaaactgggcaaagtatacaaaggatctctctatatttctttaatacagctttattgagacataattctcattagcatacaattcacccatctgaagtgctccactcggtaggttttagtgtaatccacagagttgtgcagccatcagcacaattttagaacatttttatgttcaccccaaaagaaacctcacctcagaaaatcttgtaattgactgttcatataagcagttttcataatagccacaaagtagaagcagcgcaaatgttcatcacaggaaatcggtgtagtagaatattatttggcgataaaaataacacagaaaaactgataacatgccacgacatgggcgaactcgtaaatattatgctaaagaagctagtcacaaaagagcacatgttcgatgccattcgtacaaagagtccggaagtggccaatccatagagacagagaggagattactgattgccagagtctaggcttcttatttatccaaaagacttagttgtcccttttcttttgtctttggttattatagagtaactcatgataggaaatcccaaaatcaacacaaatgctacttcgtattctatctttctgtctgtggtaaatggaacgttcagattccagcggcagccgtggcagtggggcttttgctggctgttttgtcccttgctgtgcagccctgcagcgtttctgggaatctgccctgtggactgactggcgactctggtcttttctcagcccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacaggtaccaggtcccctgttcctgctcttggcctccctcctgcagcgtgagccctgggctggcatcagccacaatgctgggtgcagtgcccggagccagccgagggttctcttgacacgtgtgcctgcccttttccatgggcttctcaaaaagtctgggacaaggccgggcccagtggctcatgcctgtaatcccagcactttgggaggccaaggcaggcggatcatcaggagttcaagaccagcctggccagcatggtgaaaccccatctctactaaaaatacaaaaaattagctggacatggtggcgtacacctataatcccagctatttgagaggctgaggcaggagaatcgctagaacctgggaggcggaggttgcagtgagccgagatcgcgccgctgcgctccagcctgggcagcagtgagactccgtctcaaaaaaaataaaaataaaaaaggaaaacaaaagtctgggacaggcaggagaaacaggccctgactcactaggaaggttctgtgatcgagcccttccatttgggcttgggcatctggcggtgggcctcctgtgtagttcaggggctgcgagggattcaaacaagagtgagctgaagcaagaagtgagacgaacactctgaggcttgggactacttgagccattgtgggccattttggctgaggacacatgtgcctcctgtttacctctgtgtcttgggttctgggctcagtgttagtcgacctccagctggtgttgcatgaggtgatggtgatgtcatgttagcagcactgcttctcagaagttgttcagcttcccatggtttccatagagagtctagacgtgttaaacatctgccctcacagcaggtcttggttgggagaggaaagccccaaagggccccaccaccctcccaccccttcaggcctcagctagctgggcttctctggatcttggcacccctctcccagagctgacagtgcatctgcagccacacttttccttctcctgctgacaagcagaccttgaccgtcaccgtgaggctcatgccactgacctataggggcaaagcaagcatcgttgcagaggcttcagaaatctgcagttgccccagcttttatcctagcttccatggagctgtacctattccttgtcatcttttgctgaagtttctaggtatgccctttgaaccatcctagtggaatggtagaccagagcccaggcacacacttggtgcctccccggtgtcaggaaggcagctggtgttggcctcggggggcccagagcctttctgtgggagatgtgcccctccccgtgtgagtgagaggtcagcctgtcagcccaggaaggccttttttttttttttttttttgagacttttttttgcctcttactctgttgcccaggctggagtgcagtggtgtgatctcggctcactgcaacctctgccccaccagtttaagtgattctcctgcctcagcctcccaagtagctgggattacaggtgtgagccaccatgcctggctaatttttgtattattagtagagacggggtttcgccaggttgtccaggctggtctcgaactcctgacctcaggtgatctgcccgcctcggcctcccaaagtgctgggattacaggcgtgagccactgcacccagccaggaaggctttcttgatggctctgcagatggccacctgggcttcctgaggcccagactgtcacagggaggagctggtgccacagaggcagatgagtgataaccgagtgctgcttgttctgtctctagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtgagtacctgtggcccacagtggagcacatgcagcccgtggctctgtcagcagtagtttctaggctctttggctagagatagcatatcctattcttcaagtgctgagacttcaggcagcccccaccccttgccagccctgccgactctagcatggctcagcagggaagcatgtgttttgcattttgtgttctgagagctgcttctgcaccccgcacagggtactgctgctgctactggggcaccaagtcgcattccaagcagtgtggctgattgcagcagttctgtgggccctttcagggtgtgagcacttcgactgatgagcaccacatgaaaggatgtgccagctccgtcagtgtctggtggtttgccaactactcagagttaatgttctaagcaaatatctttttttttcctttacactctgccaagtctcaggagaacaaagttcattactatatttttgagaggagtattaatataaaatactgttattcctagtttcattttgtatctctgcacaaagccagtctactcagtgacaggcacagaggacagagtatgatcaccaggatgaaggtagctgcatcaaggggccatttggacaactctttggctcccttggtttttgtggccttttctgtttgtgattcatgagtggaatggggcctgaggcaagtgtgggggtgaacaagaggcctcataggcagactggaagtctaggagagttgtgaggagcagatatgctcactcatctgtcacctgggagtcgacacactgcctgaccccggggactgtgcagactgaaacccttgtgtgctgcatggtggaatgtgccctggcagggtttgccctagtggcttggagatgtctaaggaagagcccgctgcatgttggaatgtgccctggcagggtttgccctggtgacttggagatgtctaaggaagagccccctgcatggtggcgcgggcctgtctcgtccttctggaggcccctccatgcagtggctccacagttgccccttttgcccaagtttgccccccacccccacttttttcttttgaagacagggtctctgttttccaggctggagtgcactgatgtgatcagacctccctgctcaagcgattctcccacctcagcctcccaagtagctggggctgcaggtgtgcatccccacacctagccaaatttttgtatattttgtagatatggggtttggccgtgttgcccaggctagtcttgatctcctgggcttaagcgatccactggccttggcctcccagaatgctgagaatacagacaggagctactacgccctgccctctgctggccggctaacccagctttccttcaaggaatcaggctgagtgaagctcttgtggaccatcagcatgcttggcccagaggatgagcaggctaggctgtaagctctgcattggaagtcgtcagtgcttgtgatagctggtgctgagggatgtgtggagacatcccagtgggagggccacattgccacttgccagaattggatttgagctaatgggatcctagatggccagtaaggtgacatcacagcacatgaggtcatgaaagtcccattcctcacctcaagaaaggctccatttcctaagcttccacaggaagactaggctctgctctctgacccaggtggttccaaatcacattctctctttctccctcaaggtccgagctccgatggtggtgcagcagcccccagtgcagccccaggtgcagcagcagcagacagcagtacagacagctcaggctgcccagatggtggctcccggagtccaggtgagggcctgggggtggagggctccatagtcatcagcaggtgcatgttcacctgcgcatgtagtgctacagtgagggttctggttggattaggggctgggggctaagttggtaaagcaggggcttctctcccccttgcactctgcaagacacccctggagtccttggggtgggcagctgtgcttggtcatgtctaggacccaccagccgcatagtgcgtgtcgtttccagctttgctcgggcatccttcattatccctcttccttgccactctgagtgactctgggaacatgtatcagagagtagaaggctgcagttttctcctcacctctcatcttccatttgagagtctgagtacagagctgaccagggtggagggcagctttctagacactcggaagcagatgggagccacatgcagcaggagcgtgggagaaggcatcctggtgctcgcctgcactcagggactccggcgctgtgtggtgagaagcgtgccactcccacattgctgagcttgctggtgtgtcacatgtgtggaatgtgtgtgtgtctctgtgtgtcacgtgttagtggaatgcagatggccttgtctggcctcctagtgtcctgggattggaggcccagggtttctgtaccttttcctataacccctcctctccttcttgtggggagacgtacagtctggggcttcagtttttcctcttttcacatgatggtggaaacactgttggtcctgactcggaaggggcgttggctttagaaagagtcagaatgtgctagttgatgtggtaagactgtggctgggtcccagcccacagctggcagtgcgcctgcactttgctgtcgtcttaagggtacctggccttgtggttttctgcaggcctgctgggcgcagcgcctgggtgcacagtgcctcgtggcaggcttcatctcacgcttggggggtgctcagtaatgtccttcatggtgcctgctacctcttttaagtccctgggaagctgcctgaggagggaatctgaggtatttggctgcagctgaggttagcatcctaccttggcagggcaccaaatgacttggggccagggtccccatgtcacattcttacttagatggagccctgtatgaaacacaccacagaactcacatttacttacagctgggggaggctgaccacttcgtgtgatgaggttggaggtctctgccacctccctgtgtgtctcggcatgtcctcaggcctcgtgggggggctcccttgtcctggtctcatgcagaggaaggacgtggtgtgttcagagtcagcttagtggtggcacatagtgactgcccacccagtggaagctgctacctttgcctctttggaccatcgatcctctgttcaggacctcacttcctggaaactttttttattttttgagatggagtcttgctctgttgccaggctggagtacagtggcacgatcttggctcactgcaacctctgcctcctgggttcaagtgattctcctgcctcaggttcccgagtagctggaactacaggcgcgtgccatcacacctggctaatttttgtatttttagtagagacatggtttcatcatgttggccaggatggtctccatctcttgacctcgtgatctgccggccttggcctcccaaagtgctgagattacaggcatgagccaatgcgcccggctggaaacttctgtaccgcaggtcaagcccagcaggaaagtgagaactgctcttttctttatttctttctgtcttttttttttttttttgagacagagtctgactctgtcatccaggctggattgcagttttgcgatctcggctcactgcaacttctgcctcctgggttcaggcgattcttgtgcctcagcctcccaagtagctgggactacagttgcacaccaccacacctggctaatttttgtatttttagtagagatagggtttcaccatgttggccaggctggttcgaactcctgacctcaagtgattcacccgcctcagcctcccaaagtgctgggattataggcatgagccatcgcacccagcctagaacttctcttctcttctcttttttctcttttcttttctttctttctttctttcttttttttttttttttttttttttttttttgacagagtcttgctctctcacctaggctagagtggctggagtgcagtggtgcaatcttggctcactgcaacctctgtctcccaggttcaagtgattgtcctgcctttgctcccaagtagctgggactacaggcatgcgccactatatccagctaatttttttttcctcttgtatttttagtagagatgggccaggctggtcttaagctcctgacttcaagtgatccacctgcctcagcctccctaagtgttgggattacaggcgtgagccactgtgcccagccgaactttccttttctttccatttcttggtatttggaaagtgaatagccatggagcagccagtgttttcagctggtgcaggcccagctggtatgttcgttaggcttctagctcaaggaagtgtccactctgcagtctcactggcatcccatcaccgtccagaagcaggatgccagctgtgtgtgctcatggcccatgctgagcctgtccttgggccactggtcttcctgtcggtttctccaccccttgtttcaggtggaggtccccgcccgactggcacaggaaggaggatggagagtggttaccactgtggttcgttgctgagtgagtttgatgttttaaggatcattgcccacctgccctgtggcaccatgtgctgccatgcaggggattcccaagtgctagtggcagaggagccttgtagtttctcaaagtccagcagtgggtagggcgtatctatgaggtgcttctcagtccagatgtggcaccttgaaattctgtaacccgcattctgctggttttctctcagagcttggtcttgccttgttgcaagcagtgcagtttcttgggggctaattgggcaccctcactgccttgttccaccaatagcagcgccccctgctgggggatggggagggttgggcacagcaagccctctgaggggccatctggattcatgatcttcttttgaaacttgaattggcacagtgaccagctgaggctacggtactctgatctaaaaactttaaaagtatgtgtggtaactgtagaacccagaaagtggagaggaacagaagtaagagaaccattccatgagagagaaggtctggtgtcctttctggttgtttcccatagtcaaggtcatgctatcctggggttttttgtgcagcatcttccacatcaataggggatgaaatgttctcctttaattagaaagccctggtcggcacgaaggaactcttgtcatacccctctgtgaatgtctcttgccatcctcagttaccatcttgttcttggaccttgtaataatttccgattttttgctattaccagtgacacatatcttgatgtcttagattgttcctggagctgatggaggtgagtgaatggttcactttgagggccttcagatctgatcagccaccctctaaccaggaggtcagagatgcagattggagctccccttgtgttgttcacacagtggacatcaggacgtggtgaccacgtgttgcagctttgtatgtatgagctgccgcgtgctgcggaaacaggcctcttgagttcatgaatgaaattctgggattgggggcccccatgcaggcagccctccatgccctgtctctcaagcccatcttagagccgaagagaggcgccctgtcaggcccttgcagtactgtggtgttggatgtggtaaagggtagcctgggactgagtattctagaaaaattgctcagccttgtgctgtgcacacctggttctctttccagtgttatttatgtagctgagaagggcaatgtcacccacaaggggatttagcaggacacagcagacttctttttctcccctataaaaccaagacatgcaggcacagtggctcatgcctgtaatcccaacgttttgggaagccaaggtgagaggatcacttgagaccaggagttcaaaactatcctgggcaacacagcgagaccctgtctctacaaaaaaataaaaataaaaagttagctgggcggagtggtgcgtgtctgcagtccctgctactcgggaggccgagttgggaggatcgtgcaagcccaggggtttgaggctgcagtgagctgtgatgacagcattacactctagcctgggagacagagcaaaactcttgtctctttaaaaaagcaagaaacaggacagaatgcatctcattttctttttttttttttttttaaagacagagtctcttgctctgtcacccaggctggagtgcaatggtacagtctcagctcactgcagtctccacctcctgggttcaagggattctcctgcctcagcctcccaagtacctgggattacaggcatgtgccaccatgcctggctaattttgtatttttagtagagacggggttttgtcatgttggccaggctggtcttgaactcctcgccttaagagatgtgcccgctttggcctcccaaagtgctggaattacaggcgtaagccactgtgcctggccatgcatctcattttcaaacagtccctatacctttgtcatttaacgttctattcttttagtatgtgaaaaccaaactctaatttacaagtcacaaagaattatccaagacagactcccattgtggacatgtatgtggcattgctgattcacagctactgtactgaagccttggccaccctggaggaccctctctctttttgctggacccttctgcacagtgactgcagtagggagagtcagacctgggggtgggggagaggttttttggattcctctctgggtagatgtgtgttgggaagtagtgaaatgttgatagctgcctggctcatctgatccagtaaacataactggtgcgtttgggttgaaagaaattgggctttccttatcagttctcagttataagaacatcagtcagcagtacattagacttaagctttgcattccttgcgtttttttgtttgtttttctcttcctggaaaaaagtttgcttctctcataccatctgacttacttccaggcttttctcccttgtggaacgagtgccgttgagccctgctgcactctcagacgggctcctccgaagtgccgcaggtggtggtaaatcgactctcacccactggggtcgctccttcgtgtctccccccggtcggttcatctgttgctctggctgcaggaggaacgagtgagcttctggtcggcgtctgccatgccgtgtcaccccggcttctggcacctcctgtgcgtgcccaggattgtgaatgtgggccgtgtgtgtgaggccacgggtctccctgcagccactctcctgctggagctctgttactggcacctgtcgctgcctgcaccgaaggctggcagcacctcctggagcttgggacccagagcacagcctcccaccatgagatgtgttgtttttctgtggatcagtcctcctttctttctgagcctggcgtgttttgttctagtttgttaccgtcctaagtgcctgtaggccctgctctccagggacgagactcgggctctacccccaactcagaacccagagcaagagtggtcgggcccgggcccacaacagtgctcagctgtcctgctgcctttgtagttcaagaagtgtccattgatgaggggaatggtcctggctcatgctggagttcctgactcgcatccctgtggagatgaacttcctcgtcagggcggaggcctgccaagcagtccccccaggcttctcttgctcacctttgcccatttttattacgaaagaaaaccagttccttgatagataccaggaccatcagcctcaggcctggaggaggagaggaggatgatttgggttcgggctgtaagaggtgtgccactgagaaggagggatgctgtgagcaggcttaactgagctcatggttcagtgggagttgagtgttctcatcacaggctttggtggaatgtactcttgacatctgtccccaggagcctggtctccagaaacaccagctcaggccctcaaggtctggctctgatggttctgtgggctataggattctgatctgttagcgaggtgtgttcagaagtgtgttgaggacaccagtgcaggagagcaaccagtagaacagaaaggtctggaagcagcattcttggcaaatcttctagattcccaatgcccagacagacctggaggtgctgtgggcttgaacatgtgggtggcctcccctcccaggctgccccgagctgcccaagctttccttgccctggtgctccttcttgcagaggctacacgtgccctctccacctgcccaggcactgagtttctttgttgcgatcaccttgtctgttgtccctctgtcctcaaagatgatcacggaagccttggcccaaggtgggatgcacataagagcccggttcccgcctaccaccgctgtgtccgccatcccgtcaagctccatccctttgggcagacagcccatggcacaggtatttacggggcagcgcccagggcacggctgggagctcggggcgtcctctgagcgcctttgtaaagcgcacctgtcattatcatcgccggtgacttcttttatggtggctttcagagtgccaaacccacagtccctttttttttttttttaaatgaagccaagcccagcttgtgcttgttgagaggatatgaataaatatctgggtcttttcagcttaaaatagttatactgtacgcattttcatggtaaaaataaaacagcagctaagcaaaagttttgctttctagagctgtgctatctaatagtgtagccactaagcatgtgtggctgtttacatttaaattgactaaaattaggccgggcacaggggcttatggctataatctcaacacctcaggaggccgagatgggaggatcacttgaggccaggagtttgagaccagcctggttcacatagcgacatactatctccaattaattatatacattttttaatggaaaatatatatataaatgtatatatattttaaaaacaaaaaaaaaacctaaaagtcaactaaaattaaataaaatgaaaaaatgcagttcttcagtcgcaccaaataaattttaagccctcatttgcccacagggaagctagtggctgctgcagtggacagcacagactccagaacgtggccaatgtggccaaagtggtattgggccatgctgttgtagagtttgatgtgtagagtgtgtaatttgtaacacagatcccctttctaggtagaggtagacttctgtgtacattatgcttttcagagacaggaattcccggcttcttttattgtatgaaatttggaattactccatggcatagtcatttttttaacaaatagttaccacatgcattctgtgtgccaggcactatgctaagattctgagaataaaattatgctgaagttctctcatcatacaggctttccattttagtgggtttgtcgtgaaaacatcaaatttgccaaaagaactttacaattcagtttctgttttaggggaaatgcctctataatcctagcagacagtggtccctgtccatccctgaacgcccaggtgcaggcactgccaccaccctggcttgtgcagtggcgtctctgcagctctgttctacacaggaagaagtggaggctgagccaggatggcccttggtccatgtggccccaagcctggtgccacacaccacacactgccaagaaagtggcctgggcccccactggggcatgtttagcttttgccttccctgcatactaaccccctgggttaccccagatgtgccattcacatagttactgactggaacttagtttctttggcagggacttcctttttagtagttgttgaattacagcgggaggaagtgcctggaatctgctggtagaaaggctttggtgaaagagctctccagaggagcggaagttgggggtcaggaattaggttgtgtggctgtggtggaaaggaggccagtgtgggcagaagccagggtgcagttccccatggcctggaggctgtgagttccacgacctgctcacatgctgctggtgtctccttgactagacccctttgggttctgcactcttgtctgctaaaactgcttctcctcctttcccatagcctctggcacagtatccactgggttcacagaatcaggttgggttgctgtatgtggaggaatgactttagtagcagcatgtaggactgatttttataaacacaaaaagtccccaatgttttcagtgtgcgatatgtgccaggccttgagctaagctctttgtgtacagagcctcactgtttcttgttgtagcaggtcatagtttgagcatttagccccttttacagactaagagtgcccccagggagccaccaagtcaggatcgagggctcaagtgaaacccttatgccttggcctctcagcaggattcttctggaaactcctcactccccttcctgctgggctgatgacctggcttctccttcttgtttactgggcactcctgggtgggctccctccatgcccccacaagaccaggctctgtcctgggctttggcttgcccatactctgttgtgggctggccactccccacacccagctgctggtgtttccacctagacttctcacaggcagcccctccctccctccctccctccttcccaccagttcccaaacccactcagtctttccctccccagccttccctggcccttagattaagtctgccctgagttatgccagctaataggtctctctctctctagaagcttccaacccccaaaggcaaggaggtaaggtggagcagaggaaggatagagaaatatatgatgaagctgaaaaagttattgccttggaataaatgccatggagaattctggtttgtcctcattgcactgtgtggggtgagagcgctctcatgggaagatgctggctaactgcacacagatttaatcaccaggccccgcccattcgcactggcagtgagaggcacacccctgaacctttggggttgttcactgaggacaaacgcggcagcatttagaaagtattcctcgtcccggcagtagacaaaagccacaggatttatggaaagaggaaggaaggcacagaactggggcaaggttctggttttgttctgttattttgttgtcattgttactgtttgtttttctttttttgagacagagtctcgcacttgtcccccaggcaggagtgcaatggcgcactcctggctcactgcaacctccacctcccagcttcaagcgattctcctgcctcagcctctcgagtagctgggactacaggcgcctgccaccacatctggctaatttttgtatttttagtagagatggggtttcaccatgttggccaggctggtcttgaactcctaaccttaggtgatccgcccgcctcggtctccaaaactgttgagattacaggtgtgaaccactgcgcccagccttgtactgtgtttttaaagcaggtttgttcatgcttgttagctgcaagaaaggaaactggaaggagttgagggagggagaaaagcgaatagagggacaccctggagtggaagcctccctactgcccaggcagctgctctgcagccctctctggtcctggccttccccgcagagggccctccccagctcagccctctacgtccggctgcagtaccaggctcttggtacagtctcccacacctggctgtgggccagccttggggacgtgaggcatgctgggccccgtgtaccaagggcattcacctgaccacaccaggtggctccagaggtgtgcctctgcttttgtgtcagtatctttcaatccagtcccttccgagaaaaagagagcttatctcaggaacgtatctgttgatctcaccaggaattgccccactgtgtcccatctgagctctcaggggccagaacctgctgtctccagtgtgtccagatggccactctgtggccactgtccctccagccacttgccctcagcagtcagcaggacacagtctggagactacactgcccatttgctcttgctctttccttgtggcaacaaattaggtccaagaaaacaggtggagctgaaagagggaatgtacgtgccccatgggctcttctccagagggcagggcccaggctccctccctctgtcttgacggctcatggctgcatcttcctgttacggtgggcatgcctcacggactcaggctaccaggtcaagcaggattctgtgctgggtgcattctggacacagtgctcagcacgggggcccagggggtggcatggcccatgccacaatcctcccttggcagatgtaagcaggcagtgtctttctcactaggggcttgtcctttgactagagaggcactgttgcctccctgttccctgctccaatcccagacctgacatgagaccaaggactgggaggtttctttctcgcctctctggctgcctccccagagcctagagcctgtctttggatgagtctttgcaggggctgcttctcatcccaggtgctggacttggactgcccaccactgacacctgggcacagggcctggcttcctgctctcgtgctcttggaaatgaatgggtgcccttcatttgtttttcttcccactagaaatctccctgcctcccatcctctgggctctgctggctgccagctgccagggtgagacccgtgttccactgcaccctggggagtgcctccaggggacacactgagtgccggagccaggagcaaggaacggttcccagtatgtgggggcgggggtggggatcgcgcagtgccgccagccttgcctgagggttcctctgtgagatggagctccctggaccagcctttttgccctcccacctcctctctggcccactcggtgtccacctgccttcagctccaggctgctgtgtgggtccctttcccagaaatgcagttcaggccattgttgctggggtggtggtgttgctggggtgttgatgtttagcgtgcctgagctcccttcatcactaggatgaccttgagcaagtcacttccctctgagctccctgttcccaacctgtgacacacaggtgacaggtggtgtgcactcagaaactccttccctaggatgtgtgacattcttgtcctggggcctttgctagctgtgacacaccggcgcccgacctctctggctgcctccctaatgccagttgtgtcttcagatgagtctttggggggctgcttctcatcccaggtgctggacttggactgtccaccactgacacctgggcacagggcctggctttctgctcttgtgctcttggaaatgaaagggtgcccctcgtttgtttttcttcccactagaaatctccctgtctcccatcctgtaggctctgctggccaccagctgccctgacctggggcagctgaagaactgagatagacctaagttctgggtgggtgcttggaggccccacgggcgtggctggtgagattgccgcttcagggccaaagtgggtgccgggcttcctgaggttcgagagcagatgagaactcttgagtggcaatgagggctgtgtggtggccttctctgcttggcagcctctgcccagcctgcagctgccttgctcctcagagaagcgctgagctttaggccacagaaaagagctgaccatcttctagaagggacagctgctcaggcacaggcgcctctctggaagaggcagtcaggtagaggcaaggggaggggccctgaccttcaagcaggaagagaggtgagcttgtgagacagctttctggggtgcaggtagagagtagcagcaagtcaagcatgggtcagaaaaggcagagttgggctgagcatggggcccagagtctttgcttcccactcctcggtgccgtctgtggttctctgtatggaattttctggccttgggattttgttgacacctggataagtctagaacatgtgttccggtgtctgggacatgcccttactcctcttcagctagggctctgtgcaccccagcaccgtgaatgcacaggactttggtgggagaaatctctgtacttgttcaactcagcatttagcaaatgaagtcacatcagtccccgtttctgaccttgctaacctttgcgagaatcaccgcgagccattttgctccattaggtagagtgatgaggcccggcaggccgaggctggggctcctgcactctgtccctcctctcccaggcagaggtgtcttgaccacaaagcagtgggaacagtccattccatcggttgatgtcccactgggccagtggctttggatagggacctctgacccagctgtgctggaagtaccctgttgtggtcacgctctgtgccttagccccccaccccctggtctcccagcacacgtggttcaggaacggcctgcacccagcatcccttgcagcactgtcaggcacagcccatggaacaggcaggacagaaagagcatttcgctccaggagcttggtccacgtggtgctgaaagggcagtgccaccctgccctctgctgcctggtggggtggtgaggagggcagcattctgtttgtgggctctgggcctggtccccaatttaaggagcttagaaagcagctgtcctatcccagtactcacagcactgtggtggaagtgcttggggggtggtgtgagccgtggcccgagacaggcgttcatggccagagtgccccaggagaagcactgagttggtctacagaaatggatggtccaggggcctggctcctaggcagactgtgaggggatgcttggcatgcagggggttgactagggtgtgggaaatgtagcagggccttcagggttcccccagtgtgacaaggcatccctctttgctgagagtccctctaggggaggccagacgcccagggctggcaggcagctgttctccccatcaaagcagccatctgtgctccaccccaggaaggtgtgggtgttttacatatgcttatccctgatgcctgggtggtgtggtttcatccctagagtttacggatgaagacagtggtgtccctggtgcagacactggggtgattgatcttatttgtgtcgtggccagcaaggcctggggagcagagcaacagccttgctttgcatacacacagggcctcagaggactcaggtgcacacctgcatggcagaaccaggctctgggcccaggtgtctgacactgagtagctcgcctctcccaggggcgctggtgtgggccgatgcaagtgccaccatgggtgtgtgtgtggctccctgggccacctcactccaattaagcaggtccaggtgggacagcctgggaccagccctgcagcagcatgtgttaaccacaacagatggctgtagccaccaggcttgtccttggtgcagtcagcctgggggctgcgggggcttgtggaagcatgtgggaagacggtcccactggtcagcagagcagggtcctcaccgacccacagaggagcatgtcacaggacaggcaggcgtgtcagggaaggccaggctagtgccagccaagggcattgcctcccagactgcccttttcctcacactcccacgacacagccctcaaagcctgtgcccctgtgggtccctggccaaggagcaagggctgccctgcctgggccccccccgccagccccttggtcacctcatgctgtgtgccaggctgggggagtgtgcctgtgtgtatgtccaggtggcatttggatgaagacacaggtgtgtggtgaggctgtgcgggaggatgggcctatgcgtgcggtgggcaggtggtgtggaggcaggcgggcgggcgtgtggcagcgcgccggctgagcccctccacttccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcaggtaggcctggcctggggtgcccctccccacctggccctcgaggctggccctgcctggaccccggctcacatgtttctctcacttggctgcagctctggccctgccccatctcccagtagcttcctgcccagcccctcaccgcagccctcccagagcccagtgacggcgcggaccccacagaacttcagtgtcccctcacctggacctttaaacacacctggtaagttgggcctgaggtgctaaggtcactcctcacctttatgaggcctcagctcatactgggtgtgcgagctctggggccctcagagctcaagttccccacccgagggtcgagggctgtggcctcacccgcctgtgtcctgcagtgaaccccagctctgtcatgagcccagctggctccagccaggctgaggagcagcagtacctggacaagctgaagcagctgtcgaagtacatcgagcccctgcgccgcatgatcaacaagatcgacaagaacgaaggtaggctgcagccagggcaggggcctgcaccctggggacaccaccaggcttgtgtcttagtgtgtaccctcttctgtcccagacagaaaaaaggacctgagtaagatgaagagccttctggacattctgacagacccctcgaagcggtgagctttgcccacagcccacggagggtccacaagggcacagatagcccagccatggatgggcacttggtgatgatgtgggtttaacaaaggcaccaggcagctctttggaccctggccagaggcctccaaggctccactctggtgtgtgctggggcttcaagcccaggcttcatcttggcccatgcccagcctttgccctattcctggctgctgctgtggccctcatgctgggccatcacagccagacctcatccagtcagcagccaggggcccagcttgcagtggcctgaccatcagctggcccagatgggcctgagcctgacctggagttctgcccctgacttgctggtgaccatgggcaggcgactgcatctcagttaccccatttgtagcccacgtgtgttgtcatgaaaatgaaacaaggtggcgctggtgagaagcaggtggaaggcagggctgctggccacaggctgctgtgaggatcagagctcgggcagtacctccaaactgcatgggcattggcatatacctccctttcacctcaactcaggctatcccccaacccctgtctagaagggtctctctgttctgcttgtctggatagaatgccagtcactattgggtggtcctccaggtcttcatgggttgatcctttgttagggttatagggatgagtggggcagggactggcctacatgacaatgaggcattcacagcctgatcaggggcctggccactgtcccttctcttgacccatcacctcactctgccaaccagggacaagcagctcctggggttgagggctgcctgccttcaactctgggtctgggaacagctggtcaactggtaggagctcctgcagaggtttctgatggctgaggcccagtggcagtagttgggatcctgagcctgagaactgccatgtcttccactctttcagcccaagtcctctctctctgcaggtgtcccctgaagaccttgcaaaagtgtgagatcgccctggagaaactcaagaatgacatggcggtggtgagtgggatgccagacacccctaggggaaccagggctctcctaagagctcctgggagtgctgctgagagggccttcaaggtcagggcatctgggcgggggccgggcctgaccttggaccctgcccacgaggcttcctggccaggtctgctgtgctgggtgggaacatgggagaagtcaccctctgtctacggcccccgtgggtgcctccttcacccatttcagaggaggcagggactgtagggaggataggctgtgggggtgggggattattcccaggatcagccaacattgtctgcacaagggtggaggctgtgagagaggcctcgggaatctgactgtgagtgaccatgggcctggggtgtgaaggccccctaaatggggaaccctcgggtcccgggctgctgaccgtgcccatcctgtctccagcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacgtatgtccagctgggctgggctttgcggagggcggccagccctgggccgcgtgtgccaggtgtggtcaccatgccgcctccccagggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctgggtgagtgtccagagggccgggactggtgtgggaaagcaggccctgaccgcagccccaggactctgccatccaagccagatggcacagcgcccagaacccaccctgtgttcacgccccgccaggctgtctgctctatcctcacacacaccgggctccagacagcctggccatgcctcagtccccactgccagagcccgcacactctcacctccccaacacagatgtggctttgcttgcctgggccctagggaggtggtaggcaggacctctgggcacccatcaatgcagagcactccaggcttcacgtttggaaatctgagagtcagagagacctcctccaggctttgccacaagcttcaccagaacctccctgggtgtggagtcctgttccagagcagggctgtgaggcagggcaggccggggcttgtccaggtcacagatagagccttctgtgttgcagatgacaaggacctcccaagtgtgccaccactggagctcagtgtgcccgctgactatcctgcccaaagcccgctgtggatagaccggcagtggcagtacggtaggtagacccagaggagctgtctggggacccagggcaagcaggggtcattgtggaaaaccaggcttccactgcagcagggacagcctctgtgtgctcctgcccctccccagctcaggcccctccctcccctcttctggctcctcctgcacagacagcagcgggttttccagtggtcgcctgagagaaaagggtctctgctcccactgtgtcccttcgccccttcaacttgtgtcacgtcagctgtccagggtggttgtgttcagtgggtgaggggtgagtaagcccatggctcagggacagtccccgctcttcccagaggccactagcttcccagaggccactaccttggcagggctgccaggttccactggtagcttgggcacacagggcccaatctgggtgctgtggctccagagagaaccacggtggcagggggcagtctctgagcccagagctggcacacagcagagctggcacacagcagagctggcacacagtagagccaggctgggtccccaaggttgttagaggcagagccctagatcctgttcagatttggttctcactgacgatgaggctctgggaggagagcccaaaggccgggcagcgtgcaggacacatcacctcctggtgcttcggcccgcgcctggggctaccccttcccagagcactgccgggtgtgccaggagcgagcgcagcgccggccgccttaggttcacgcccactgctctgttgcagacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgtttgtcagttgttcatcactgtgtccccttctccatgaatctgggctcgctgtcctgtcaggatgctgtcagccttggggctgcctggggcctctgcctcccttccaggagggacttgaggtgctgcagctgaaaggcaggggcaggggtgtggtggggcctgcggtggcaccaggctgcccagggccatccccaccacccagggcctcacctcttgggcctgcagaaggttggtattccacagctggtggatgaccacttacactgctgaagtgtggtgggctttcgcaggtgtggggacaggatcatcggggagtgccatcatctgcctgtccctgtgctggctgcccacccaacagaaagccctggcgttagaggcctctgcttccctgtctctgaaagtcattacagtagccagaaatgacctgcccaggtgggtctgagcatccaggcagcatacttcccccaggcagtgcccaggccagtgtggggaacagggcctggctcccttctcccactgaccagagtgctctgggtgccagatgggggtctcggactggggtctgtcccttcctcccctctgaaggtgccctgagggtcagatgtgcttcagtgggtgaccagctagctgccaggctgcccttagtcaggaccctatacccagtggggcttcttgcttcagggctggtctcaggggacgtgcagagatgcaggagcctgtcctgctggttgcaccgctcaaaatgtgcactctgcaatgtctcagggcagcccggcaactcggggagtaccagagcctggtcctgctctcctagtcccctccaaaggcaggctgtggccaggggcagcaggcactgaccagctccattctaatcaggcccaggaacacaactcacttttcttggtaaaaagattactttgttttcttttctctgagaaagtggtttaggggctgttgctgccccctcttgtgggctcaggtcagcacaggtaatctgcaggactccaggggaggggaggaagacagcgcccacccaatggacagagtgtggacagagcgtggccattgtctgctttcatgagccctggagacaggatcctagagcaagggacacagcagtttgctgactgcagtgtgggagcctagtaaatgtggtcctggggcccttagggtgcaggcaaaccttacttggactgcccttgcaccccaggaactttgtccagcttgctgttgtgaagcagtggctcctcctcaaggtctgccttctggggtaccttagagtaccccagtgctttagagtcttgtttcttgaaggaaccggctggggcctgtcctttccttgagagttggctgcaggtcagacccgacagggccagtcactgcaggcaccaacagccgctgcccaagtctttcaggatcagctgtgtgtgcccaagaagcccctgcctcagttgcctcctctgtaaagggaagcctgccttggagggttctaggaggaataaatgaggttctgaggatgaagcccatgggtggtgcctgtgaacattctagaacagtcaatatagtggaagctggctctgttttgggtaaaataaaactgcatgcgaggcctgggactaagcctgcatgggtttcctctgcaaggacaacgcccatggcacgcctgggctcatcacaggaacaataggggccagggttggggccaaggaagatgcctggtctcgagccactccccgctcactctgcagaagatgccatgagcccagggctccgtgggcagtgccatccctcctgtatcctgtctgcttgtggagggggacgtgggccaagcagggcctctgccaggcagccagtgtacgtccttccccctagaaggccacccaaggaggccccttctgaccgcttgctgtgctggcttggggtgcctgccatgaggccttgctgccctgcgttgacagcccctgtgactggcccccagtcctgcccaccccaccctaggcccctcctggtggtttcagcttacagggctcccttcagctgcccgttcacccccaaatccttgaggttggcccagcagaggactttcagctccctggtcagcacctctagtgaccacccaggctggggtccctgtggggcacttgcccctgtgagcacatggaggacaccagcctgctcacctgacaccatttaattcgaggtggagttgacaggctggaagttgccacccgcacacctgcctgagggagaagccctccgtctgcctgcaggcctgtgtcctccctgctctacccacactccactgaggcagccccagacccaccgcgcgcccaagggagcagaggccccggaaaggttgtttcctgaggggccatccagaaagcgggagggcttgggacccatggagcagcaggtccggagggagagcatggcctcttcccgtgtcctgtcagggtccccagcactgcagggccacactttgcccagaacagctcactggagttgccaccgcagctagggaagggccttcactcaatcccattctctgtgtctccctagaagggagagccctggacaatgccccagctgggatgttcccaggctggtcccattcaccagtcagatgtcctcctgatgtcagccccggccccaaaggtaatagagtgagctcaagaactcaaccagaatcctgggctgggtgggggccaccattgggatggggaagtgccttggacaagtggcagggaagcaggactctggttactccccccacccccatccccacagttgttgctgagatggcaggaaggaatccctggatggggtgtgcccggagcccttctcccagcgtatcaggaatcagagccacaaggctggagatcctaggcccagccacagcagcaatctgaggcaaagacccagcagggtaggggctgtcccagagtcccctcccatttcaggagctctgcttggaggagggaaggtctgggaagcaccctgtgcccaccatcaccactgcactgaccacagcccttgggcttcctgagagcagcacgtgctgtgcttggctgtataacatcgtccagccatggctaggggcagcagcatctgtccaggtccctcagaacctgtcctcactgggttggcatacagaggccagtgcagccaggtgggcaaggacagtctggaggggctccccggggtggcaggagcttcccatcaggcacgaaagggcccaagtctcacctttctcctgtgactcattcattatgagcttgtaatggggatctgaaatcaagcgcatgctcttctcatcacttgtgaagccacagccattctaagagaagcagcttgggctgtccactaccccctgctgaaccccgagagtcctggctcgccactggctgactgggccctgccccacaggtcccgctttccaccacacctttgctgtgggcatgtgagggcaggaatgaccctgcctgttccctaggcagagcccacccagcacatcagcctcatcctcccatctgactacaagacgcccatggtgccaggcaggacctgggccccaggggtacaggggtgaactctgggagcccctggccatggatgagcatggtcagtgtcatgatcctgtgggcatcagggactggggagaggctcaagaagacatggggaagggggatcctgacataacagatgcctggtgatggaatacttagcacctaggtaaggcagcaccagggagcggggagggagatgaggctgcaggcactggtgccctcgctggagcctctgctgaagcagggagggaggagcggagccacatcctggcgggccctctttctgctctggtgggcagtgggggtgaggagctgctaagggtgcagttaggaaggcccagcccgaggacagtgtgggcacaggcgaagccgggggcatgcctgctcctgatccggcatgtttagttggagaaaattcactcagttgtgcaccggcactgggcatgttttccttctacgaagtttttaacagatgtgtacctgaccctgcctggagaggggagggctggcagggtcagcgtttgaaatgatgctgcccccggcgggacaggcagacaaggagggcaccgccccgggcctaggcgggtctccgtcctggggcaggggaagagctcagcatggcaggacctagcgtgggcttgctgccctgtgtcctccctgagcccaggcaggtgctggagttcatgtgctgcgtttctgctctgcgggccgccgccgtgttcaggcgcttggggaggcagggcaggcctagggccctgtggctgggctcacccttgttctcccacttcagatgctcgatcttctagtggagcttggccagcaactccaaggactgctgctgtaggaactgcaggcccaggtccaagtccaggatctgcctctgctggtcgatctggacacccacagaccggcggcactgcggggggtgcgacgtaacctgagatcccggggaccagctgggaggctagctcgcacggctcatgtcgccacccccaactacacagccgctgccactgcaccctggctcagtggccatgctgcccgtcacaatggaaaggggcgtggctgaggagcagggtgggcagctggggcagggcctgtggctggctcttcctgggtgagtacagtctgatttaaaaggcacccagggctgggcacggtggctcatgcctataatcccagcactttgggaggcccaggtgggcggattacttgaggtcaggagtttgagaccagcctggctaacatggtgaaaccccttctctactaaaaatacaaaaattagctgaacgtggtggcacgtgcctgtagtccaagctacttgggaggctgaggccggagaatggcttgaacccgggaggcggaggttgcagtgagcagagatcgcgccactgcactccagcctgggtgacagagggagactctgtctcaaaaaagaaaaaataaaataataaaacgcattcaggcattctctacagcctgggcaacatagtgagaccctgtctctataaaaagtaaaagaaaaaaaattagccgggcttggtgctgtgctcctgtagtcccagctacttgggaggctgaggcaggaggactgctggaatcccggaggtcaaggccgcagtgagctatgatggcaccactgaactccaggctaggtgacacagtgagatgctgcctaaaagaaaaaaaaaaaaagaaatatgtctttctttacaaggcctgccctaaaaaaaaaaaaaaaaaaaaatgttcgccagagccaggccaactgtgattttaccagatgccaacatacccaacccaagggaggaagggaacatacccaatcccagcctgttctagctcctcttccccacatcttcctgccacatcaatagggctcctgtataataacaggggatacaagtgaaagaacagcccatctcagaacttatttgagaaatgtctaggaaaccctaaagacaacagggagacaaaaactaagacaccagaggaagtttatgcctctgacacttacagttagaacaaacagcacacatggcccaacccctaaccagagcaaaataaaacctcacacaggccgggcgctgtggctcacccctgtaatcccagcactttgggaggccgaggcgggtggatcacgaggtcaggagttcaagaccaccctggccaagatggtgaaaccccatctactaaaaatacaaaaattagcgggcgtggtggcaggcacctgtaatcccagctacttgggagggtgaggcagagaattgcttgaagccaggaggtagagcttgcagtgagcggagattgcggcaccgcactccagcctgggtgacaaagtgagactctgtctcaaaaaacaaaaacaaacaaacaaaaacttcacacagaaagcccatttatcacgtaccccgtacagcatgtccagctccccacaaaaaatttcaaggcataataaaaaccaaaaaatgcagtttgaagagacagcaagcatcagagccagactcaaatatggcagagatgtcggaattatcagaccaagaaatggaatacaactatgattaatatgctaagggctctaatggaaaagtggacaacatgagattacagacagaaaatggaaacagggatagacactctgagaaagaatctaaagaatatgtgaaggccgggcacagtggcttatgcctgtaatcccagcactttgggaggctgaggcagcggatcacttgaagtcaggagttcgaagaccagcccagttcgagaccagatggcaaaaccccatctctactaaaaaatacaaaaattagccaggtgtggtggcatgaacctgtaattccagctattcaggaggctgaggtgggaggactgcttggacccaggaggtggaggttgcagtgagctgagattgtgccactgccctcaaatctgggtgacagagtgagacaccaccaaaaaaaagaaaagaaaagaaaggaaacaaggagaggaaagaaaggaaagaaagaaagaaagaaaagaaagaaagaaagagaaagagaaaataaagaaaaagaaagaaagaaggagaatatgtgagaagtcagccaggtagtgactcatgactgtaatcccaacactttgggaggctgaggtgggtggatcacttgaggtcagcagttcaagaccagcctgggcaacatggtgataacccatctctactaaaaataaaaaaattagctggatgtggtgtcatgcacctgtaatcccagctactcaggaggctgaggcaggagaattgcttgaacctgggaggtggaggttgcagtaagctgagattatgccactgcactccagcctgggcagtaagactccgtctcaaaaaacaaaaagaaaatataagaagtcaaaaacacaacagaatgaaagatcagggctggcagcagtggctcatgcctataatcccagcactttgggaggccaagttgggtggatcacctgaggttaggagttggagaccagcctggccaacatggagaaaccccgtctctactcaaaatacaaaaattagctgggtgtggtggcgcatgcctgtaatcccaactacacagaaggatgaggcaggagaattgcttgaacctgggaggtggaggatgtagtgagccgagatcatgccactgcactccagcctgggtgacagaaggagactctgtctcaaaaaagaaagaaagaaaggtcaggtgcatggctcatgcctgtaatcccagcactttgagaggccaaagtagaaggatcgtttgagcccaggagttggagaccagcctgggcaatatagccagaccctgtctctacaaaaaattaaaaaaattgccagcatggtggtgcacatctgcagtccctgctactcaggaggccaaggctgcagtgagctgtgattgtactactgcactctggcctgggtaacagagagagaccctgtctcaaaaatggggtaaaatggtataggaaatttggatctaaaaaaaaaaaaaaggaagtgcattagataagaaataaatgaagataaaatagaatcttttttttggtgggggtggggaacggagtttcactcttgttgcccaggctggagtgcaatggcacgatcttggctcaccacaacatccgcctactgggttcaggcgattctcctgcctcagcctcctgagtagctgggattacaggcatgtgccaccacgtccagctaattttgtatttttattagagtcgggggttactccacgttggtcaggctggtcttgaactcctaacctcaggcgatctgcctgcctcggcctcccaaagtgctggaattacaggcatgagccactgcacctggccagaatcttgtattgttcttatttttagttgaacagatggcaggttattcaaaataattatatcaacatgtattcagtaattatagcttatggatagctggaatgaatggcagcaatgttataagggatgggaaggaggatatcctgagtggaaagaaagtcacccaggctggagtgaagtggcacaattatagcccacttgcagcctgcaactcctgggctcaagccatccttctgcttcagcctccctggtaactgggattacagacacacaccaccatgcctggctaatttttaaattttttgtctcgctgtgttgcccaggctggtctcaaactcctgggctcaagaaatcctcctgccttagcctcccaaagtgttgagattacaggcgtgagccactgtgcctggtttatggttgcttttgaatgtcctagtcctacataagtggcttccaagaagggaaaaagaaaaatgcaggcaggaaaaggtgctgatccataaaaacctctggaaggtatgtctctagggagggggtgagtgttgaggagggatgttgcaaacatggtagtggagatggcaagagtggctgcctgcctcttcgtctgcacttccacaatctgaagcagccatcatcaatcggaacacagatccccagtatttggaggatggggctcttattgcctgctgtggctcctgcaagctatagggaagctaccccagaagtataggcatggctgcttgcaccaccaatttaaatgctaattacttctgaaaacaccctcacacacatgcccagaaataatgtgtaaccagatatgtgtgcatccagtggcccagacaagttgacatatagaattaaccatcacaagtccaccccttgtcaacctggtacctacacacatctccttaaaccatacttaacctccaaataaacacaataacaaagtcagtgttagcagtggaaggtgtctgagttagtggcagcgaatccgtatgggtctgcagcaacctcaattcttgcctcctcagaaaaaagaattcaactggccgggcatggtggctcacgcctgtaatcccagcactttgggaggccaaggcgggcagaccacgaggtcaggagatcgagaccatcctggctaacacggtgaaacctcgtctttactaaaaatacaaaaattagccgggcatggtggtgggtgcctgttgtcccagctacatgagagactgaggcaggagaatggcaggaacccaggaggcggagcttgcagtgagccgagatcgcgccactgcactccagcctgggcgacagagcaagactccgtctcaaaaaaaaaaagaattcaactgaggggcataaggcagaaaaagagaccgaggcaagttttggaggaggagtgaaagtttatttaaaaaagctttacaacaggaaagaaagtattcttggaagagacctaaacaggcacataaaggtcaagtgcggtgtttaaccttgattctaggactttatagactgacccctttcccaagattcttcccctagggtgggctgcctacatgcacagtgtcctccttacccttgggagatgagcacacgcagtgtgtttaggaaactgtacgcatgcccatctgaagatttcttccgtcccagaaggtcatactctgccattgtctcttaatgcacatggccggggaaattgcttctccctggtgcctgcattcaattaacactttaatgaaacaggtgtgacccatcaggaactggcctctccctgatgccagctgccaatttatcactttcatttttaatttattttttagaaggagtctcactctgtcacccagactggagagcagtggcatgatctcggctcactgtaacctctgcctcccaggttcaagtgattctcctgcctcagcctcccgagtggctgggattagaggcatgcaccaacatgcctggctaatttttgtatttttagtagagatgggctttcaccatgttggccaggctggtctcgaacccctgatgtcaagtgacccacccaccttgacctcacaaagtgctaggattacaggcatgagacaccatgcccagccctggctttttttttttttttttttttttttgagacggagtctcgctctgtggcccaggctgtagtgcagtggcatgatctcgcctcgctgcaagctccgcctcctgggttcacgccattctcctgcctcagcctccagagcagctgggaccacaggcgcccaccaccacgcccagctaattttttgtatttttagtagagacgggatttcactgtgttagccaggatggtctcgatctgacctcatgatccgcccgccttggcctcccaaagtgctgggattacaggcgtgagccactgtgcccagccgctaattttttattttttattgtttgtagagagggggtctccctatgttgcctaggctgttttgtttttttttttaaacagagacagggtcttgctatgttgcccaggctggtcttgaactcctgggctcaagcagtcctcccatcttggttttccaaagtgctaggattacaggcatgaaccaccaggcccggtctccactgtgaatcttttttttttttttttgagactgagtttcactcttgttgcccaggctggagtgcagtggcaccatctcggctcaccgcaacctccgcctcctgggttcaagcaattctgctgcctcagcctcctgagtagctcagattacaggcatgcaccactacgcccagctaattttttgtatttttaatagatacaggttttcaccatgctacccaggatagtcttgatctcctgacctcatgatccacctgcctcagcctcccaaagtgctgggattacagatgtgagccaccgcacccggccgctaatgttttattttttattgtttgtagagacagggtctccccatgttgcctaggctgttttttgttttgttttgttttgtttaacagagacaggatcttgctatgttgccaaggctggtcttgaactcctgggttcaagcagtcctcccatcttggtctcccacccaaaatgctaggataggcgtgaaccgccaggcccggtctccattgtgaatcttttttttttctttttttttttttgagactgtgttttgctcttgttgcccaggcgggagtacagtggtgcgatctcggctcaccgcaacctccgtccgcctcctgggttcaagcgattctcctgcctcagccttcctgagtagctgggattacaggcatgcgccaccatgcctggctaattttgtatttttagtagagatggggtttccccatgttggtcaagctgatcacgaactcccgacctcagatgatccacccgcctcggcctcccaaagtgctgggattacaggcatgagctaccgcgcccggtttaccattttgaatcttaagaggacaaagtctggttctctagaaggcccgagtagcttttcccctgagcatcttgagaaaaaagtgctctgagcactccttgggaagtccgagacagcacatgcagccaggtgctccctggctgctctcccagaggtcagcacagctggaggcagctggagggaggaggctgcagaggcgctgaagccaggaagacccaacagtggagagagaagttgcctggtgactgaccctcggcttgaccctgtgctcccctgggctgagctgggtgtcaaaaggcctccaccctccaaagtgccagcctcctgctgtggctggaaagcatttgctcctcctcctcttctcacttctttgcattcttctgatctcttaagggcgtacaaagattcacatggatattaaagtcaatggtgattttcatagctggaatactcgttgggagaaagtaggaattcttttttttttttttttctcccaagctcaagcgatcctcccacctcagccttctgagtagctgggaccacaggtgtgagcctccatgatggcctggctaattttttatatttttagtagagatggggtttcaccatgttgctcaggctggtctcaaactcctgagctcaggcgatccacctgcctcggcttcccaaagtgctgggattacaggcgtgagccactgtgcctggccaaaagtagaaattcttgattgggaaataattttatatatttcggccccttctcacttgggaaaattctgctaagaattctggttttgagagtcaagggaagctagcttaatttttaaagtgaaggctacataagagtcctctctccagtgtggtggctcacacctataaacccagcgcttcgggcaaatcacttgagcccaggagttcaagaccagcctggcaatgtagtgagacccctatctctacaaaaaaatttaaaaattagcagggtgtggtggtgcgtgcctgtagtcctggctacttgggtgggatgctgatgtgggaggattgcttgagcccaggatttggaggttgcagcgagccatgatggtgcattgcactccagcctgggcaacatggcaagacctcgtctcaaaaaaatacaaagagtcctctctatgttggaaatgtcagagttattggccatttaggggatctaacttgctctttgatgtccaagaggaaaggtatagagttctcctgattacacagggcctctgcttgtgggtcgcctgcatgaggcgatcagaatctgagtcacctgggatcatgtgggtgctggtacatcctagagataggatgtgttggtcatggaagagagtgggccacaaatgggttccaggggaatagcgttgcctggtgcaaggagggggatgtggaggtgcagggagcaggggtggtgtctggagagcctgaagctgtgctgccagaggctccaggccatgaggtctgagaagcatctagatttggcctgttcacagcagggaagtgtggtccagtggcaaaaagttgagggcatcctaggagttgaggaggtggtggcggttagagtaaaccactctggaggcgtccggggtggagagacgagaatgtgcaagaactcctgcctctagcctggcctcctcaggaccccggccaccagcctccctcctagaagtccccagagcttcctcctccttgtgccccagaactggttcctgggttgctccaaccccagaccttccctggaagtcccccccagtgcctcctggctgggaacccccaactgcattttgcttctgctctcgtgccagtagtccccttttctctccagtgtccaggccccaaccaccaagaccctgcctcctcacttggctttgctgttcttagttctctactcagtaggttgtgtctgcctccattcctggccagacgctgccctggggctgagtgcacagtccccagccactcccgagatcctcagagcttctggaagccacagacatggtggcatatgtttcaggtcgtcagcttgtttttttttggagacagagtctcgctctgtcgcccaggctggagtgcggtgacgtgatcattcactgcagccttgaccttctgagcccgggtgatcctcccacctcagcctgtcaagtagctgagaccacatgtgtgagccaccacacctagctttttgaatcttttttttttttttttttgagacggagtctcactctgtcacccaggctggagtgcagtggcacaatcttggcttactgcaacctccagctcccaggttcaagtgattctcctgcctctcccgagtagctgggattacaggtaggtggcaccacacctagctaatttttatgtctttagtagagacaaagtttcaccatgttggccaggctgatcttgaactcctgacctcaggtgatctgcctgtcttgacctcccaaagtgctgggattacaggcgtgggccacgcgcccagccaactttttgaatcttttgtagggatggggtcttgctgtgttgcccaggctgggcttaaactcctggactcaagtgatcctccctgccttggtttctcaaacttctgggattacaggccaatctactcaacgttgatattgagtagaaggcaaaattcacatggctccggcccagcccctttctgtctcaggcacttcagtgttaatatgcgccttggttttgctgctgccgagtctactgtgcccctgggcaaggaaagcaaaggaaaccagagggccaggcccgtggacactggggtgaggggccaacagggtgcccagcagttgtttccacagcccccacgtggtcagggaccctgtatgggtgaaccgcctggatactgagcctaggcggcggaaaactcaaaagcaagggcaggtttattcagatccctggtggagttacaagcttggtttggtttttggtcacaggccctaaaatacctgtattctgagtttacataaaaatacaaagcactggccgggcgcgctggctcacacctgtaagcccagcactttgggaggctgaggtgggtggctaacatgaggtcaggaatttgaaaccagcctgactaacatggtgaaaccccatctctactaaaaatacaaaaattagctgggcatggtggcgcatgcctgtaatcccagctattcgggaggctgaggcaggagaatcacttgaacctgggaggcggaggttgcagtgagccatgatcgcaccgccgcactgcagcctgggctacagagcaagactctgtctcaaaaaaaaaaaaaaaaaaatcaccaccgagacgctgttctccctggtgtgtcatctgtggggtgaatgaaggtgtgagataccccgtggtggtttctgtcagtgaatctgtagttgtcatatattttgaatacttcaatatcatcgaacagttgctgtgtctttaagcactagattttattgaagctaccttcttccctttttagtcccatttcccctagatgcatccacgactgcaggaacccccctgcccccaccaggagcccaaagataaccatgttcccacctggagtggcctcccacctccaatgccatcagggctggtgcagcttccccacctggtcagcaacatcatggccaaggagtagagggcgtagcccagggtgaacagcagtgcacaggtgaggggcctgatgcagaacagagaggccatgaagaaagccagcagtagccagggcagtgtcaggtagctgcctaggaagtgcaggttgagcctgtggccgctggccagcgtgggctctgtgaggtggtagcaacagaagctggcaaggaagtcatctcaggaacacagagccgccatctggtctgcaaactgaagcgcaggcagtggcacgggggcatggggtggtggcaccacaggcctcaggacagctgcaccccacccccacaggccaccctgagactgcaccccaggcaggagcacccagaaccctctctgaagaggccaggccagccctcctgcccactcactctgtgtttgatggcagatgacagccggaaggatgctcagaccaagctggtaatctcataactccagaggggctgcagctccgggtccccctggtactcaatttcaaacctttgcagcctgttgatgatctagaaacccaggctatagggttgggccagaaaacatggccctggccaggtgcagtggctcatgcctgtaatcccagcactccgggaggccgaggcgggcggatcacaaggtcgggagttagagaccagcctgatcgatatgatgaaaccccgtctctattaaaaatacaaaaattggccaggtgcagtggctcacacctgtaatcccagcactctgggaggctgaggcaggtggatcacgaggtcgggagatcaggaccatcctggctaacactgcgaaaccccgtctctactaaaaaaaatacaaaaaaaaattagctgggcttggtggcgggcacctgtagttccagctactcaggaggctgaggcaggagaatagcgtgaacccaggaggtggagcttgcagtgagccgagattgcgccactgcactccagcctgggctacagagcaagactccgtctcaaaaaaaaaaaaaagttagccaggcatggtggcatgtgcctgtaatcccagctattcaggaggctgaggtgggagaatcgcttgaacccaggaggtggaagtttcagtgagccaagatcatgccactgcactccagcctgggcaagagagggaaaccttgtttcaaaaaaaagaaagaagagaaaaggaaacatggcccctgcacacaactcagaagagccaagccatctctgctcacaggggaggagggagctggggacacgtcagggcccaacccatgcacctctgggacttgggcctctcacctggtactggcccaggggcgtggggatgagtctgtcctcacccgcgatgcagtccggagctgcttctttccattctcatcctggatggtgtccaaggcaagtgtgagagactctgcgtgagctgcacttcactgagctaccagagagagagaagctcctctgccctcagtgtcaaggcaaaggaacaccagtcttcaccccaccagcctctaacagtggcaacgagagcacccggacatgacactcggggtgtgggcctgcctcccacaacaccgggttcatctgcatggggcctgggacggatgcatgctgaccatgggcaaagggggagtggatccttcggggaaggggaccctaacggccgtggaacaggccccattgctcatactcggaatatctggcgcaggtacgccagggcctcctccaggcactcgtccatcttctggacgctgtcctgccccatctcgcccaggtcatggctgaataggagccgttggtgtctgtggggccaaagcccagccacaacaggaaggagtggccagctggagtctccacacactggtccgagatggacctggccgtgtgcttggcctgcgtgatgagctgagtaaggtgcaggacctgcaagggaggcgagggcaggtcaccggcaggatacgcctgtactgccacccaggcaggctggctgggggccctaagatgggtgcacagccagatcactgagtgacgggaggagcagcttctgctggaggacttttaaagactaaagaatgatcttctaaatgtgaaatttcccaacactgccttcgttatcagaaacaaatcagactttactgaaacggggaaaggagatgtgcgtcaactctccgcccaacctccctccctcccgccagaacacagcacttccctgcctctgctcagccttgtggctccaggggtcctgtgaaggggcaccgccaacccactcaccagggtgtaagcctcgggcccgaacatcgggtgtacttgcagtcctggccctccaggccatagatgtgactcttcacattgaaggaggcatcagtgaccactggtggccactatgacaggatgctgctggcgaatgtgcaggctgtgaagagtcggtgctggcggtagggggatgacgagctccggctccgggaacagctgctcgaactggaaggcaggagacgaacctagcgcccacttccgggggcacagagaacctggttgctgcccacaggttttcaggatgcctccgaggtatctggggagccatgacccaggggtgtcctcctgaggtcctgcccagcagtgtctcccatgtagcaggtggccgacatggggagggcaaatgagggagctggtggctcacagagcccccgacagtgtctgcaggagggcaaacaccaggaggagtgacagaagccaatgtccaacccagccaagacaaacgcatgccagagaccaagaccgcctcccaaggatgctgccacgagttgccagggagaaactgtggtgccatgggcccgcagcttggtctgtgcagaccccctctgtgggtatacctgcggtcttccacccagtgcctggtgcctggtggctgcagggcaggcagggtccagccggtctcagccttaactgtgcagtgttatggatgacagctcaggagactgttggcaggcagggagggcaggacacaggcaggtgagacccaggccctctgaggttgctgcatccttagcaggcctgaggcccctttccaagaggactgaagccaccatggcagaggccagcccagagcctgagggggctgagggaggatcccccagagggtccaaaggggaaggcctcgggcaaggaaaggagaggtcagtggccacgccaggtgccatggaagcctgggggggtctgctgtgaggatcaagcaggagatgaggggaaggtggccactggtctgctctgtgctggtaaggaagggttaaggaacagtttgggggtcaccatgaaaatttgtctgggccagaagggagaggggacaggtcacccactgcttccatgagaaacccattctagggcctggcgaagttgagcctaggaagggctggtctgtgctccactcagcagcagctgggagagggccagggccaggctgaccccagcacaggccgctgtcttggcctccacccactggagcaacatttgcccaggggagccagtggcatgtgaggagagggggccagggctcaccatttctcagacacactggggctgggagttgctgctggcagcctgcttgtcagctgcataccaccatggctgcaggtagctcagccacacctccaggacctgtgggggaggtgtgtgctgaaggcccagtggctggggccaaatcctctgatggcctggaacccaggtacccaggtggcagctaagttggctcttcccacgtcccccagagggcgcaggagagacgcgcacagccctgtgagatttggttctctcactgctcttcagaagccagggtcatgggcgggctcttcccggcccacgggacccagtgctacctggttgcgtaagagtagaaacctgtctggcaccagacaggtgggatggggcagggctttgctgtgcctgagggttgcctttggaaactgaaacagaaagaacaacgtggccctccaaggccccctcctctccaaggtctctgtgacaacacttgttctccttcatccaccccaggggacctccctcattggggcacacagaagacacaggcacacatgtgatggggccgacactcctagctctgaacaatgcgtccaagggccagtggccaaagcaatgccgcaggaagaggtagagtttctgctggactaacctcgggacagcggcctgcagaggaggggagggtcaccagccgcttgcacagtaaggtggccctgctcacagatgagcccggggttcccattagtgagggttggctctgctgggagagagcactaggcacttctgagtggtaagagctggtttcagccccattcttcagaggaagaaaccgaggttagggagcatcccgaggacacagcatgcaggcggccaagccattgcatctcctgcacacacctcacctcagccccacacaaaacagcccactctgccagccccgatgggcctgggagtcaggacccgccccaacccttctcctgacgggtggggaggagcaagagacggcaccgtgatggggcctttttggccagtctggagagagaggctctgggagccagagatcagccggcagccccaccaggctagctgagaaggcacttgcgtagccctccagaggcctcacgtgctctgtgagcaggaagggattcccctcaccctgccccccatgccccggggagaggtcgccgtgggcaacaccggaggaggggaacgaggaggagacagcagcggctggaagccgcaagggccacccactgtttgaactcccccagcgggctggtggtgtgggagtggacgaaaggtgagacctgctctggcttcaggctgtcggcaaaggcgtgcaggtgcttcagtggcaggcgcaccaccagcatgtgccccttggtgggcatgaacgactcctaggtggaggaagaggagtcagggcctgggaagggctgcagcacgtggcctccaggtctgaccacagcccgccctgggacagctgatctgcctccacacaggaggcacgagccaggcaaagagtggggccaccactgtgcctcacacccagcgggtgtgccttgcactgcttggtctgaactgcgaccagctcgtggtagggaagtgcttggcccagcgcccacacagcctacctggggagaactcgctgagacagacgcatctgcttctgcaccgctgcacacccgcggtgggtggcacagggctatggcccgccagactgtgcccttggccattgctgcctatcttgatcctcatggcaggaggaggccgatgtcacccccaagctctggatccagggtctcccagggaagatggctaaggccaggaattcgagattcgcttgggcaacatagggaggccctgtctctacaaaaattttaaaaagttagctgggcatggtggtgtgcacctgtagtcctagtgactcaggaggctagggtgggaagatcgcttgagcccaggtgttcttggtgcagtgagctaggatcgtgccactgcactccagcctgggtgacagagtaagaccctgttcaaaaaataagaaccttcacttttctccccaattccttccatctgctcctcattctggacacagctggatgagggctcaccctgggagaagcgctgggcatcaattcctctgttgcccacagacctgtggtcaggaaaaccccaagacaagagcacagtcaagctaacaggccaagcttttgatttacaatgtacaagcaggatcctggagacctacacccaagaggaaagcctttttgctggctgtgggctttctctggttgctcagcattgagagggcaggggggagcatcaagagtggatgagggcaggagaagggggcactgagggtgggcccctgagtccgagtggacatgctcgcctctccatgcttacccccagccctttgggcctcaacacatctgtgatgctgagactggtgcagggcccggcctctgggtatatcctgggatgctgcagaacccacatggaccactgctcacatcactgcccactcaagtctgcccgtcaggaaaatgtccccacaggtccaggagacacaccccacagatcagtggctgaggctgggaatggaggtattttcttcttcttctttttctttttttttttttttttgagacagggtctcactctgtcacccaggctggagtgcagcagcacaatgtcggttcactgtaacctctgcctcctgggctcaagggatcctcccaccaaagcctcccgagtagcggagaccagaggcacataccaacatacccagataatttttctatttttttgtagaggcaggggtctcatcatgtttcccaggctggtctcaaactcctgagctcaagcaatctgccttccttggcctcccaaagttctgggattccaagtttgagccaccgtacctggctattttcttctatctctatctttaagtatttaggcaatgaatttgcattgctttggaaggaaggagaaaaccagtacctatacggcccgactagaatggtactagtggggtgggaagttagaccagggtccttctcctccagtctcacccctggccctccctctgatcctggcctgggatcctgagccatgacatcctccctgcagctcacgggaggggacagcatccacataggaactgggaacctgccttcccctgcaggttcacttacccaacatcacctggtccttccagagggtctggaggggccagtgtctgcccctgcccccagcagtcacatgaaagcctctcaggctattttcccacagatttgctgagccaaacttttccctcagctctgtacccctcctgggccacattcccatgtgtagtccctggccacagtcacacctgcttgcttctcaaagatgtgtacccaaagccccgcatttcccactgggcccagcctcacagcacctcagctcactcctccagggtctccctggtcacctgtcctgccatgggggttgctagatgcttcctggacactgccctggcccaagccctcatgtccctcttctccagtggctcctgcggaacagggacgccatcacatgcagtggttgccatcccaacccaccggcacttggggcccacatgtttttttcatcttgcgctcaaattcccattcaatcacgtgtgctccttcgcagggtgaacgggacagacccctggctgtgggcacagctcgtctccccgggctctcacagactcactaactctgtcgtccccgaaatcccccatgggcctgaactctgcttcactgacctcaaatccatccatacgcttgtcatttgtgcctaggcagaccacaacctctatgaggtcactacctattctcatccacctccacaggtgtctacgagtggccagggctccctaggtgaaggactgacagcctctgtgagctatagggccaagccccaggtcctccccaacccccttgcctcacacacagtctgggtcatggaacctccaagctggatgacagttctgaacagggcagcacccacattaccgtaagtcccaggcctctgtgtcttcagctccttccttagcactgggccctgcagagtgggggtgaaccgggccactgcagaggcctcacgactccagctcttcaaaccagggccgagcacagagcctccaacaccagagaacttgtgacacctccaccactggtggggagtctggccagcccaggccacatgcctcattctgacacacagccacaccccactcccacaagccaggctagtctgcaaagccaggggccaggccaggctggaggctgatctctgcctccctcaacacaggggcttcactctgcctgaaactagcctctgagtcacctgcagctgggcccagccagccccttgctttgccaggcgcagacacgcactccgggcaggggaagggaatgaacgagcacagccagtacttggtaggtgtggagggcctggaggttgggctgccgggggctgtggtgggcactggagacacagagtcggtagtgcagcacctccagctgagagagtgaacagagagaagccggaagaggcagaagagaaaagcatgagaggacagggtggtgaaggagagacatggtaccggacatgggagggggaagtggagaaagaaagcaatgagaacgagcccagaagtgaggagaaaaaaacaacaaaagcatggtcagtgaccatccaaacaactgcagtcccagcagctgtgaccagcgcagcaccctcctcggcagccaggccagagctgtgacagcactctcctcagccttggaggctgggggcggatagaccctccaggtcacctgggtggcctctcaatgtcgctggggcctaaaggcctctccagctcattggaagggcccaactcactgcccttccagatgggacccgctctccccagtgactctgaggccacaccgtgtgtgccatgtgcacaccacagcccttcaagtacccagggccttctctctgggacatgctgtcagccaccaaggcctcaagatcctgaggcccagaaaataaactggcaaagcatgttctaggaggaggactctgcctagagaagacacatatgtaattgactggatttccctgggttgttttgagaaatttatcaaatttgtatatgacatgatcaattcctatgtctaaaacccaatcaatgtcccctccatgagtggatctctctgagagctgaggatgaggacaggtccccaagggtagcacaggctcaggcccccaggccctgccctccgcactcccccagcctggaggtcagccgaggtggtgtgtgcatcagctctgactccaggaggcaacctctcctaccgcatcaggaactcccaccctccagatatggagggctcccaagggcaggagcccccgaggacctggccacagccacacacacccagaggcaacaggaaactgaggctaagctggcccccagccaggaccctccaatctaccaccctgcagcgctgcagcctccgaagcaccccttcggcccagcatagccagagctggcctggtgcatatcctgccccgtgagcgccatgcctcctgcccaagtagcacgaccactgggctccacacaggagacatcagaacacacctgctagatgtcacaacacgcagagcagggcgggaaggagcagggcagagagatgttgcccttcacagccttcctctgtgccagacctagggctcaggcaggaaacagacacacagttctccagtgcgtctctgcccttgcctaaggaacacggtggcttgtggggccattggccatctttatggcccacggggccaccagggagcaagcatgcacctcggattcaaccagggtgtggagggcaaccctgggagcctcacttcctgcatctgaaaataagagctagcagagacaggcagggatttctgtatggcaggagcagcataggcctgggcaagcggcaaagggccaggggccttgggggccccgacctccacagctgcctttctctgacccccacccacccagttttctcacgttttgttttttgcctcaactggaagaggcaaaaagtggagcatctctgggcacttcgtcccaccactgcaagtcattctgagcaggactcacgcaacccaaggtctggccaagaggaagcgaacattgagaagaggggaaaggcacctcctgccctctgcagggacgacgccttgccagttcccctgacccatgaggacacagaatcctcacaggtgacagcccagaagagcctttctggcttgcccttgaaagtaggtgtgtttccactcactcagtaggcagaaccagcagataggaaggtgacacagtgcagcggcccctgcccctgccaggtcaagccacatgcaagagcgctgagcaagtgttctagggcgccagggagaagcggggccctaggaaccaaccagccccccaggcaccagccaggcatatgcagtaagtctgctctggaagcgggaagggcactgcaggctctttgtgactcaggaggcccaagatggggtccccaacttttccttgtgctccttccaggtgatgctgagggtgaggatttgggggaacctatgctctgagagagccttcacatggcaaagcatggggccacagaactggctgcagaggctgtggcagaaacagacccacagctcttctccagaaccggaggaaaagtgacaggaggctcttctgaagtttaactccatcacccacagatccttcattctggatgaagccttctggaactttgtcagcaataaaggcaaagtctcccatgcatagacgccacgggcaccggactacaggatgtgtgcccagggcatgctgcctagagagagagtggggagaggcgaggcggagggggaggaagcaggccaggctgcttgtaggagggcgccaggccccacacaccatgagtatggcggcttgctcatgctctggaggaggtgggggagtggggggcagacaaaggaggctaactatggtgccactatggtgggcatgggtctgccctgggccatcacttcatgggaaagcacaaaggcactgctgatggtggaggagacagacgagaacgcggctcccagaggcattgcagctcccccacccccacagcaaaagtgccacaacctcatctgttcctgttgccagggagggggctccggaagctgcacaggaaaggccctggagaggccagacctccaggcctcagtgtccacatatcagggtgcaatgccacctgctcctcatcgggaactagagaactatgcccacttcttattcagcttctgaatgaagggtgggtggtggatttctgcttcccaccatccggtctgtgaaaactcactcaaatgcaggataagaagcagcaggctgagcatggtcagaagcaggaggtgggaagaaaaactatggaaacctaccttggcatgaggggaactgcattttttggtacatctccagagaatagtgttgaagccacatttcgacaaaaacctgcaaaagagcattacgtagtcaaatcattctcgataactgccaagaccattcagtggggaaaggacagtgtctcccataagcagagctgggaacacagaacaccctcatgcagaacagtgaagctgggccctgccctcacaccatcgacaaaaactaactcaaagtgggtaagcggcctgaggataagaactaagaccataaacttacagaagaaaacatgggagaaagcttcataacactggatttggcaatgatttattagatatgatgcccaaatcacaagcaacaagcaaaaaaatacagcatcaaaagatactactgatagagtgaaaagaaccagcgggcatgatggctcaggcctgtcatcccagtgctttgggaggccgaggcaggtggatggcttgaggccgggagttcaagaccagcctgggcaacatagcaaaaagttgtctccacaaaaagcacaaaaatttgctgggtgtggtggggcacagccatagtcccagctactgggagtctgaggtgggaggatcgcctgagcccaggaatttgagctgtagtgagccaagatcatgccactgcactccagcctgggaaacagagcgagaccctgtctcaaaataaataaataaataaataataaaataaaaatagaagcaactccagtgttcactgagagatgaatagataaacacaacatggtacatccgcacaagggaacactatgcagccttaaaaaggaagcaaattctgacacatgctgtaacatggattaatctcgaatccattatgctaagtgaagcatgccagtcacacacaaagaagtactgtgtgctacagaaaaatgctttagatatgagatctaggagtcaaacatatagaaacagaaagcagaatagtggttgctaggggctgcgtggggaattaattgttcagtttctttttttttattaaaagagatggggagccaggcatggtggctcatgcctgtaatcccagcactttgggaggccgaggcgggtgcatcatgaagtcagaaattcaagaccagcctggccaagatggtgaaaccccgtctttactaaaaatataaaaattagctaggcaccgtggcaggtgcctgtaatcccagctactcaagaggctgaggcaggagaatcacttgaacccgggaggcagggattgcagtgagctgagatcgcaccactgcactccagcctaagcgacagagtgagactctgtctcaaaaaaaaaaaaaaaaaaaaaaaaaaaagagagagagagacggggtgtcactatgttggcgaggctggtctcaaactcctggcctcaagcaatctttcccaccttggtctcccaaagtgctaggattacaggagtgagctctcatgcctggtcggttcagtttcagttttgcaagattctggagattggaaaggaagcaaattctgacacatgctgtaacacggattaatcttgaatccattatgctaactgaagcatgccagtcacacacaaagaagtactgtgtgctacagataacaacaacgtgaatgtatttaatactactggctgtacacttggaaatggttaagacagtaaattttatgttatgtatattttacaattacagtttttttcttaattaaaaaaacgaaaagcattaatgctttggtccaggaaacagcagaaccttccagttctgtcctgttgtaagcttgtgtcatggtctcctgccctcttcacagccagcacatcccatggtccacacagccaagagccatctgggtatcatggtcccctctggggaccatgcccctcccagggacaatggtccctatcattctagcacccgaggttgttgtgaaatggtgtggaggcttcaaaaagcacggcaccccacatattaggagttatgtacaaggtcggagacagaatcctatcttatctacttcccaggtgtcaacggcgaggctgtggctaccaagtcagtcctaggatccagtgtcaggagcagcacctgccaaatctctccaagttatgctcagaagacacagccaggacctggtggatagcactcagggagtgagccagtccacaccatcgtgagaggctggagccccccaggacagacaagggactctgtcacctactatttggatcccctgaatcaacagaaggcctgtggaggctgcacaaacccctcaccattccgtgtcacaaaagtgctactggggcaacgcttaatatccacatgatggtaatcataggaagcatctccagcaacacgagagacggacaccaagagaccgcaacaattatatcacaatgggcaaatgaaacgactccgatggacaggggatcctgggatgaaaaacaccatgaatgacaagtaagttaggtgggtgggcagacttatattcatgttttctaaatgtcataccaggaaaatgccaacaatttagaatcagccctgggctaagcggccgcctctgggactctgacccatatagtggaagatggctgaccagtttcttttgaaacagacgttgagaccagctcagctctcacccggagcagagtttctgacctccagatctcctgggaggcggggtctgcattcacagacatctgatgagagaagtgtcgcttcagggggctagtgtgctggaggctacaggaagcaaagggcatggctggtgtcctgagggagacacggaaacaggcccaaggtaggagctcctgctggccaggccaggggcgatctggacatcaaaatcaatgacagcagggacgtattacaacttgttcaattgcacaatgcacaaacctcacccctgccccaaatccacactgatacacctgaataaacaaatagcaaagagaaaagtcttccttcccgcagagcgaccactgacccaatacaggaagaatgaagttagggaaccaccacttggcaactgccctattaatagcttatttggtcaagaatcaagtgaggccaggcatgggacctgcgtgagacgcctgaaatctcagcactttgggaaaccaaggcaggaggatctcttgaggccaggcacttgagaccagcctgggcaacacagtgagaccccgtctctacaaaaacattaaaacatgaaatagctgggcacggtggggtgtgcctgtagtcctaactacttagaaggctgagaagggaaaatggctccctccttgggcctaggagttgaggctgcagtgacctatgatggcaccaactgcactccagcctggggtgacagagcgagactctgtttctaaaaaaaataagatgtccagcttgggcaacatgggcaaaacccatctctattaaaaaaaaaaaaaagcattcagatgtggtgatgcatgcctgtagtcccagatacttgggaggctgaggcaggaggatcacttgagcctaagagattgaggctgccgtgagcctagatcatgccactgtacttcagcctggggtgagagaacaagatcctgtcttaaagtaaaataaaatcaatttgaaaaaaggaaagaatcgacttctctgtgtatggagtagcccttcttctattcctttactttcttaataaacttgctttcacttaaaaaaaaagagaaaagaatcaacagttgatgttaatactagtgataatacatagtctctatacatcttcccggtaaatcatcattaccaatttttcttttttttgagacagggtctcattctgttgcctgggctggagtgcagtgctgtgatcacagctcactgcaacctcaacctcctagacccgggcctcccaagtagctgggaccacagtgcacaccaccatgcctgcatgcctggctaatgtttttctttctttgttttttgtttttgttttttttttgagacagactctcactctgttaccaggctggagtgcagtggctccatctcggcttactgcaatctctgcctcccaagttcaagcgattctcctgcctcagcctcgttagtagctgggactacaggcatgcaccaccacgcctggctaattttttgtatttttagtagagacggggtgtcaccatgtttctcagcctggtcttgaactcctgacctcatgatctgcccgcctctgcctcctaaagtgctgggattacaggcgtgcaccaccacacccagctaatttttgtatttttagtagagatggggtttcaccgtgttgaccaggatggtctcgatctcctgacatcgtgatatgcctgccttggcctcccaaagtgctgggattacaggcatgagccattgtgcctggccaatatttttctttttagtacaaacaaggtcttgctatgttgtccaggcactcattactaatttttttttttttgagatgggctctcactctgtagcccaggctggagtgcaacagcatgatcttggctcaatgcaacctctgcctcctgggcttgagtgatccccccacctcagcctctaagtagctgggattacaggcgcatgccaccacgccaggctaattttaaaatttttggtagagataggattttgctatgttgcccaggctggtctcaaactcctgagctcaggtgatccacccaccttggcctccctaagtgctgggattccaggcgtgaaccactgcactcagcctcattactatttaatctgggcacgaagtacttattttacagtggacaaacctggccgacaccctttccacccagtgataaagctagcatcaccagtgatggggcaaaggggcactgcaggcctcctgatgagacacctggcaaggaccaggtgtccccgctgcagtgctcctgccaacaaagcccaagctatgcctaatcaccagcaaatacaagacagcccaaggggtggccacatgctttggaggggtcaaggtcaggaaagacagacaggctgcagaaccattccggactgaaggggactagaaacatcactgcatgcagtgggtgagcctgtgctgaaacccagccaggtaacgggcatgagtggggtagctggtggtgaaccccgaggtctgatgactaggtgtagcctggtggcaatactaacttcctggtgtggtggcatgtgctggcttgcacatgccagcagatctggggtgggccagcatctgcagaaacgggcctgtatgcagcctcctggggaaggcaatggggcagcaagattaaggagggtcagaggagcacacgcactgtgactatataagataatgcattcacttttaggaaatacactgacatattaagaggccaaggggtgtcctacctgtagtttattcttattggcttaggggagaaaaaacatatcatagaaaggggataaagcagatgcagcaaagtgttaatttggaaatctggatgaagggtctatgaactttttttttttttctgaaacagggtcttcttgtgtcaccccaggctagagtgcagtggcgcaatcatagctaactatagccttgaagagtgcacaagagatcctcccacctcagtctcctgagtagcttggtccacagttgcacgtcaccatactcagctgattttattttttgtagaaatgaggtctccctatgttgcccacactggtctcaaattcctggcctcaagtgatctttctgccttggcctccctaagtgttgggattacaggagtaagccaccatgcccagtctgcaagttctttttattatgcgtggaaacttttctgtaagtctgaagttatttcaaaataaaaagttagctaggtgtggtggcctgcgcctgtaatcccagctacttgggaagctgaggcaggttcaccctcccaatccgtgcagtatggcatcaggctcagcctgtttggtctggcacaacaggctctttggcccagggcctccccctctcaagacctgctcctggggccaataaaggattgtggaagctaggagttcaagacccaccagggcaacacagcaagcctcccctgtcatatctctacaaaaaaaaaatgttttaaaattatctggctgtggtgatgcgtgcctgtagtcactgaggtgagaggatgacttgagcccaggaatttaaggctgcagtgagtgacgactgtgccgctgcactccagcctgtgtgacagagtaagaccctgtctttaaaaagacataatgactgaatgtggtggctcatgcctgcaatccctgcaccttgggaggctgaggcaggaggatcatttgagcccaggagttctagaccagcctgggcaacatagcgagacccatcttacaaaaaatacaagctggatgtggtgttgcacacctgtaatcccagctactcaggagactgagacaggaacatcacttgaacctgggaggtggaggttgcagtgagctgtgatcacaatactgccctccagcctgggcaattgagcaagactctgtttccaatatatatatgtgtgtgtatatatacacatatatatattatacacacacatatatataacataaatgtgtatatatacacacattatatatatataatttctaaaagaaaaaattaaattacaaaaaaactcaaaagctgggcataaaaaccacttggcaactgaattgtacatctgagagggtgtgaatccacctcacctccaagtcctccacagcatcagcaacatttcagggtcactgaccactgccgccacccaggcagcctctcctccttgctgctccctttctcccctccaccctctggggcatctgtccacacatgtgaattgtaggtagaggcctgtcctggcttgcacatgccagcagatctggggtgggccagcatctgcaggaaggggcctgcacgcagcctcccagggaaggcgatggggcagcaagattaaggagggtcagaggagcacaggcagctgctgcctgtgcagagggtctcctgggaggtccccagagggtctcctgggaagtcagccaagaggccctgggttagggcccactgagaccccagcacagctaggcacaagagcccctggttcacacttcccacctgtgcagtcaccaacaggctcagcttgtttggactgacacacaggctctttggcccagggcctccccttcaagacctggtcctggggcccagagagatttccatttttttttcccccatagaacaagccttctgccatgctcaccacctcagacactgcatgtggggagggctgcttcatgcagaacacagcccattcccatgcaggccgtggaggcctccagagacctgatagcttcagtgatggccacagacatcgaaaactaaaggacagatcaccctcctcacccccaccctccagtctgtgctaagaaagctggaggtggggaatgaggcataagacaaatttgggaaccctggacaaagggtggcaccattgtcctggtgggtgattcaactgaccaggccactcccttatggaagggccaggtcttcacaatcagggtagccttacctgggagcaggtgagggactggcccatcctgggctggaggacagtgagggtggtggcaggctgcctttggtgggcaggaaccatgacaggtacctgtccaccaggaggaaataggtacagtctgaaatatggacatggagagacacagggagtggctggaaaaccaagctagttcttagcatggggtctgggcactgcctggccccagagcactggcaagtgcagggaagccccgggccatgcccccacccctcccagcaagaggcatcccttccctacctttagtgtgttgaggctcaaggcaaagaagcatatgtaatactcgaacggatctgatggcagcgtcaagggcaaatacacagggttgctgggaaacccccagtgttgagagctgagccacccacaaccttcctacctcaaggccaccaaaggatactcaaggccaggttcaggccaaggcccttagttgggcggaactggatcttgtgttacagaggactgtcaaggacgcactcctggatggatgccttcacgagaccctgcagagagaggcagcaaggcttgtgggcaggcactggcgtgtagtgcccggtacgcagtgccccacatgcacagcagccctttgggaaagctgctggggaagagacccgcacacagaactcacctgtggggacagtgccctgctcctgagcagtgcctcaacaagagtctttgctcagaacttccaccatctcataaaaagctgcagacaggccaggtatggtggctcacgcctgtaatcccagcactttgggaggccgaggtgggcagatcacaaggtcaggagttccagaccaacttggccaatatagtgaaaccccatctctactaaaaaaaaaatacaaaaattagccgggcatggtggcatgcatctgtagtcccagttacttgggaggctgaggctgaagaattgcttgaacccaggaggcggaggttgtggtgagccgagatcgtgccactgcactccagcctggcaacagagtgagactttgcctaaaaaaaaaaaaaagctgcagatggcaagggtagcagccatgcaatacccatctcctttgcctctcatacccccggagcaaatcactccttaatttgccctcagaggaccggaggagactgcccgtcaccactgggctgtgcaaggtccactgcccgagcaccactctcaccactgtggtttacttatgggcaggtaggagatgggaaagtcaaacttaagtcttcagcttgaagcttataaaccaacttcatcattgggccgctgaacatgaaattgaacaaacaaaaacagggtatatgaactgcaaattatcttgctttgattgtatcttaaccttaagaaattgagagtgacttaaaagtggaatcaccatgaggaagcaccctgcctctctcgggtgtcaaacctaccttcccagggtcgagaaattccatcaccatgctgtacttcacaggattcacgcgcctctgtaagcagcgcaggttccagcccacaaggacaccatccaggctgccgaaaatgctaccagccatggggagatggcgtgcagctcctgaaacagtgtgcggtgaggctgcaggcaggaccagcacccactcctgccccagctccaggcctgcaccacctgctgcccagctccctctgaggaggccactccctggctgagacccatgggatcagccctgcgctcaaaggaaccctggtgcggtgatgccaatgagaagagcagctttgggttctttcactggggtacgtggcttaccaagcagtgctgctttagacgtgggccagttaagtaagtcagcctctgatcaaaatacattttttgtgtgtgataaaagcctaaattaagggaaaaaaaaaacaaaaaaatgaaaaaatgaaaaataaaataaaataaacaaaatacctattcttttgagacagggtctcattctgttgccctgtctggagtacactggcgcaatgcacagctcactgcagccttggcctcctggcctcaagcaatcctcctgccttagcctcctgagtagctgggactgtgggcacacaccaccacgctcagctaatttttagatttcttgtagagatagggtcccagtatgttgcccagactggtctcaaactcctggccttaagtgatcctcccacctcagcctcccaaagtgttgagattacaggcatgagccaccacaccaaaagattttttttttaatgtcagaaacttctgatggatgcgaaggatgctctattagaaaggaaagcaacacccttcccagagtgaagcccttaaaatctaactgacctgttgtcatttggtattaactccttgtctaggccagcttcctgggcttgacaattccaggtgtgatttaaatacatatttttagcatttacatcagggttcctcaacgttgatgctattgacattttgggctggattcttctttgttgcagggagctgtcctgtgctttgcaggatgtttccagcatccctggcccctacttactagatgccagtagcacacactccccatcacccccagttgtgataatcaaaaatgtctctgatattgccaagtgtcccctgagggacagagcacctgtggttaagaactcctgatctgcaagttcacatatttaaatgtgtccataaacatgacggtcatgataatgggccaggactctgtgccaggcagtgcttggagtgggggtggtggggggaattaggaattataataaagtttttaaaggaatgtgtaagacatgctccaaagagagatgtcagcagagctatacctctgctggaaaatcctcaatgactttaaccaagtcttggcatcactgtgcaaagggcttatttacagagtcagctttcagggtagcctagaaggtagaacaaagtgaaaaaatcatgaggacattcactgcagcttttagtgatactctggcttgagtcaaacagaaatccaagtgataggttatgagtcagacacataaccactggcgtgattccccagcccctcatgtgtgtcagtggcccaaaggatgctactaggagaggctgtggttctatgcactctggaccaggaactctcaggcttgcttcccagtaccaactcagcgtgctgctcatcatcagaacaggactgacttccaccaatccataagtaggggttggccccagggtcagccccagagccagaagaggatctcgattgtgtaagggcacctctcacagaccacagagtactactgagttcgtacgcatcaaatggaaatttcccacctgatggaccatcatgattacacagttgtgatcatcagtaagaatgcccaacaaaatcagggctacagcatcctctcttaactgagctgtcttttattcagcagacagtgaacctactaaaccaatgaccttaaaacacagggcagggccgggcgtggtggctcacgcctgtaatcccagcactttgggaggccaaagtgggcaaatcacaaggtcaggagttcaagactagcctggccaaaatggtgaaaccttgtctctattaaaaaaacacaaaaaaattagccgggcttggtggtgcatgcctgtaattccagctactctggaggctgaggcaggagaatcgcttgaacctgagaggcagaggttgcagtgaactgagatcgcaccactgcactccagcctgggcgacagagagaaactccgtctcaaaaaaaaaaaaaataaaacaaagcaaaacaacaacaacaaaacacacacacacacacacaaggcaggtaaaaattatagatggcttgcaccaagtaaacactaaacataaaggcaatggagaggccagaaaagactcaggacaaggactaataaaatctacccacagtcgtgggatatacggaaagcatcctgactacaaggataaaaatagcgtctgtgcaaatggactcacatcaggagaaactgctagaatctgtctacctccaaatgccttgtctacctccaaatgagggtggatttcacaggatttgagacaagagatggagacctgagttgtctggccatgtggcagacctggtggctctagtggggtgccctggggaggaacgtccttccacatacatatttacaaaaatacctcctaagaactaaaattaggaactttcatcaccaatacttgctcatacctaacttctcgcttctcagtatcattttttcttttttttttttttgagtcttactgtgttgctcaggctggtcttaaaactcctgggctcaagtaatcctccttcctcggtgtccttagtagttagaactacagatacggaccattacacccagttctcagcaccatgtttaatagttaaagtgctaacctagcaccccctcagaacataagagtgtctccatttttcactaatgacaattatgattatcagaatgtttcatgtctgtttaagaacttacagatcatgaacactctgatgtacatcattctcatttgctcctccccctcctcctcctcatacccccttgggaagtagagaaaatagaacttgaatgaatttgtcttgtatgggaaaacccagagcccagagcccagcggttgagtaaccccaaggccctgtagtaataagggggcacagtcaagcttaaggagtctggcattgcttccatcacacgctcctaaaagacaaccactagagaattcttcaagtcaatgggaagaacattcaagtcccacagctacagagctgtggccacactgacactcatccagacagctgatatttaccagtagaaagctgggccgctgcaggtgagggaacgccataaaagcctccagtggagagttgaaaatggccttcttagcaaaccactgtggaaaaacagagacaaaatctcaacatctgcagcacagcagaatctttttatttttctagagacagggtctcattctgttgcccaggagagaatgcaatagcacgatcatagctcactgcaacctcaaactcctgggttcaagcaatccttccccctgagcctcctgagtagctggaactacaggcacacaccaccatgcctggctaattttcttcttattttcttttttgtagagacagggtctcgctatgttgcccaggctagtttcaaattcctggcctccactggccctcctgccttggcctcttaagtgctgggattacaggtgtaaaccactgcacctggccctaacaaaatattacatagtttcacaatgcccaggagaacatttgtgtaactcaacatgcattacattatcgattctcatgtcttctttatttatttgtagagacagggtcttgctttcccactcaggctggagtgcagtggtatgatcatagctcactgcaacctcagactcctaagctcaagcgatcctcctgcttcagcctcccaaatagctgggactacaggcacacaccaccaggccctgctaatttttatatttgttgtagagatgtggttacatcatgttgcccaggctggtcttcagctccagggctcaagtgatctacttgcctcagcctcccaaagtactgggattacaggcgtgagccaccacgcccggccagcaattcccacattttacagaaacaccattcgcatgcagcccacagtggccagcttcagagccaagtctgtggtactgaatccttggtaatgcttgtacagcacttgctgtatgccaggacttgctctatacaccacacacactgtcagtccccaggaggggaatgtggtatgtgatgcttcataaacacattgaactctttctgccaaggaacagccattaacaccttggggttacttgcaactcacctgtggactgttggtctgagctattgtccatcacttgcaactcagtgtacacaggttcatcagagctggtcccaaaagcaagtccaagcgctggagagcatgagtgggaaatctcacttccacctcggatggagaaaaacttcagcaagattgtcattttatctttccgacccagatggactccatcttgactcaaagacaaccagaacatcaccaagcatctcctacagggcaggcttggtactaggtggttttatttagattatttcatggaatgttcaggagaattgctccctcttcactcctgaattcttgatgcagttcttccactttcgccctttcttctcgtctctgtctcattcagctccctcattacaaaccttccaactggctggatggcgcagttgctcaaccagcagagagcactggggtagccccaaataaatgttcatgtcatctccaaattaccagcactattcccaggtcccaattcaagacaaaaccttatcagcctcatcagtgagagcacgttttcaccgagctgagtaaaaacttaggtacaagaccattcagtggggaaaacactcatttctttgaagaatggtgctgggagaactggatatccacatgcaaaaggatgaagctggacccctacatcacaccatatacaaaaattaagtcacaataggtcaaagccctaagtataaacactaaaactgttaaactctaaacaaaaaacatggaattacattttcaagatcttggatttggcaatggattcattcttatttggtttttaacttcattgtgagccaatttagcatccaaaattccagtaggtttggtaaaaattgacaagctgattctaaaattatagcaaaaatgtaaagggcaggccgggtgcagtggctcacacctgtaatcccagcactttgggaggctgaagcaggtggatcacttgaggtcagtagtttgagaccagcctggctaacatggtgaaaccccatctctgctaaaaaaaaaaagaaaacaccaaaaattatccgggcatggtggagtgtgctgtacctgtaatctcaactacttgggagactcaggcaggagaatcacttgaagccgggaggcggaagttgcagtgggccaagatcatgatactgcactccagcctgggtgatagagtgactctgtcgaaagaaagaaagaaggaaagaaaaaaaagaaaaagaagaaagagagagagagagagagacagacagacagacagaaagaaagaaagaaagaaagaaagaaaagaaagaaagagaaagagaaagagagaaagaaagagagagggagggagggaggaaggaaggagaaaaaaatgtaaaggacaaagaaaatctagactcttcttaaaggacaactcacctcatcctggtcatcttggcgtcttcatgattatgagcatgaggacttctagaattctctctctctgtcccctgtcctctctaggattccacagtcttcccaggtgaccaatacttgggatccacctttcaggcaaggtcctcttcttacccatggggcttacatatctaatccagtggttcttacccagagctgtgcactggcaccaggacaccccaggcacacttggggcagcccctagagattcggttggtctagtttggagtcttcttccacaaacgcgactgtgattgatttacatctgtgactgaatccctagtgaagatgcctaattgcagcacagtgacctcagtgacgctagccctaagcatagccacccagaagaacagggcatttggccaagcgagagtggtgttctgaggagggtcctggtcacacacctccatctgtctccacacctgtctggccatctgggcccagctaatcggagtccagtacctcttttcttggtctcaggcccacacagcttcactcttcgcatgtaagccatgcccctctgaatttctgatgccactatcttatctccagtgctggagttactacttctttcagggaacatcacaattctttccgcatttgaaacttcccactttcaaaagttttgtctttctcagtgtcacctcctctgtctaagggtagggcccaggtgtgagaagcagggaactaagagaaccatcctgactctcggggagctgttctgccttggcccgttgctgtgaggacacacgtccatggtactgagacagccaacagccctgggaaccagaaacctcaccctcctatgagcaggtcatggcaggtagacacaagccttgttctgggggccaggctaagaatgtcccatggattgaacagtagagacattgaccctgtttgaggtgtgaattctagatttgagctccagcagtgcagttagaagcagccgacctgcctctagttcctaagccctcgtacccatcacactgttctacagaagtggccacttgatcccctaaagctgtgccctcaatggacactttgttcacatttaagtgaatatgatccttttaaaaattaaaaatacatattttaaagatagtcttaccctgtcacccaagacggagtgaagtgggatgaacacaggtcactgcagcctcaattcctgaagttgaggagtcaactgcctctgtctccaaagtagctgagactacaggcgtacaccacacctggtttcattcaggtgaatataatctttgctgccagcatctcaccctttgatagtaatcacatcctcttaagagggctttggaaacaattggccttggctagccaatcccaggttttcgcttccatgagggtctccagcttcacacaatattgtgcccatatctgtagcggccttggtttttaattgcaaacaacagcatccacccacatcagtgttggtaaaaaataaattgcttttttttttttttttgagacagactctcgctgtcgcccaggctggagtgcagtggtgtgatctcggctcactgcaagctctgcctcccaggttcacgacattctcctgcctcagcctcccaagtagctgggactacaggtgcccaccaccatgcccggctaattttttgtatttttagtagagacggggcttcaccgtgttagccaggatggtctcgatctcctgaccttgtgatccacccgcctcagcctcccaaagtgctgggattacaggtgtgagccaccacgcccggccaaggtattgcttctttaagaatggagctgttaatactgctggtaccagaaacattaaaaaagaaaaatcctgcatgagggccagaggaggagtacaggagagtgagatggagtggaatcctccagtgggtgatagatggatggacagacagatgaatagacagacgaacagatgaacagacggacagacatgaataaacaggtggacagacagatgaatagatgaacagacagatggacaactggatagatggacagatgaaactaataatctgagaaatcagaaaagcttcatgaaaaaagtgggactgagctgtgtctccacggatagatataaaagcagaggactctccacttgagtcgagaatgacccagtgtcctgatccagagaggaagccagcctggcttgactgggaaatttgtgggaggactcagaggcccttaaaatgaggccaggtgaggttgggctgatccgagccagctcaggactcctctgccacacagcacagctgccttaggggacacattactcagggagttgctgggacctactgggcccagcattgccaccagcaccaacagcttcagagaggggggacacacacttggggtgactccaagactgtgggtggcacctgcctcaaacaggggacaggcacagggacacctctcggggtctggcacccccacgcactgtgcctaggtcccaacaacgcccactgcagccctgtgcccatcatgcccagaaggtttccgcttcagcctggcccctgtactggccccaggaatttggacccaagcctcagtcactgggtaaacagcagtgggaaccagctcattactctaggtaagtggctcttacaaccttccccagccagttccaccctctgttgtctctggaaaatatgttttctctccctggggtggcttctcctctgccctcccagccttaatcactgacccctacctttctctatgggtcctgggggaggtgggttagtcttgaggtaaccagcagaagggccccaggttccaacagccagacgcagcctggtcccggggcctgggctgggtttaggcaaggtcagagttccttcacctctttcagggcaggcacccgaggtgcggggcaaaggccagttctgactggcacactgcagtagcatcagagacaccccccggaccccagggtctaggctgatggctggatgcccatccagcctgggaaggccacacgggggcctggggacaaaggggtcaccatgaggtgacatcaatgcaggtgcagagagggctctgggtctaggctgcagctctctggcctctgctgggtcatgaggacacagggacaaaaaaagaagatgggtcagatggggcaagatggccagagcccagccctcccagaatagtcatcagagaggagcagatcccttagggcagagacatatttgtccctggagccccttcacccctggggcctggcgtctcactgtccatgggtcagtctcccaccttcctcaaagggcacgttagactcaggaggtgacaagaggggagcgaatggggggtgcagaggactctacggcagccagctgaagtctagagttgtcagagtccgtggaggcaggcatggggggctgctgtgtcccgtggtccaggggagcagccccaacaccacagtggaggtgaagggtcctatggttggggtggtggggacaagggaggtgaagagcggtggaggagccccggggcttgtctgggtgcagcccacccttcatcaggaaagctgaatgggatgggctggggcaaagcctggtgccccaggggacaggaagctccaggccccaccaggcttgggcctttccacactctgccaggatagtcctgtgggctgggcggggacgtgcaaattccaaactcagactccagagaccagagaggagggagcacagcctgccctgggtacacacagggaaacagaggctgcagaggagggctgggccagggctcctagaaaaggtgacttgggaagagctcctaggaaggtgcgggctggctgctctgcagaggtcttgagtgaaaaggaggggaatgaggagggaagaggcagccccgggtggactggacagccatgccgtgaacctcacagagactttagacagagagggggctctacaacaccccagtactccctctgcctctcttgccccctcctctgtccacacaggtctgcccaaggccgcccctttggacactctgaggaactccaagccaacaagatgcctctcattagtgacttctaccctgatgccgtgatggtggcctggaaggcagagggcaccaccatcaccctgggcatgaagactgccacaccctccaaacagagaaacacaagtacacggttagcagctacctgaacctgacgtctgaccagtggaggtcccccagcagctatgttcttaggcccctcaccccacccacagcagccaggagctgcaggatcccagggcaggggtctcccctcccaccccaaggcatccagcccttctccttgcacccaataaaccctcagtaaatatcctcattgttaatcagaaattctgctccctgtcttcatttcttacctttcatataatttgacacttcccccaggttctcagtgggggatgggggaatcctgacactcagtgggaaaatagcttgtgggagaggctcccaggctcccaggggcatctgctggagaaacaggccaggcaaggagcaatctgatcactgaagaccagtccctctgccctctccctcctccaattccccgctgcagcactccctcccccaaccccccgccactccctgcctcctttctggatggagctgtccctggctgggccttcagatatgccctctgtccttgccctagtaaagacactcttcccacctacgacctctttttcctcagcctggaagtaacactctgggcctggagttcctctgcccgtggccctggcccctggaatcccctcctccctctctgcccaactccccacccctgagagctggactgtccagaatactccagcaccttcaaattcatgagctgttaaatttggggcccacctcgattcttcacctgccagcaggttcacaggtgtaagaaaaatcggaggaaggcaagaaggaaacacacacaaaaggcttgcaggaggctcaggacacttgccaaagataggctctaagctccccaggaaccagagcaagaagggtaacaggagctccatcatttctatgagatttaacaaagcctttgcttgagggaagttggtgttttcaatgctgaggccaggcatctcctcagaactaacagtggggatgtgttttttgtctgtttgttttgtttcgttttgttttgagacggagtctcactctgtcgcccaggctggagtgcactggtgcaatctcggctcactgcaagctccgcctcccaggttcacgccattctcctgcctcagcctcccgagtagctgggaccacaggcgcccaccaccatgtccggctaattttttgtatttttttttagtagaggtggggtttcaccgtgttagccaggatggtcttgatctcttgacctcgtgatctgcccaccttggcctcccaaagtgctgggattacaggtgtgaaccaccactccaggcagtggggatgtgttttacccaatcccttagtattgattggatttgggctccgacacctgcacaggtgactgcctggcagccccagaacacggagatgttctcaagtgtgtggcacagaaagtcactggctgcctttggggggcattctttttgggaaacacctctccattggatcctgggcctcaggtggaaaaccaggtcctgcctcgggactttctctgtgaggctccctgggtctggggctccagccattctccgagaggaaggtgccaggagagagagcaaggcccagccccacctagtctttcctgcatggtccctgctctggtagagacagggtttggcctggctgggttccacacctgctgaaggatgcacagatggtagatgcccagtctgaccctgggtctacccagggctaacccccttccctgaggccagactgaggaggctgagcctgcccaggtcctgcaggtgttcagggcagcacagacagtgggtgcccaggcccctgacccaaggtcacccttccctcttgaggctgtgctaggcagggccaggagacagtactgaacacaccaatccccttgtggctctgtggggttggggacctacactcctcagtctacatcgagccggtgtaggagacaggcagaagcaggagggtcctcggagtccacaaagcagagcaggggcaggtgctcgtgtgcccatttcaccgaagagagaactgaggctccacgggaagggaagtgacctgcccgggtcaacatggtgagctgctgcctgacccacccccagcctctttccacagctcctcagtccttcattcattcactcacacactcattcagcaaaccctcagtgagcacagctgtgggccaggtgctggtgcaagaccaggaccacctgccctggagaagctcatgagctggaggacaacagggagacaccactgcacccccctgtcctcaagtccccaaggttggagcttggcccagggagcgcctggggcagcaggggcatctccccctacttagcagaagatttaactgaaagaaccatctgacggagccccagctgtcatccctgggccacagtgggaacatcacagtccctcatcaaccctcacagtgaccctgaggcccagggcagccatggtccacctcacatagggcaggccgaccatgaggaatgcaccacggttgcctcatagcgaccctgagctctagagctgccattgcccaccttatagaggggatgctgaccaggagggaggcaccaaccagggccacccaggctccggccagcctgagagtggcccagctggccctgtgcctgcactgccctgcacctgctgccctgcccagctcagaccctggtcatatcctcaggagtgatggccccacagcaccagggcagggtaggtccacactgggagagcccctaaaggtacagagaagagcactggagtccagggaggagggattgtcccggccctggtcctgcctcgctgtgaccagggctgaggcatttgctctaaatcagatgggggaggggcatctgtggcttcctctacagccaaaaccagagccccaaatagccccggtgggtatggaggggccttgggggaggggaggaaatgggaggggaggtggctgcttggggctctgggtgagggctaggagctcctactgagctaagcggatgactctcctatctgacctggccccccatggggcctgcaaaagcaccaagagagcatccccagccaggcctgtggaggggcccttgacccctcatactcactgagcccagtggtgggaagagggggctggtccccggccagtattctcctgaggacaccgacactcactggtaacaagcaaaccagacccagatgctccaaaaagaggccactggatcccagcaagcacccactccccccaacacgaaggtccaaaaccaagcttcagccaactagaatgtgggaacttcccgggaggtagaggaaacaagtcactgtccacttgcaatgcccaccggttagtgacgcagcacaatgacagtcacacctctcagagggggctctccctcgactctccttcctgacacatcaacaaggacagccttaccaagggccacacctgggcagtcaccatggggttcgtggtctcacgtgggccctgcttaaagcccctggggataagctcactccagctcatgagaggccgggggtgaccctgaccccattttccgatcagcgatagcacagcacatgtggggaccaatgagaaatgagtctggggagaccacgggcttcagggagaatgtttcgatgaggcaagtacaagagccagtgagggactgggtgacttctgtggcctgtgtcacagagctggggccatcagatgccccatgtccactctgaggacagagtagcccatggttaggatgacccaccagccaggcctggccagggcacccacaggagacaggaaggctgtgagggcccgggggcacggagcagctctgaaaggaaggggtgctgggtcccggggctcctgggcagagtggttgaagaaggtgagaccccagaccagccagatgggcccacttctcaggggaccctggtcagacaagggagcacctcctgctcatggaacacagcaaggggcaaggtaggcacagccaggctcggagaactcgtatttgggggagatgtaaatcaacccaatagacaagggagcgatgtggtgtaggagatggggtttgtgctggggagaaataaggcagagagtggggagtagagagcacctgtctggggtctcaggaggagcgatgtcccaagactggaggcggccaggggctgaggagccctgactgggccaggcctgtggctggagctggaggctcgggttcagcctcagtttcccctctgtgaagctaggttcataataatggaaattgactttctgggtggctggagagacattcagatggaaaatggatattctattttgtctctgtccttggttgttgtcatctcaggctgttccagccccagttagcctcgggtcagccccctgcccatgttggtctccccatgagctcaggcacctcatccccagcacagctggcctggagaaaccaagattccctgaggcttaaaatagctggaaagccagcccagctgcaggtgcctccctgtaggataaaatgtaggagaagatcttcaagagctaggactaggcaaaattttcttagacttgacaccaaaaacatagtctacaaaaggaaaaattgctaagctaagtttcatcaaaatttaaaaatttgttctgcaaaacaccttgttaaaaagatgacaagttacagactaggagaaaatattttcaaacaacatatatgaacaaagcactgttatcttgagtatataaggaacttgcaaactccacacaaaaaatcaaacaatccaattagaagatgggcaaaagacacgagcagacatttcaccagagatgatacacaatggacaaataagcccatgaaaagatcttcaacttcactagccatttgggaaatgcaaattaaaaccacaatgaaatataatttacacacatcagagtggctaaaataaaaaatagtgacaagacaaaactctgctgaagatataagtgtgaatcactcatatattgctggtgggcatataaaataccacagccactgcaaaagtgtggcagtctcttttttctctttagagacagggtctccctatattgcccaggctggactcaaattcctgggctaaagtgatcctctcgcctcagcctccagagtagctgggactaaaggcacatgctactgttgatgtttggcagtttcttatacgactgaacatggaactaccgtatgacctagcaattacattctgactcatctatcccagagaaatgacaacctgtgctcatacaaacaaccgtacgtgaatgttcattacagctttaatagcaatagccaaaaatctagaaataactcagccatccatcagcaggtgaacagttaaactgtgctacatccatcttatggaatagcactcagccatccaaaggaatcaactcttgatacactcaaccagctcaaccctccccagaacgcacctgggtgggaaggtgcacagcagattgggccactagatttacccagtgtggaggaaacaggtacctcctcctagattttgttcttggcagagataaaccagtgcttctcagtcatttttgctttttactagccatgggaggtattttccagtaaaggcttctatgaccaaatgcatttgaaggaatgttccatatgctctcccacacgccttcaatttcctgagagtgacaagaataccagaatagccaaggttctaagatatccttcaggatacctgtttaacttaaacttccccaaactatttgattatgagactcttttcaagcataaacattttccttccaggaacatttgtattcttataagaaaatattagaaagcattccaggtgacttacctaatgggagaacctcaggcgccaagccagatgagataaaagtttcaaatagtgctgataaggttttcttggttcagctgcctccctccaactcagctgctgtcacacttctaggcagttttgactggactgtaaattccttctggctggggccatgtctcagcaccttgtgcaggagtgatacaaactaatgcttcataataaatacttactcactgactttctctttattcatcccaggtgagcatgttttccatccccttcaatctccacactcacgggcaaaagtgagttgtgggtcttggaactctcaagaagaggaggagatcttcaatttgcatatgcagaatccaaacaagtcatcttgagtccccacaagtaggtgggcttatttctcacataacaaaatcgcccctcctttgcagcctctacaccactgcagatcaagcccagctaaaccttgctgtgctatcctgaaggtattgctcccagatcccggctgtcagctcctgtccagcatcacagggcaagtccagagacatgatcatgtaattgaccagggatgacaagtgggtcctctcagtggacaggtgtctgcagtaggtaagccctgtcaggagaggaaagaaaagcatcatcatctaccacctgataccctttgccctgtcttatggagtccccaaagtgctgtcccacactcccatctttatttttttatttttctgagacggtctcgctgtcacccaggctggagtgcagtggcgtgatcatggctcacttcagcctaagcctcccgtgctcgagcaatcctcccatctcagcctcctgagtagctgggactacaggcatgtgccatcatgctcagctactttttaacccctccttttcttcacaaggaaggcaaggcttgatgtcacttgctggctgaatggcttaatagctctacaaccctagggaagtcttatcaccttgctcagccacagtcagggtgatgccatcctcctctgctggaagccaaaacatttaattgataggctggaggcagagaagggacaggaaagaaggtggccaatgactctgtggccttgctgtgcctttgtctgcctccaatccatacacagagaaagacactgtgagatgtggacaactttctttcaaatatcagctgaatacaggtattcatccaaaagaaaggaaatcagtacatcaaacagttatctgcatgcccatgtttactgcagcaccattaacgatagtacaaaatcaacctatgtgtggaggaatagtacagaatcaacctaagtgtccatcaatgaattgacagttaaaggaaatgtggtatatgtatgcaatggaatattactcagccatgaaaaaggatgaaatcctgtcacgtgcagtaacatgaatggaactgaaaatcattatgttaagtaaaaaaagtgaggcacagaaagacaaatatcacatgttctcagtcatacatggaagctaaaaaagtatttctcatgaatgcggagagtagactggtggttaccagtggctgggaagggaagagtaggaggggaatgaagagaagttggttaatggtacaaaaatccagttagatggaattaagttcttgtatattatagtaggaaaaatataattaacagtaatttattgtatatctcaaaatagctagaagaactgtaaagttcccaacatgaagaaaacataaatgtttgaggtgatggatgttccaatcacctcaaacgtgatagatcaatacgcagtggatctatcaaaatactacatgcacccccaaaatatgtacaactacagtatatctattacaaatttttttaaaaagagggccggccgggcacagtggctcacgcctgtaatcccagtgctttaagaggctgaggtgggtggattgcttgaacccaggagttctggactagcctgggcaacacagtgaaacccagactctacaaaaaataagcaaacttagctgggtgtggtggcgtgtgcctgcagtctcagctacttgggaggctaaggtgggaggattgcttaagcctaggaggtcaaggctgcagtgagccaagatcttgtctctaaaaaataaaatcggctgggcgtggtggctcacgcctgtaatcccagcactttgggaggccgaggccggtggattgcctgaggtcagccatcctggccaacatggtgaaaccccgtctctaccaaaaacacaaaaattagccgggcatggtggcacacccctgtaatcccagctacttgggaggctgaggcaggagaattgcttgagcctgggaggcagaggttgcagtgagccgagatcgcgccactgcactccagcctgattgacagaatgaaactctgtctcaaaataaataaataaataaataaaacaaaatcagataaaaataaaacaaaattgcagctggattaaaaaggccccagtaagtcaggaaccagggagagagatactgagggggcagcttgctttcaatgatggtcctgcctcaaaagcacacctaccaatgtgccaccccttatctgtcacaccctgtcacctggagggtgttaggcaaagtgcctcagcaaacgccagcccgtgctgtttgctctggctgtgccctttccttctggcgttccccagccatttcatcctcaattcccagtgagaaccctggacattttgcagcctggggactaaattctaacaggagggtcaatcatagcaatgatgatgatgatgatgaccacgatgatctaatagctaatacttacacagtacacactatgtgccagggagctgttagcagagtttgcataactcagtctcgccacaacccaagaaagcaggcgctactgttatttccatcttatggatggggtaagttgaggcccagactggttatgtcacttgcacaagttacataactggaatctgaaaccagatcacctggctccaaaacctgggctctcaaccaccatcagccatgagccacatcatctgatgacattattccagacccgtatcaacccccaacccttcctgcaggaagatatttcatttgggtccaaaaatacttgcccaatgcctgctccacgccagcccctgcattaggcaaaaacgtggattgtaacggaacaggcaaaacctttgtcctagtagagtcacgctctccccgcctctgcagcactcaggtgagctgcactgtggtttcacaggcccatgcaggtgtgtgtatagctgcaggttttatttccctagcctcacagcctcaagaggagagataaaatgtgtatattcagggatggaaaacacacacacattttctctctcccatcaaggctgtgaggctacggaaataaaacctgctaagaataaatatacggagaagaaaaaacaaagccttggagtcaggccagagtctgagtcccagctctgctgcttggtagctgtgtgaccttgggcaagtcactttgtctctctgtgccttagtttcctcatctgttaagtgggaacaatcagaatacagatactaggaatttaatttttaagttttgggggaggcataacgtcactttactcttctgcttctgcccatgacagaaggaaactgacatttactgagcacctacagtatgcaagactagctgccaggggctttctacatgctcctcacttaatcctgaaaacaaaccctccactgtggcacctgggggtacaatggtgatttaatgaaacctctgtccccaggggtccccattgttcactgccctctcttaggactcaggcataaaatttatccccaatctgtagatgatgaaactgaggctcagaacggttcatgtaaattcactgaaaccaggcattcaggtaatagaggaggagaggttcaagctccaaagccagtatctcctggtatcgctgacatagagtaggcactgataactgcccctcggagactacacggcaacaaagacctatgtacatccatagaaggctctgcagaggatctggtacttcatattgtcacaagagaagtttctggggagccctgcaggcagagaaggagggagatgcttagaatagattcaaacacagcccaggttttttggagaggagcacaacttgttatctctagagggtaactgaaatcagccagtcatgaggagtgcagggagggtgctattacctccacctttacaacatcacctcttccactaccagtgacccagtttgcccttgagaaatcactccgtccacaactttctgtctccggtttctaaagggatgactctacccatttataggaccaaagctggagtcatagtaatggaagcggagattgtcatatgacccaacctgagccaatgagaattaggcttgggactttcattgtaactaccaggaaaaagtctttttctgcttcagtttctaaaccagtgggatacaggacagtagctcctaggagctatctttgccacaacataaaaagggcctgcctgtggatggaaccatcacagagggaagcagagccaagagctgaagaaacagagattcccgtctcgagcatctgagcctgaagccactatgactctaagcttctgttatgccaacaattttttttacctgaaccagtctgaagtgggtttctatcacttgcagaaagagttctgatttctttttttttttttttttacacagagcctcgctctgtcgcccaggctgaagggcagtggcgcgatctcggctcactgcaagctccacctcccaggttcacgccattctcctgcctcagcctcccgagtagctgggactacaggtgcccgccaccacgcctggctaatgttttgtatttttagtagagacggggtttcaccgtgttagccaggatggtctcgatctctgaccttatgatctgcctgcctcggcctcccaaagtgctgggattacaggcatgagccactgcacccggccgaaagagttctgatttctaaagtgacccagctgaaccaagagccaaactgggattcagtatctggctgtttgctaagtaggtgatgcctcaaggattctccctgcatgggaatttgtggcaacttttttggctgaaagaggcaagaggagtaaggtaccagcattgctggataaatccaggactgctgaagggagtgttgtacgctcttgcaatgaacagaatggaagaatatcggcatatttattctcagcacatcccaaaggacatccagaaaaatccagggagactggggtgggggaaacatagccgaagtcctctagttagacatgtgaactccaaatatgagagacaggtctcagttaatttagaaagtttattttgccaaggttgaggatgtgcgcccacggtaccgcctcaggaggctctgacgacatgtgcccacggtggtcagagcagtttggttttatacattttagggagatatgagacaccaatcaccgatcaatgtatgtaagatgagcattggtactgttcagaaaggcaagacaacttgaagtggggaggaggcttccaggtcataggtagataagagacaaacagttgcattcttttgagtttctgatgagcgtctccaaagggggcaatcagatatgcatttatctcagtgagcagaggggagactttcaatagaatgggaggcaggtttgccttaagctgttcccagcttgacttttccctttagcttagtggtttggggccctgagatttactttccttttacaggcacatggaggcattgaatactgaagtgtcccactttgtgccctcaggttggtgaggcttacagttgctcaggttacatgagaatagggtcacataaacagctgtcccactgtgggcttggttttctgcaaggtactgagttccccattatgccaggtgtgtaagcagacgctgtaacaggagagagggcagtaagttatggcagcattttttttcttttttcttttctttcttttttttctttttgagatggagttttgctgttgttgcccaggctgaagtgcaatggcgtgaccttggctcaccacaacctccgcctcccaggttcaagcgattctcctgcctcagcctcccgagtagctggtattacaggcatgcgccaccacacccagctaattttgtaggttacagcagcatttctcactggtccatggaccatcagcctaacagttacttgcagttgctccaacatgtgtattcctgggccctgcacagacttaatcagaacttctatgaagtagtctaggagctggcatgttttgctacctagcccaggggattctgatgcacaataagagaatatccggtaacattagcacttctcaatcttaaaagtacacacatggtcttgggactacgttaaacacaaattctgattcagaaggtttggtataagagactgaccatctgcccggtgctgatgctggttcacaggccacagtctgaggagccaggagcttagatgatgacttcaacaatgtaatgccagccctcacaccgtacactcctatggctgaagactggaccacacactggtacagaagaccagcaaggacaatagggttccattctaccaggcaaggccaggaggaaacaaaaccagtctcatgaactggctgaatagttccaaagagacaaaagctctatgggcaaagagagagatgcgcctgagatttaagtttacatgataaaatggtaactgttatttactgaacagtactgtgtgcaggtggcatattctggccactttaaaccattatctgagctggcatttaccatagccatataaagtaagcaccagaatctccactgtgtggaggagcaaactgagatgaatgtggttgacattaaataatatttgagattattctgccttctaggctcatggtagggctgcacttcctggctccttgtggatggggccaatgagctgtgggtgggtatgacatgctaattttgggtggggcccttttattgtgggttcaagcccctccaatgctacctttccctgtcactgtgactggcaacattcaaatgatggctgctccaacagctggaccctttggtgtggaaaaaacagagcctcaccatttgacctatgagagacacacagcatgcatgataaataaaatttgttgtaaaaagctgagttttaggactgtttgttactgcaccatataaccttgtatagcctgactaatacacataagtttcaacagctagaatttcacaaggccaggatttaacctagatctggttgactccatagtctatgttcactcaattcaatgtagggaaagatactggcatccacaaatctcagccgaaccactctgtcaacagaatgagaaggacgatttccaggagctgggctgacataggaatgagaggttactcatggagacatccatcagatcctgggggactgtggtgagtagaacaagagccctggtcaagcctatgtgggtcacagaaacctcatcccagagcaagcagctcatccccaggccagcacagggatagggaaagaccctggaggtgacagcagaaaacagcagccccaattatagtctgacccaggctattgagcccacctgacccaatgaaagccaccaccaaaatctgggggctccaacagataggcagaactgatgacaactgaagagagaggaagagaacagagagagacaacagccaagaaaacaggccctatcccagagcaggccaagcctcaccatgttgtcacttagtcatgctcaaaggatgctacaggaaggaaggggcacctgctgggtgcttctgtagaagaggcaggcctcatggggtacgatgaaagggagcctgactcaacagatgaggcagggcacccatgggcaagagacccagtggagccgctgctaatgaaagaaaagggtacttgcactatccatggttctgaggctaaagctgctccaccaagtgggtctcaaacatattagtgacaatagctgtcgctttgtactgagtgcaggtaccatcattatacccttttccagattaggaagctgagacatggagagtttaaacaacacgcccaaggccacccaactaacaagtggtggagccaagatcccagcccaggggatttgactcttcttctgagactgagtcttgctccgttgtccaggctggaatgcagtggtgcaatcatggctcactgcagccttgacctcccaggatcaagcaatcctccctccccagtctcctgagtagctgggactacaagtgtgcatcaccacacccagctattttttctgtatttttttgtaaagacagggtttcactgtgttgcccaagctggtctcaaactcttgggctgaagtgatcctcctgctttgacctcacaaagcactgggattacagcgtgagccactgagcctggctcagggatgcgactctgatcttactcttcctccctcagctgtgttcccataggctcttgtggctacacaacatctgctctgtcctcaagtggggtgattctgtcgatgtctggagagactttggtttgccatgccttgtggattaactaggtgctactggtgtctagtaggtggaggtcagggaggcttctaaacactctataatacaccagacagccctcaacacaaggaatgatttggcctcaaatgtcaacagtgctgaggctgagaaaaccaatgttagaccagcactatccaacagaaatacaatcaagtggtcaaggcccggtagctcacatctgtaatcccagaactttgggacgccaaggcagggggattgcttgagcccaggagtttgagtttagcctgagtaacacaacaagaccttctacaagaaatcaaaaaattagctgggcatggttacacatgctgtggtcccaagtacccaggatgctgaggtgggaggatcgattgagcccaggaggtcaaggctgcagtgagccatgatctcaccactgcactccagcctgggcaccgaggccacactacccataggctgctcccagccagaagcgagcatgctaggtactagtgccacctgttcctgcaggcaagagagtcctctaatagtcaacagtccaccagagactcccaactgatctggccaaatgttcctagagctgtgtgttgtgtctcagactcctcctgcccaaccttcttccttcaccctctccccttcatcagctggcttactgttcacttcaaggtcaagacattggctgtctgatgcagggacatccctggcacggcctccatggtcatctagcaaggggagggtggagcaaaggcttggtcccatagcatatattcacccatctccttgtccatttgttgtcttccagcagaatgtaagctctgagaaggtaagcagtttcctctcctttcctacaactgctgtcttccttgtatctagcacagtggctggcacaggctaggtgctcagtaaatatctggtgaatgaacccaggtcccctgaattctctgcttcatttcacaaagctgatctgagcacctattaggtctacaagctgtggcaggtattggggataagatctgagcaagacaggacccttgccttcaaggcactgagttctcaaaggcaagatggtagctatacagctaggcacagaattgtgtgactacagactatggccacagagctcctccttgctgacagctggtgggagctggtgttggctttgtttactgagcatccctacaaagggatttggggcttatgtaatctgaactcaaccagaaggtcagagaaggcttcagaccaaagtttaagataaagaggctgaggcaaggctccagtcccagagcatccccaggaggcctaccctgttcttccatgaatgtctcttgattagaaactctagagtctaggaggtcaaggtgggaggaacacttgaagccaggagttcaagaccagcctggacaacaaagcaagacctcatctctataaaaaataaaaattaaaaataactaaaaataaaatgagagacagagagagagagagagagagagagagaggacagaccagcctaggcaacatggtgaaaccctgtctctacaaaacatacaaaaattagctgggtgtggtggtgtgcacctgtggtcccagctactcgggaggctgaggtgggagagtcacttgagcctgtgaggcagaggttgcagtgagcagggatcgtaccactgcactccaagtctaggtgacagagcaagaccctgtctcaaaagagagagagagagattgtgagaaacagcagagtctgactggagctgaattattgagctcagcctgggaccaactgtcccacccactgaccagcactgaggacagagggtaaaccctgcaaaggaacatttttcatcactccaagacctgatgttaaccacactgaggcttcacattacacagaacacaatgacaatgttctggttatgtttcttgaaaagagtttttttttttttagagatacacattaaaatatttacagatgaaatcatataatgtctgcacgttgcttcagaataatattacaggggagaagggataggctgattcaggccattagggcctggtgaaggtacccgagttctgtctatctttaggttaaaactttttcatcataaaaggtttcctgaaaaaagcaagaaaatgtaaaaatatatatatatagattacatgtggacttggagcagccaacaccattgcttcctgtccccaccagcagccaagactcctcaagctgaaatactggggtcggccacacctttgcaccacagcttcctttgttcttcctgaagtctttcctaattgtgctggaatgcaggcattgcagcagggaatcccctgttccaaagcctttgctggatttttttttttttgaggcggagtctcgctttgtcgcccaggctggagtgcagtggcgccatctcggctcactgcgagctccgcctcctgggttctcgccattctcctgcctcagcctcctgagtagctgggactacaggcgcccgccaccacgcccggctaatttttttgtatttttagtagagacggggttttaccgtgttagccaggatggtctcaatctcctgacctcgtgatccgcccaccttggcctcccaaagtgctgggattacaggcgtgagccaccgtgcccggccactggatcttataaatcacaggatttcagaggagatgcggccctggatcagatactaacatcttatgtcttcccttgagtgctgggaaaggggaggttggagactgggaaacattttgccatttgcagtcttaggagatctttgtaaagatttctccctctggctggttttgaccaggatattgccaaattccacgtcttggtttctggatcctcccgagcctttgagtttcccgtgaggccacagctgtagggaggctgagccaagtggccataacaaccaggcagagtagcaggaagaagcaggggcagggtacaagcctccccctcaggaggggaacttccctgtgccaaggggaatgaagggacccaggagatgcacagcagacccagtgccctacctctttttatagtccaggtcccccacagacccctttatcagctggcttactgttcactccaaggtcacgacagtggctgtctgatgcagggacagaaatccctggcacagcctccatgttgtccctctgcagagacaggaggactcaggcctggccatgatgctggagtcaccgtggatataggccctggcccatttgactcaagaacacatacataactggaaccaagaggctggcgaatcctctcaagaccctggccacttggaagaccctaagcctccttgcaggtggccatactaagcaaagtcacttgcagccacccttccacgatgcgttctacatcacccagctgtgaaaaccacccacccccatccccatccccttcacactcatgccttcctcctgagctcaaggggccctggcccaaggttcctttagaaccaggaaggaggttttgtccctctgaaaatcatccttttcaaacagaaggcatttatcttggccaggcttaaaagacaaaaagatgatagctgagctctagggcccatcccacagacaatatccagaaaccttctccccacaattcccacaccagcctcccagcagctggatcttttctccacgggatttgcctacaagacttctctccggctttatctcaggcgggtttgtcaggggagcaatgtcaccatccctccaccaaattcacctcaacaacatttactgagcaccaagtgtgtccccaccgtggctcagccttcccacgcactgtcctgatttaaccccacgtgcttataacccaagggagaatcactgcgatattttatcaatgtaaagacacacatcttaattgttcatattttcatgcacctgaaatttgggtaggtcttctaattacaactgtgacatggctgtcccgcctggtcccatacagactcagtcacagcagttcatagcattgtcactttaattaagttttgggcatggttgttacttcaaatgtggagtgtaggtgctattttaaatgtcttcaaaaagattcaactgtgattcagctttgaattgaaaagctattgtgcacacaggaagcctgggaacagagcagcagaatgcctgtgcgatgctggcgaggcagacacatattcatccctgcagacaggcccacaagtccagattttcttgcaaagcaccaaccaaatacttaaaaacttaaaatgggacttaaaaaccatcccaggctgggcacagtggctcacaactgtaattccacagctttgggaggccttcaggattactgaagcccaggagttggagaccagcctggacaacatggtgagacccccatctctacaaaaaaaaaaaaaaaaaagaaaaaaaagaaaaaacttaaaaattacctggacatggttgtatgtgtctgtagtcccagctactcaggaggctgcggtgggaggatcgtttgagcctgggagttccaggctgcagaaagctacgattgtgccattgcattccagcctgagcaccaatgagatcccatctcaaaaacaaaacaaaacatccccgggatgagtggacacacttgcaagaaatgcctcacttcctgtgcttctcgattaggggccaccaaatgtttcatgcaaagggtgatagggaatatttttggtttgtaagctacacaggctcagctgcaaccactcaactctgccatcagggcctgaaagcagtcatagggttgtaactatgctccaacaaaacttttttttttttttttttttgagacggagtctcgctttgtcacccaggctagagtgcagtggtgcgatctcggctcactgcaacctccgcctcctaggttcatgccattctcctgcctcagcctcccaagtagctgagactacaggtgcccaccaccgcaccaggttaatttttaaaatatttttggtagagacggggtttcactgtgttagctaggctggtcttgatctcctgacctcgtgatctgccggcctcagcctcccaaagtgctgggattacaggcatgagcctccgcgcccagccccaacaaaactttatttgcaaaaacaagtggaggaccacatttggttcatgggtggtagtttgctgtccctttctcttgatagaacagaaaacaatgtggaaaaatgagggcactgatgattttaagtcaaaagtgatacagaagatgaactttgaactaaaaaaaaagttttaagaatatcttacttcaatgatattttatctgtgtgtacttacaaaagtgatgtgtgattaaaaaaccaaacaaggggactgccatcagcaacagccccaaagcccactgggctccttggtgggttgtgagttcagcagcctcagcagggtgcatcagtcgagcacagctaggactccccacaacatgcgtgtcccaggctggcactgagacacagcgctgatgttgctgccgggggctgctgatggcactggtgctggtgctggggtggctgctatgggtgagggggcgtcaaggaagagcacagtagtgtgtagatgtgaaccagggtccccaggtggtcgcctttgaatgggccaatgtccaagacctgtacatgattgtgctctgcatccttgcagccagcctggccaagactggttctacctgtcccacaaggtcaccagcatagtccctgagagcaccctgctcatcatcctgggcctggtgctgggcagcatcatctgggtggccaaacacataacatccttcatgatgatgtccctcatcatgctagatgccagctacttcatccccaactggctcttcttcggcaacctgggcaccatcctgctgtacaaggtcatcagcaccatgtggaatgcatccaccaccatcctgtccctctatgacgtctctcttagtaggctcatgggctacctgcagatagggctgctggacttcctcctgttcggcagcctgatcaccactgtggacccagcagctgtcctggttgtgtttgaggaggttcatggcaatgaggtcctgttcatcatcatcttcagggagttgctactgaatgactctgtcatcatggttctgtacaatgtgtttcaatcttttgtgacactgggtggtgacaacgtgaccagcatgaactctgtggaaggtgtagtctccttccttgtggtgagcctggggggcatgctggtgggaatggtctttgcctttctgttgtcactggtgacccacctcaccaagcatgtgcacatcatcgagcctggtttcatgttggtcatctcctacctgtccattctgatgtctgagaagctgttgctgtaggccatcctggccatcatcttctgtggcatctgctgccataagtacatgaaggccaacatctcagagcagttggcccccaccatgtgctacaccatgaagatgctgaccagtggcaccaatcccatcttcatgtccctgggcaccttagccatgaacctgctcatctggacgtggaacaaggcattcatccgcctgcactggccttcatcttcaggtactgaggccatcagtgtcatccactcctggctcctggactgctattggatggtgtggctggaaatcataggccaggtggtcatgtcctgtggaggcctgcatggggccatggctttcatcctggtcatacttctgaatggaaacaaggtcaaggagaagaacctgtttgtcagcaccaccgtcaacatcttcaaggtcatcttctggggtctgaccatctagtccctggtgcagtggctgaaggtgaagaggagtgagcactgggagcctaagttccatgagaagctgcaatgccaccctctcgaccacatcctcttggccatcaaggacatatcgaggcatatcaggcacaatgatctcaaagacatgtggtcccactttgacaggaatttcctcagtggagtcctcatgagaaggctggcccagaagtctccagaagggatcctcaatgtcttccatgcactgaacctgaaggatgccatcagctaagtgaccaaaggagagtgcctgagatccctggccttcatcggctccccaagtactgataacgtggtaaacgtggacttcacaccacgatcgtccaccatggtggcctctgtctcctaccacctgagggagaacatcagcaccgtctgtctagacattcagtccctggagcagcatggcagagcattcggtacggggaggacacggtcatgcaccacatgctgcagcaatacctgtgcaagctggggaaggagtatatgcatcgctacagccacaccagctgaggacaagaagcaggaccgagatatcttccacaggtctatgaggaagcacctggaatccttcaagtagaccaagctcaggatcacccagaacaagaaggcggccaagctgtacaagccaaagcgtgcccagaaacagagaactcccaaagctctgtacccgctccagcacagctgcactaatgccaacccaggccagggcctgggcctgagcggccatcctacactgctgaacaaaatgaatttgcaaaagtgataccccaggcaaggctccaggcccctcccagcccagcatctctccccagcacggtggggtgcatccagagtgccaggactcagggcctgaccctggagtggctgcaggcccagcaagtggcccaggctcaagtgctattttcaggtccttagcagtttgttgaactgctgggtcacctcgtgcgctgcaggtaaagttgcaggaatgtcttctgtttgctcagcacttgcgatttagactccttgaaccagcacctgccccctttccctcccagttaccatcctgcccttgccagctttggaggtggaagctctgggtggctgccatgcaaatgcctcttctggatctggtatcgcaaggggggatagagggatgaggcctgaggtgaccttgaggtcatttaaattttctaaattagacaaaacaattaaaaaaaaaccatattcccatgccttttaaaaatcaaaaccacgtactgtttcttttcagtgtaagcagttttaattacctaccaggtgcagagtctaggatacaagacagaactgcagataaagtctctttccagcatagctaggagacatggctcactccacctgttcccaggcctcacctagaaatctaatgaatggctccaaaccaggtaaactagataattttccaaagtcaaagaagcagtttatgacattaaagcacttagccaatttaacctctgacttaatttagaacaaatgtctaaattttaaagacttttttaccaataattttaaaactgtatttcccaaagattactgaagtcatgtgaaataaaaggcatgagagtgtctattcttctgacaacatatttaagaggtttcattttctcttaatccaattaattagagtaccttcatataagcatcacacacacaacacttctagacaggagaagatctagcagttgtaagtttttctttcccatcttatgactttctgacttgtcctatattttgctctttcctagtcattctactttaggacaagaatttgccatacaagatgctctctcacataaaatttctttccttcataacctatcttacataaatatatcttcatatccacaactttttcttttcttcttttttttttttttttttttggagatggggttttgctcttgttgcccaggctggagtgcaatggtgtgatctgtgctcaccacaacctctgcctcccgggttcaagcaattctcctgccgcagcctcccaagtagctgggattacaggcatgtgccacaacacctggctaattttctatttttagtagagacggggtttctccatgttggacaggctggtctcgaactcctgacctcaggtgatccgcctgcctcggcctcccaaagtgctggaattacaggcatgagccaccatgcccagtttccacaactttttttagatctctctcccctactaatttctgatgcccacccaaatcaaaaaggtcagataaagcaaggcaaaacagagtagagccttagattttgagagggacctgtctgcttacacttcttgaagttccataaggaaaacagacgtttctcctaaaatggagtctatggcaccttctgtttttcctaaggagtcccaggttgtcaggaattaccttaggtcctctcatatgagcatcaagagtggcaagaagacagactagggaaataattcagtcaactgagaagaaaaagaaaaccttagtactgttccccttgtaaagatggataaatggaggcaccatgcatactgtacggaacccgcccaggcaatgcaacctgggatagcatgcccaacgtgcccccgtggagagcagtgcagacccagataccacacctaccctgcttccttttctaccactctggccatactcccactgtgggctgccctcctaccgctctccccgctgcagtctccatggccaccaccaacctcagctaagcgaaacacgttgccacacgctcaagcctaccgcatccagcaggcgtcttacccttctccttctctaagctgggcaccgaacatcagggtatgcagacacaggagagcccggtaatggcctgattccttgccccctcagccggctttatatagggaggttttgcaactgagtgcctggactacatattctgattggatgagagaaaacgtctaggcctactctgattggactttattgtcatgttctgattggttgccttaagaattgctctcatccaatcagaacatgataataaagtccaatcagagtaggcctagaggtttttctcccatccaatcagaacatgtagttcaggacccagtggtgtaacttccctatataaagtatgctgaggggacgtcaggccattgcagattctttagtgtttgcctcctcagcggctcttgcccggcttagaggaggaagaggcgaaaggaaagacacctccctcactctggcctaaggcaccacggctcacctcactgctgtggttggtggttgctgccacggagactgaagagccaccggagtagtaggagggtggcccacagtgcaggagctgctcagtgcccggcttaaaggaggaagagaaggggaagacccctgtcccaagctggaggctggagctcttggcacctcggctggcctctctgcgattggtggctgtaatgaagactgcagccccgcctgagcattaagaaggagaaaatagtttttgggtaaatggagggagaaaagagagtggcaggtggaaggagtacagagagagtagtaaaggggggaaaacacgggggcgagcaagagggagaggaagttttgcgaaaagagagtggggagaaaagtttttgggtagatagaaggggaaaagagggtggcaagcaggagccataaaagatggtggggaaaagagtgggggaaaagtttttgggtagatggagggggaaaagagggtgacaagcaggaggggggaaggagggttgggaaaacgacggaaaaatagttttggggggcagatggagggtgaaaagagggtggcgtgtgggagaggggcgggagtggggaaaagaggttgttgagcaggagcggggagaaggctttgtgaaaagatggtgaggggggaaagacaagaaaaaggtttttgggtagatggagggggaaaagagggtggtgagtaggagggggcaagagtggtgagcgagggagacaaggttttccaaaaagaccatggaggaaaatgtttttgggtagatggagggggaaaagagggtgacaagcgggagaaggaaaaggggtggtgagagggagggagagaaggttctgcgaaaagaaggaagacagaaaagaaagatggtgcagaaacaaaaaacgtgggtaaaaagcttttgggcagatggaggggaaaaagtggcaagtgggaggagaagagagggtggcgagagggaggtagggaagaggattgggaaaaagatgatggggaaaatagttttggggtagatggagggcaaaaagagggtggcaagcaggctaggggaaagaagagggcgagcgggaaggaggaagggctttgtgaaaagacagtggggaaaaatttggggggtagatggaggggggaagagggtggcgagccgaagtggggagaaggctttatgaaaagacagtggggaaacgtttttggatagatggaaaagagcgtagcaaggaggggaaaaaagacgatggggaaacagtttttgggtagatggagggggcaaagagggtggtgagtagcaggagtaggaaaaaggctttgggaaaagatggagggaaatgtttttgggatgatggaggagcaaaaggctaatgagagcggaagggggaaaaagagggtgggtaaaaactgtggggaagtttttgggtagatggggaaaagagtggtgagtgggagagtagagaaggtgttgtgaaaagacggtggggaaaaaatgatggggaagaagttttggggtagatggaggaagaaaaaggatggcgagagggaggggtccgaaggcggtcaggaaaagaaggcagggaaataatgatgggggagaaagcttttgggtagatctttttctgatttttaaatcagattatttgcatttttgtttttgagtagttcttgtcttctttatatattttgtgtattaacccctcgcctgatgcatagtttgcaaatacttccattctctggattatttcttcattctatggattgcatcctctgctttgcagaagttttgaagtttaatgtaattccatttgtctatttttgctttttctgcttgtgcttttgatgtctatttgaaaattccttgtcctaaccaatttcctaaagtatttttcctatgtttttttctctagtagtttcatagtttcagatcctatatttaaatctttattttgagttgattttcttacatggtaagataacagtctagatttattcttctacctgtgggtgttgggttttcctagcacagtttattgaagagattgtccttcctgaatgtgtgttcttggtgcctttgttaaaattgagttgactgtaaatgtgtgaatttatttctcagttctctattctgtttcatttgtctatgtgtgtctgtctgtcatttgtctatgtctgtctctctgtctctccccgccccccccccttttcttgccagtaccatgctgttttggttactatagatttgtagtatattttgaaatcagtgtgatgcctccagcttttttctttttattcaacattcttttgtttatctgaagatattttgcatttccatgtgaattttaggctggtttttttttgtatttctatgaagaacatcttttgtaatttaacatggattgcactgactctgtaagtcatatattgggtgacacagatattttaacaatattctttctagtgcatggacataggatagctttctatttacttgcatttgctttaatatctttcatcaatgtgttttatagttttcattgtgggatcttttgcctttttggttaagtttatccctaggtatctttttttggtgagtactgttaatgaaatagctttcctgatttttcttaggtgtttcactattggctcattggtgcgctactcatttttgtatattgatattgtgtcttgcaattatactaaatttattatttctagtaaaatttttagtggaatctttagggttctctattatatgatcatgttacctgaagacagagaaaatttgactcctttttttccagtttggatgccttttattcatttgtctaattgcattctcttgcctaattgctgtagtgaggacttccagtactataatgaacaaaagtggtaaaagtagccacgtttgttccagattttagaggaagagcttttaaattttccccattgattatgatgttagcagtgggtttgtcatatatggcctttattgtgctaagtaatgtttcttttgtattcattttgttgagtttttatcatgaaagaatgttgaattttatttttttcagcatctactgaaacgattacatggtttttgttgttgatttgctgaatatgatgtatcacatttatttgtttattgaatcatcctcattttcctcagatgaatcttgcttgatcatggcagattatctttttattgtattgtcaaatgcaattttcaagtattttgttgaggatttttttgcatctgtgttcatcagggatatttgtctgtggttttctttttgtgttgtgtcctggtctagtttttgtaccagggtaatgctcgccttatagaacaagtttgaaagtattcctcttcatattttggggaatattttgagtaaaatcggtattcgttgttttaaaaatgtttggcagaattcagcaataaaaccatgattcgtgtgtttttcttcaattgacaggagactttttattactgctttaattgcattactcattattcgtctcttcaggttttttatttctttatcattctatcttgggaatttgttatatgtccagaaatttattcatttctcctacatttttcaatttgtatataagtgtttttagtaatctcttagaatactttgtatttctgtgtgatcaactgtaatgtctcctttttcgtctatcattttcagtttttcttagtctagttaaagcttgtcaattttgacttttttccaaaaacaaaaaaaccccagcttttggttccgtttgactttttgtattttttttagtttcaatttttaatttttttctaatctttattattttatttctactaatttgatttttcttgtttttctcattacttggtgtattgtcaggttgggtatttgagatctttctacttttatactgctgtgttgacttctttacccttatataattatctttctagtttttctttttttgacttaaagtctattttatcagatataagtgtagctactcctgcttttttgtttccatttgtatgggatatcttttatcatcctttcattttcagtctatgtatgtctttataggtgaagtgagtgtcttagtcagtatatagttgggtcttgtctttaaatccactcagccactttgtcttaattggagaatttaattcatttatattcaagattattactaacaggtaaaaacatactgttgccattttttacttgttttctagttgttttgctactctctttttttgttttctcctttcctttctcttctctcctctctctctcctttcttcctttcttttccttcctctttcccttccttcctgtctttatttgtagtgaggtcattttctctggtagtgtgttttaatttcttgcttttttatttttagggtgtctattactgatttttgttttctggtcagcatgaggctaaacaacataattataacgagttattttaaactgaagaaaacttaaccttgattgcaaagaacaaaaaagagagaaacaaaaaaaactaaaaacatttaccctgtaactctatcccccgcaacacacacacattttgtatttagatgtctttcagtatttttttttttttttttttttttttttgagacggagtctcgctctttggcccaggccggagtgcagtggcgctatcttggctcaccgcacgctccgcctcccaggttcacaccattctcagcctcccgagtagctgggactacaggcgccagccaacgcgcctggctaattttttgtatttttagtagagatggggtttcaccatgttagccaggatggtctcgatctcctgaccttgtgatccgcccgccttggcctcccaaagtgctgggattacaggctcagtatgtttctatattgcctatccctttaaaaattgttgggttatattattattttaacaattttgtattttagccttcacatgaaagatataggttgcttatacatcacaactatagtattctaaatttatctgtgtacttttagtaatgagatttataccttcagatggtttcttgttacatgttagcatcattttctttcagactgaacaactccctttagcatttcttgtaaaccaggtttggtagtgatgcatttcctcagcttttgtctgggaaaagtatttatctcttcttcatttttgaaggatctattctttgggtgtggtttttttcattggtattgtttttcttaagcactttgaatatgtcatcccacttctcccataggagggaggccctcagcctgtttaatttttgctgagaactctgcttcctgacatatcaaaggtcctcaatatgttgtttgattcacttctcttgctgtttatagtatcctctttgtccttgacatttggagttggattattatatgccttggcatagtttttttttttttttccttgagatggagtctcgctcttgttgcccaggctggagtacagtggcacagtcttggctcactgcaacctctgcctcctgggttcaagcaatcctcttgctcagcctcccaagtagctaggattataggcacccacgaccatacttggctaatttttgtatttttagtagagatggggttgcaccatgttggccagggtggtctcgaactcctgacctcaagtgattcacctgcctcggcctcccaaagtacttgggattacaggcctgagccaccgcacctggccactttggcgtagtcttatttggcttgaatctgcttgatgatctttggtcttcatgtacctggatatttatatatttctcttgaattggaaagctttctgttaccatctttttgaataagctttctactctttctctgctttctcttgaagaccaatgactcttaaatttgctcttctgatactatcccatagatttcctaagctgccttcattcttttttttcttttcttttttctcctattgtgtatttcaaatggcctgtgtgagctcactgattctttctctgttggatcagttctgctgttgaggccctctcatgcatttttcagtgcatccattatatttttcagctttgaggtttttgtggtcttttaaaattatttcaatctctttgttaaatttctttgatacatttccgaattacttatatttttaaaattgcattgattttcctcaaaacagctattttttacctccctctctgaatagtttaacatctttatctctcctaggttagtcactggtgacttgtttattgtttggtgaggtcatacttccctgaatgttcttaatgcatttgggcctatgttcatgcctgggaattgaataagtcagtatttattccagtctttgtagtctggtcttgtttgtacctgtcctcctctagatggtcttccagaaattccaagggtactgactattgagttccctaaggctggggtcactgaagctgtttcagcaccagggtgccctaagctcaggttcactgtgactcttgcaggactgaggtcccagagggccctgatggacttggagaagataagggaggggttccctgggttcccaggcaaagtgcttcattcacttccctcttcttcccattggaaggagtctgggtactaagctttgtggatctgggagaagggtggcttgggcactcccatggccactgcagctggcaccacatacccgaagcccacagcctctaggaccagagcagcactggggcttgtctgagtcctgtggccactactgcctgactgctgctgacttatgtaggtcttgaggccgagctactctgctggtggtgaagctggccagggtttaggtccatcccgccagggcagcaggttctcttctacctccaggcaggtctagaggtgtctgggagctcctgcctgggatcagggccactgtgttctgcctgatgctgtgtccaccgtggtggagcctggactgggttctcctctttcctgcataggaaaggagttctcccggcactgcactgcctggagttgggattagggtaacacaggcagccctgtggccactgtagcggatgtcatatatgaaacccacagcctcccagaccagcacatcattggttgctggggctcacccaaggaccacagtggctatggcctgcctgccactgaaatttattcagagcctgaggccactttaaacagctggtggtgaaggaagtcaggactcaggtttgtcccaccgggcagtggattcccttctagcccaggtcatgtctaaatgctctgtctgtgggcaccggccatggaatcaaggaccatggggttctgcccagtgctgtgttttactgtagcagagctggtactgggctccaaggcaaagtttaatgcacactctcttctccctcctggaagtggacacattgtctctctgcactgcctggggttgagggagggatggtataggcactgcaagactgtcttttccaccctgtttaatgtgtcttttcttgtttttaagctaaaaccaggttctgtgatctgtcacctgatttctttggctcttgtgaaggtattctcttgcttagattgttggtggttcaatttgatgttcctgcagggagacaatcttgtagagttctattctgccatctcgctccaccacttctcatttatttaattgttcttcaacttatttcaacaatattttgcaggtttcaaagtatgaattttgcactgctcttgttaatttctaaatttattacttgttttgttggtattatacatgggtttgtttccttaataccattttaaagcagtttattgatagtatatagaaataaaattaaatttttagtattgcatttatatcttgaaactacgtcaaatttatttctaatagtattttactgaatttcttagaattatatatgagatcgtgccatgtgtaaatataaaaaaattattttcttttcaataaggatgttttaaattttccgttctttactacacctcgctacaatctacaatataatgttgaatagaatttgcaagagtggacattcttgtaactgattagtcattcaccctctcattgctgagtataatgatagctgtaagtttcataggtaactaccactagtttcaggaagttaccttattgttcgtaaatttggagtgttttgttttttttttgttgtttttttttttttttggagacagagtttcactctttttgcccaggctggagtggtacaatggcgaggtcttggctcactgcaacctccgcctcccaggttcaagcgattctcctgcctcagcctcccaagtagctgggattacaggcgcctgccaccatgtctggctgagtttttgtatttttagtagagacggggtttcaccatgttggctaggatggtctcagtctcttgacctcgtgattgcgcccgcctcagcctcccaaagtgctgggattacagttgtgagccaccgctcccagcctggagtgtttttattattagaatgtgtgatattttctcaaatgctttctgtctgagatgcttatatatttttgtcttttattctgttaatatggtgtttgcatgcaatgattttcaaatattaaatcaatggtgcattcctggggtaaatcacatctgcgtatagtgcataatctattttatatgtttctggattcagtttggcaatattttgttgaagacttttgattttataaaacaatgtgctgggcgtggcggctcacgcctgtataatcccagcactttgggaggcctaggtgggtagatcacctgaggtcaggagttcgagaccagcctggccaacatggtgaaaccctgtctctactaaaaatacaaaaattagccatgcatggtggtgcacgcctgtaatcccagctacttgggaggctgaggcaggagaatcgcttgaacctggaaggtagaggtcgcagtgggttgagattgcaccactacactccagcctggatgacagagtgagactctgtcacacacacacaaaatgaaagatactgttctatattgttttgtgatacagttttggtgtcagtaatcctggctttataaaatgaattgggaagtgttctctccccttttattttctgcaagagttggtgaacaattgatattaatttctcagtgtgtttgatagattttgcctgggaagctacttgagatttttattgtaagtttttaaaattacaatccaatctttttaccttctgtagatctatttcgattttctatttctccttagtcctttcatctattttagtttgtgtctttctaggaattcatccattctatctaggctatctgatttttttaacataagattttcactgcattgtcttgtatttttattttgtaatactggcagtgatgggttttcttttattgctgattttagtaatttgagtctcttctctctttttcttgattgacctaagtaaacatttgccaattttgttatcttttcaaacatttaattttggtttattgattttctctgttgtttcatattccctttctgttggcttaactcttattatgaaattttttttgtctttaaaaattttatatttggttaattaaaatttaagttgattttggggtatcaacgcttctcttatatgaaaataagagcatgaatcaagaaataatgggttcccaaatactgcagtggaaacacatttttttgggggggtacaaaacaagtatccatgtacatatagtccttggttccccaagtcattgagtcaacttagtcaaaataagtagcctctcatttcttatctcatgagggtggtcttgccttgcttggagacattataatgaattcacttgatgtagttacttttaagcataccagtttacttcatatcccattttcaaccagttatcgtacccggaataattgctagaatcaaattccatcatgcacaggtaaataagtaaattctgtcatttactatctaaattagatatataattatttatagatacgtacatatattttacttgtaattcagtgaacataaggctttgtatgctctgtctaaaatatgctgtctatattaattctcatgatagtaaagaatagagtgatggagtctatattttacatatatcttccatttagtagcagaaataaaatccttgtacttgatttggtaaattcctccatttaaattaagatgttacttcccggaaacaaaatttttttttcttttttttttttaaattttaaatctttaatttctgttttcacatattttctttttgcttccaaaaggaaaggagtgcgtagctctgttgactgtgtacatcgtccacagcccctgggtcggggcagggtcccctaggccgcccgggggtccacatgcagcccctggggggccggcgcggggtgaggtccgggggccgccttattgctgaggtccggccggttggggcccgccgctaggcgcgctggctgggcagctcctgggagatgaagcgacgcaggcgctccaggtactggctgtagagctcgatgtcgttgtgcccggcgccctccacccacagcggctccaccgccttggggcagcgctcgtagagcgccagcccgtgtgagaagtcgatcacctcgtcctccatgccgtggatgatgagcacgggcgacgtgatcttggacaccttctcgatgttagggaaggcgtcgaagcagtaggtcttggtgtcggggaaggcgacgcgcatgcccgaggtgagcggcgagtgcagcaccaccgcggcacactcgtagcgcgaggccaggtccacggtgggcaccgtgccgatgctctgcccgtacaggatgatgctgtccgggctgatgccgtacctggcggcgccggagcagggtcagccgcggcctccgacgcgggcgcacccttcccaccagcgggcgtccccgggcccagctccggatgcgaccctccagtctccccactcagctaagtcagtgggtcagacccaggctccacaccagtcccgagggccacccccagcccccaacaccgcggcggtgggcgaagccagcggccccgccctattccctggcgctgccgttcactggcgtttcctagcaaggatctgcagggatcccgcctacagagtgcccctggggcaggggtaggggaggccctggcacctctcctcctcctggtcacccctaggtgcacactgggaactgtgtgccccctacattctgaatgcttcacgcctccctgcccgggttagaaagccgttcctggtgcactggccaggacagcagacactcttcctccctgcagcctttgcccacccccttggccatgaggaattcaggcagctgtgtccccaaatgtctccacccgattttggagtctcggagtccccacgcccaatgagatgccagtgcaacccaggtcagcatcgagggtggtggctgcggaggtggcaccccctcccaccagcaccttcccttgggagtggacaagtcctcggccacctcagcaccaccagctcccacccaggggcacccccacccccaggtcactggtgtgcggcccctgacccagctgatccagcaacagttacaaggcctcctcgtgcccaatcccaaccacgcgggacccacctgccaccctgcccatgccgggaccccacaactctcctcccacacgctccaggctctgatcccaggcagacgccctcttgcaaggcaggagcatgggcaggtgtgcatcccctctgcctggcattcggactccaccagcgggctgtccccgtccctggcctggaatcccagcctcctggcagcactccacagctcgccactcacccatgccccaaaggatgctgcctggctggtgcctgtggccccagctctgcctcggcctccccggcctgctccctggcagccatggtcagtagtgtgctgagccagcccagccctaccacctgctacagtcaggagcccccagctgccacctggatgtcaccactcaaaggaacgggacacatccccagtggaggccctgggcatgctctggcctccccctcacagctctgggcctaggttcctgcaggacaaagtggcagcaggacagatggccgagcagacagagctcagagctggccatggcgggtgtgactctgccagaggcccaggcagtagagacaggaggggccgaggaagtcgcatgaagtggtgattggtgtcagcgccccacactgctgggaggcccccggagccagggtggtgccaggggaccagctcccaggcccacagcagggaccgcctgcaatatcaccaaggcaacgaggaccccacctccccagggcctctgacttctcagagttgtgcctggtcccctgcgggagcaggtcagaccagtgggctggggagggccaggacgagacagccccagtggatggcgagcaggaaaggccaccagaggcccacccgggtctcctcgtccaaagcagcactggcccgggcggtgctcaaacaccggtgaagggcccaggcaagcgcagggctggggacctggatgactaggagggctggatctggaatcgaggctggcccagacctcgggtgtgtgctgggggtctgcaccttaccctgcaggccctgccccaggatggccaagctccgcagccacagggcctcatgggccaggcctcgggacctggatgcagcagcctcgcctcacttggccccaagtgctgcctccgcagatgggctcccagccacacgtgcacagacccccagaccaccacccactcccgactgccgggtggcatccacgcccctgtgataagctcagccccttcccgtcctcaggccaggggttcccagggagcctggctccacaggccagggtgtgggaggaccgcctggccacacctcagccatgtggaggcggcacctgcacacccaagctcgcctgtccggctctctggccctgtgcatccactgtggctcccctcctgcagggccgcccaacttcctcccagggaagcccgccccccggcccccggcttggtcccctcttgggtgtgcccaggctgagctgcccccagggtcgccctcacctggtgcgcagggcctgccaggcggcgtcgatgtcggcatagaggttccactcggaaggcctgcccgcgctggcaccgtagccggagtagtcgtagatgatgttgcagtggaggcgggagttcagcccagtatagaagctgctcatctggcccaggtccaccgcgttgccgtgcgagaagaagaccgtgtacctggcaccaggcacgcagcgaacatacatgcaggagacgcggttgccgtgggcgctcttagtggggaagacctcgatggtgtccagctcgcgctggctgtactggaagtcggcgagctccgtcaggtgcagcttccagcgcccgaggaggcccgcagggtccccaagggggcggccccggccccaccaggccccggccccaccaggcccgggctcaggcaccagggagtaggtggcctccggcggcaggaaggcgagcttggcagcgatgcggccggggcagggcgggtagcagaaaaggcagcagagctcactcagcgacagcccgttcatggcaggcgcctcccgggccgggcctccaccggggcccccgccaacaacgccgcccggcctggccgggcaggggaggggtgggggtgctccgagtcgcgggcaggggtgagagccccagacggcagccccattaggaggccagggcccagccccatcgcggtccaagccgccccagggagcctcgcaaccacaggtctccatgtcgtgccgtgggaaggccaccccggcccgcgcccccgggccccagggccgcgctccatggctcccgaccgcccgcccgtgcatccgtcggtccctccgcgccccggcccggcctcctgcaccgccaccgccgcagctcccccacgaacggaagcaaaatttttcttaacgggatgataattcactagtttacctctaatgagtctcagtatttaatctatcatgaaattacgcggcaccaaaataaaatataattagttaaaacacaaaaattattttattgattaatttagacatcagatgtttacattatgaaatcaaggtattttttggtttttgttttgtttttagaatattagcaaatattaccaaacatgaaccatagtaaaagttcttcagtaacactttaccattccgttttcaaataacctgaatttatgtgccagattgaaaagcttttacatgagtgacctatatttctgtatgtatccaaatatttgtatatcatgtagacaagccaagaaaatacacagatatgtaagccattgcatagaatggtaaagaatacattcttaataagatgcattcgcttaatgctccaaacaggtctctagtatctcaaatgcagcattcacccactatttccaaacatatcagggccaggtgccatggctcatgcccataatcttggcactttgggaagttgaggtgggtggatcacttgaggccaagttccagaccagcctggccaacacggcaaaaccctgtctttactaaaactacaaaaaaaataaaaatagctagccatggtggcacactactataatcccagctactcaggagactgagatacaagaatcatgtgaacacgagaggcaggggatgcagtgagctgagccgagatcacgccactgcactccagcctgggcaacggagcgagtgagactctgtttcaaaaaaacaaaaccaaaagcattgtatcatgatatgtgactaagctgaatttaaaacactgtaacataaactagatgaaaagtattatacaaaatttttctttgtatttctatttgttttgaatttaccaacaattcaaatcttgctgagaatatttgcactataaatatttctgtgattattggttatattcaaattcgctcattttcaaagctacctgtataaaattattaaaattgtacatagcttggaataagagtatgttgaatataattgccatgtgatacatttatatttaataattaaaggcatattacaacacttacgcctcatcttaatgttacttaaccttagaaacagagtaaatgataggaataatatgggagacaaactgtggaaagccacattctgtatatctctgttgtttttattaaacttttttcctactgcactttaaatttgtcatagaccattattttagtaattattaatgtaatcttacgtatgtatattctctaccatcttagcaggttgaataaaatacatgattaaaggcaaaaatgtgtgcaaggaaaatatagaatatttaagttacaaaaagctactcttactgaatctcttaaattacagcttatagctaaagagtacaaactattgtaaaagttttctcccatttgtaagtaattacacatataaagtatctccccattcagtagatcttatatttctttgagaaacatatattaaatataaaatattctgaattctaaattgcatttaaaattgttcatcattggttatattatgtaattataagcaagtacatttaatgactacatactgtaaactttctttaccacgtggcacaaatagttaatttaccttttttttctgtctctgtcttctatgtcctaggctatttcagttttctcacgagtagccattattttcaatgaactaccaaaaagttataaggcagccacgatcaaacaaaaatgttagtaatatagtatagtataaaggttttttatttcttaatttatattccaaattgttaaataattttatcatccagtcttgatgtctgaaaacatcttaaaatagagaagttcacagtattagatgctgtatctttcttcatctaatgacaaaagactttagttcttttctcaattttaggagaagttttgctttaagaccaataaaaacataagtttacataagctgagagcacgttatgtatagctactctgtggaaaacattttattttaagagctattaggaacatcttttgagaatattcaagctatatatgatgctgcaaatttatttttatggttgctataactggcaaggcaagcagatgatatgcttgaagctatctcgtgatgagcacatctgagggaataaagaagggccttcacaagaagagggaggcagctggtacattcagtaatgcatcatgaacaccaatgcagtggctcctgagaaagagtcaatataatacctggattccttgtttctatctcatatgtaatccagtttcagggaagtataaaagtgacagggatggggagagtatatgaaccattaatatgaaatctaaagaagtgcaggcatccagctgtctggtgtctactgaggtcgttcacccagattaacaatacagatacttagttaaattctgaactgcagataatgggaaagtaggattgtggaaatcggctccatccaaattattactcaggtctcctcctcttccagatgctgtccccacagtatactcaaggtgtctgatgacagtgatgagcaactgaggaatcatttaattaccaagttcttcatccttacttaaaaatgtagagtcacaaaatcatatatgaaaacacactctttttttttttttttttgagatggagtctctgttaccaggctggagatactctttttcaatagagtatggccttctgtccactctcctcttattctttccagagtagcaaggtgtccttacggcatacatttagcataaaattagatgggttccattataaaataaaatggagacagaataagtcaatactgaattctttggtaaatcaagcaaagtctttaaaaatttttctagaaaatggatttatttttgtttttatttagtgtttgttttatttagttatttttagtttttttgtttgcttttgcttcattgttctgcattgctaactcgttaaaatcacaagctatcttattgtatattgagtgtatttgcaagagctgtttagtgttttcttccctagtgaaccaacataacgattattctgctatgagtctatgttacgaaatatgtctatgtcctgctattctcaggcttcatttttgcctctaaatccttcaggtactgttgttttgggcagtgtaatggatgtttcttcttttgttctttctgtgccttgaaaatttcagtaaggaaataaactggttgtcaaaaacacctgtttgttaaaattggaatcagactttttaaagaagagatatacttggtttccttggctaaatattcaaaagttaataggatttttttcatagtataacatagtttcaaaagttaaacgtaattgtatttagttttattgaatacctacttgtgtggcatattacatttatttttgttaatattaaatttaaacaattttaagtataaattattatatagtgtgcaaatgtctttttcatataatgacttctttttctctgggtatatacccagtggtgggattgtggatgaaatctatttatagatctttaaggaatctccatactgttttccatagtggttgtactagtttacattcccaccagcagtgtaaaaatgttccctttacaccatattcatgccaacatctgttgtttttttattttcttaattgtggctattcttgcaggagtaaggtggcatctcattgtggttttgatatgcatttccctgataattagtaatgttgagcatgttttcatttgtttcttggccatttgtgtatcttcttttcagaattgcctagtcataccctttgcccactttttgatgggatttgtttattcttgctgatttgtttgagttccatgtagattctggatattagtcctttgtcagatgaatagtatgcaaaatattttctcctaatctgtgggttgtctgtttactctgctgattatttctttttctgtgaagaggctttctagcttaatttggtcctagctacttatctttgtttttgttccatttgcttttgagttcttattcatgaagtctttgcctaagccaatgtctagaagagcttttctaatgttatattctagaagttttatggtttcagggcttagatttaagtctttcatccatcttgagttgatttttgtaaaaagtgagagatgaggatccagcttttttcttctacatgtggtttgcaaattatcctagcaccatttgttgaatagaatgtcctttccccactttgtatttgctctgtcaaaggtcagttgactgtaagtatttggttttatttctggttctctattctgttccatttgtctatgtgcctatttttataccagtaccatgctgttttggtaactctagccttgtagtatagtttgaagttgggtaatgtaatgcctctagattttttttttttttttttttgcttagttttactttggctttgagggcttttttttggttccatatgaattttagggttgttttttctagttctgtgaagagtaatgatggtattttgatgagaattgcattaaatttgtaggttgctttagtcagtatggtcattttcacaatattgattctactcatcgatgagcatgggaggtgtttgcacttgtttgtgttgtgtataatctctttcagcagtgtcccttagttttccttttagagatctttcatctccttggttaggtatacattcctaagtattttattttttgcagttgttgtaaaagaggttgagttcttgatttgattctcagcttggtcattggaggtgtataacagtgctacctctgatttgtgtacattgattttgtatcctgaaacttggctgaattcatgtattagatctaagaactttttggatgagtccttagggttttctaggtatacaatcatatcatcagtgaacagcagcagtttgacttcctctttacctatttgaatgccctttgtttctcttgtctgattgctctggctaaaatttccagtacaatgttgaatagaagaggtgaaagtggatatccttttcttgttccagttcttaggcgaaatgctgtagatttttctctgtttagtataatgttgactatggatttttcatagatggcttttattaccttgaggtatgtcccttctatgctttttctgatggttttaatcataaatggatgctggattttgtgaaatgggtttttttgcatcaattgaaatcatatttttaaatttttaattatttatatgtgattaattacatttattgacttgcatatgttaaaccatcccttcatccctgatatgaaacccacgtgatcatggtgtattatctttttgatataatgttggactcagctagtattttgttgaagatttttgcatctatgttcatcaggggctgaactatagacctacagagtctgaactattggtctatagttttctttttttgttatgttctttcctggttttggtattagggtgttactggcctcatagaatgatttaaggaggatttcctctttctttatcttttgaaatcatttcagtaagattggtaccaattcttcgaatgcctgatagaattcagctgttaatccatttggtcctggacatttttattgttggcaattttttttactattgtttcagtctcactgcttgttacttgtctgttcagtttctttctcttttttttttccacgtaggatctcgctctgtcgcccaggctggagtgcagtggcacaatctgagctcactgcaacctctgcctcccaggctcaagtgattctcttgcctcagcctcctgagtagatgggattacaggtgtgcaccaccacacccagctaattttttttattttcagtagagacagggttttaactctgttggccaggctggtctcaaactcctggcctcaagtgatctgcccacctcagtctcctaaagtgctgggattacaggtgtgagccactatacccagtgcagtttctatttatttgtgttttaatctaggagggttgtatatttccaggaatttatcactctctctaaattttctagtctgtgcacataagggtgttcatagtagccttgaatatatttcatatttctgtggtattggttgtaatatttcccatttcatttctaattgagcttatttggatcttctccctttttttcttagttaatctcactaatggtctattgattttgtttatctcttaaaagaatcagttttttgtttcatatatcttttgtatttttgtttcaattttatttaattctgatctttattatttcttttttcttctgggtttgggtttggttggttcttgtttctccagttctgtgaggtatgactttagattgtctattcatgctctttgatgtaggcatttaatgctatgaaccttcctcttaattttgctgtatcccagaggttttaataggctttgtcactattatccttcagttcaaacaattttttaaatgttgcataacaatgtttatttagttttacatttgtttacaatttcttataaacacttttcgttataattttatacaaacaacagtaggagaaacaaggagctagaaaacattagaaagttgagatttggagggaagaattttaaagactggaagtactagagggagagaatctagagaatgaaggaggcaatacttgaagagataacacaatgttccaaatttgttggtaaaacatgaattcgtaaattcaggaaacacaatatataccaaacatatatttaaataaaatccaggcctagactcaaggtagtagtaaatgacaagataccaaacacaagattttaaaagcaaccatggggagaaaaagatcatcaatgaaggcaagacagtcaaatcgtaggcttcgtaacagcaacagtgtacccaaacaattattttatttatttatttattttttgagatggagtctcgctgtgtcgcccaggctggagtgcagtggcgcaatcttggctcactgcaagatccgcctcccaggttcacgccattctcctgcctcagcctcccacctagctgggactacaggcacccgccaccacacctggctaatttttttttgtatttttggtagagacggggtttcatcgtgttagccaggatggtctcgatctcctgacctcgtgatccgcccgcctcggcctcccaaagtgctgggattatgggcgtgagccaccgcgcctggccatatttatacttttttaataccactaggctcaacccgtatgatattttttgcagcagctttcttgagatgtaattcacataccgcataaatcgcccatttaaaatgtacaaccgagcggtttttagcgtattcatagagtcgcacatcaccacaatcaattttagaacatttttatcaccccccaaagaaatccacatcctttagccgtcaacctccaatccttccatttctctgcacctaggcaatgtataatctactttctgtctgtatagatttgggtactccggatgtttcacgtaaatgcagtcatgcgacacgtgatcttgtggctggcttctttcacttagcgccatgttttctagtttcacccgttttcagcatgtgtccgtccttttccttcttttcaaaacagttttattgagatgccattcacataccatgcagttcattcatgtaaagcatctgtaattcaattgcctttagaatatgcacagttacgtagccatcaccacaatacattttagaacattggtatcacctcaaattcctttttattgccaaataatattccactgtatggatataccacgttgcatttatccactggtgggcattttcactcttagaatattataaataatgttgctatggatattcgtgcacgagttcttgtggggacatatgtcttcatttctttcaagtatatacctaggaatggaattaatgggttatatggtaattctatgattaagcttttgaggaactgtcagacaagccatgtgattgattgattgatttttaaagacagggtcttattgtattgccccagctggtctccaactcctgagctcaagcaatcctcctacctcagcctctgaatggctggggctacaggcacgtgccactgcacccagctgccatgtgatttttttcttcccaattttctcactgaacattaatcatgtgtattttcatgaatggttaagtgttctttgagcatgtggcttttaacatttgcttttaacatttaacatatccaaattttagttggccaatcccctgttattggggacacttccaattttcattatgataaacagcatttccatgggcatctttttttttttttttttgagacagagttttgctcttgttgcccaggctagagtgcaatggtgagaactgcagcctccacctccaggattcaagtaattctcctgcctcagcctcttgagtagcggggattacaggtgtgcgccatcatgcctggctaattttgtatttttagtacagctggggtttcaccatgttcgtcaggctggtctcaaactcctgacctcaagggatccagccacctaggcctccaaaagggctgggattacaggtgtgagccactgcgtccggccccatgagcatctttaggcatcaatcttttatgcatctctggttatttctctagagcacattagtcaaatgattgtatcaaagggcacaggcagttttgaggctctcagtgcatgatgatatattgctttccaaaaaggctgtgcccgtttgcattctcaaaagtagagtgtgcacccctccttatattttaatagtttcctgaggtcatcagaacatgaacatggggagggcagggacttgcttgggcatcttggataccatgcccagttgaatgtgcagtacttagtaggggtttgtgtgacaggaatgagtgagagcacatgaaggcccagatgagtgcagggtccgtggggcacagaggagggtacaggtgtgtgagcaccgtgtggacttagcacacggctgacgtgaggactcagtgcagacacaagtggtaacaaggcctcgtgaatcaaagagctcctcaacctggaggtcgaagcagctgattggagatgaggaagccacactccaaggtcacttagggacagacgctggcagggctgatctgaagactggcagcaactcctttttatactccactctgcaagcgccagtctttatgcagagttctggaagaattcccttcactgagctagcaaggccatcaaactctgcgttcacctggatatcctaaggagacacccattacaaggatgaactttgttactatctgagaacttcaccatttttcactcacacacgcaaggtctcagagaagctccttcgggcggcttctcccctgtggatgacagtctcatacccgcaaactagtaagatccaggagagaaggggacaatgggggatgtttagaggcctgctgtatttatttatttagaaatgggatcgtactgtgtcaccaggctggagtgcagtggctcaatcgtagctctcttcatccctgagctcctggactcaagctatctatcctcttgcttaagcctccagaatagcagggactacaggtgcccaccaccatgcccggctatgctgtatttccagatctgggggctggttacatagacacctatgctgtttgtgaaaattctccaagctctatgcttaatctttgtgcatttttcagcatagatgttgttcctcaattaaaaacaaaaaaccaaggggttgtgaagaacagaactggcactgatggagtccttctctgtgcaaggcctttcccttaggtctgtcatctcagcttatgttcatgatggccttgcggggtagacgttagccccatttcacaaaaacacaagtctgagcccagggaaagattttccttgaactataagtcttcaaaactatttccctcaaagctcagaataaaatctgggctagtcagattatactagtgataacagataacaacagttaaggaatagaaggtagaatattcaattcaggctaattgtttttctttgtttttttgttttttgggtttttttgaggtagagtctcgctctgtcacccaggctggaatgcattggcatggtctcggctcactgaaacctccgctttctggttcaagcaattctcctgcctcagcctcccgagtagctgaggttacaggtgagcaccaccacatccagctaatttttcttctatcttttacaacacagagtttcactcttgttgctcaggctggagtgcaatggcacgatctcggctcactgcaacctctgcctctgggttctcctggaggtgattctcctgcctcagccccctgagtagctgggattacaagtgcataccactatgcccggctaatttttgtatttttagtagagacagggtttcaccatgttggccagactgatctcgaactcctgacctcaggtgatctgcctgcctcggcctcccgaagttctgggattacaggcatgagccaccaactccggccaaatttttgtattattagtaaagacaggttttgccatgttggccagggtggtcttgaactcctgacctcaggtgatccacctgccttggcctcccgaggtcctgggattataggcgtgaaccatcatgcccatcccaggctagttattgattgatcgtttatgattctttgactcagaatcttgtccaggatctcacactgatagacacaggatttggtcccaaccctgaactgattccaaagcccatggcattcccacgagactaggggcttctgataatgaccatacattgtgacaagtaagtgtatatttgggcaggataatgccatatgacattctatttcttttagaatgacagatccagtgctgacaggaattctcagagcagcaggcacatggttaaggcaagaacaggccattagaaggaaatggtaaggacgtttgacatcggttgtcccaaacctgaagaattgaaactacacagacacatttctggaaaggctttcactcaagtctgggttgaaaaaaatcagggttagaatcagcactgatttgtaactcaatttttttgtttccttccctttttttttgagatagaatctggccctgttccccaggttggagtgcagtggcacaatcatagctcactgaagccacaaactcctgggatcaggtgatcctcctgcttcagtcttctgagtacccgaaactacgggtatgtgccacatgcctggctaattttttaaaaagctttttgtagagatggggatcttgctgtgttgcccaggatggtcttgaactgtaggcttcaagggatcctcccacctcagcctcccaacatgctaagattataggtgtgagccatctcacctggcactttttctacattaaaaaatcaaaattcaccaggcgcaatggatcatgcctgtaatcccagcacttggaaggccgaggtgggtggatcacctgaggtcaggagttcgagaccagcctggccaacctggtgaaaccctatctctactaaaaaaaaatatcaaaaaaaaaaaaaaaatcagccgggcgtggtggcacacacctgtaatcctggctactcaggaggctgaggtagaagaattgcctgaatctgggagccggaagttgcagagagccaagatagcaccactgcactccagcctgggcgacagtgagactctgtctcaaaaaaaaaaaaaaaaaaaaaaatcaaaattgacccaagacatgagagaccatggcacaggatcacttgaggtcagaagtttgcaaccagcctgggcaacatagcaagcccccatctctaaaaactttagccaggtatggtgacctgtacctgtacttccagctgcttggggagcttagacaggagaaccacttgagccaaggaatttgagactgcagtgagctacgatcacaccactgcactgcaactgggtgacagagtgagaccctgactcaaaaaaaaagtggcaaaattgaatgaaaagggatcctaatctctctcacagccactcaagtgaagcttccagcaccacagtccacctgcagacagtcaggggaggggcagagggcagccttgcaggtgctgcgcctgcagatcgaaacctcagtggatagggagcatcatgcccagacctccacttatcctctctcagccaatgaagaacccaggcaggtgccccaggtgagatcccatggaaccagcagtctggagttcttgtggggacatatgtcttcatttctttcaagtatatacctaggaatggaattaatgggttatatggtaattctatgattaagcttttgaggaactgtcagacaagccatgtgattgattgattgatttttaaagacagggtcttattgtattgccccagctggtctccaactcctgagctcaagcaatcctcctacctcagcctctgaatggctggggctacaggcacgtgccactgcacccagctgccatgtgatttttttcttcccaattttctcactgaacattaatcatgtgtattttcatgaatggttaagtgttctttgagcatgtggcttttaacatttgcttttaacatttaacatatccaaattttagttggccaatcccctgttattggggacacttccaattttcattatgataaacagcatttccatgggcatctttttttttttttgagacagagttttgctcttgttgcccaggctagagtgcaatggtgagaactgcagcctccacctccaggattcaagtaattctcctgcctcagcctcctgagtagcggggattacaggtgtgcgccatcatgcctggctaattttgtatttttagtacagctggggtttcaccatgttcgtcaggctggtctcaaactcctgacctcaagggatccagccacctaggcctccaaaagggctgggattacaggtgtgagccactgcatccagccccatgagcatctttaggcatcaatcttttatgcatctctggttatttctctagagcacattagtcaaatgattgtatcaaagggcacaggcagttttgaggctctcagtgcatgatgataaattgccttccaaaaaggctgtgcccgtttgcattctcaaaagtagagtgtacacccctccttatattttaatagtttcctgaggtcaccagaacatgaacatggggagggcagggacttgcttgggcatcttggataccatgcccagttcaatgtgcagtacttagtaggggtttgtgtgacaggaatgagtgagagcacatgaaggcccagatgagtgcagggtccgtggggcacagaggagggtacaggtgtgtgagcaccgtgaaggccagctccataggacttagcacacggctgacgtggggactcagtgcagacacaagtggtaacaaagcagaatggtgcagactgtggcaagttgagaacttatgcctctgtaaagggggcagccaccactcagttactgcagattactctatctttgctgaggacagttgcacaggtagtgcactgcagaagggtaacaccttagagggatgtcatttgcatcatagatgcaaaattcacaggcaaagactgatgtagtttgtccctaaagttttgctttgatttgcagatatttatccatggcagtttcgtgaaaaacgtctatagaaggttttgaggaatgggcaccttttaatttgctactaaactaaaccccaagggcccattatatgccagcgtggtcctagagattccacactcattcagttccttttcatcataggaagtgggcattataatatcaggtccactataagagctggaggctgggcatggtggctcatgcctgtaatcccagcactttgggaggcctacctgggcagatcgcgggagcccaagagtttgagaccaggctggacaacacggtgaaactctgcctttacaacacatacaaaaagtttagccgggcttggtggcatggccctatagtcccagctattcgggaggctgaggtgggaggatcgcttgagcctcggaggtcaaggctgcagtgagcccagattgcacaactatactccagcttaggccacagagcaagaccttgtctcaaaaaataaaataaaataataaaaagaaagaaagagaaaggaacagatcaataggtacaataaagtaatatttgtataaaaaaagcaaaagaacatatttatttatttggatatttgtttatattcataaactatctctagaaagataccaagaaattgaatctatttggttgtatctgagaaactgcaggaatagggacagggttgagatgatgccttctgaattttgaaatatacaaatgtattttctacttagaaataaatgggccgggcgtggtggctaggccgggtgcggtggctctcgcctgtaatcctggcactttgggaggccgagactggcagatcacttgaggtcaggagtttgagaccagccttgccaacatggtgaaactccgtctctactaaaaatatgaaaatggccaggtgcggtggctcacccttgtaatcccagcactttgggaggctgaggcgggcggatcacctgaggtcaggagttcaagaacagcgtgaccaacatggagaaaccccatctctactaaaaatataaaattagcctggtgtagtggcgcatgcctgtcatcccagccactcaggaggctgaggcaggagaattgcttgaacccgggaggtggaggttgtgctgagctgagattgcgccattgtactccagcctgggcaacaacagcgaaactttgtctcacaaaaagaaacaacaacaacaaccacaaacacacacaaaaattagctgggtgtggtggtgggtgcctataatcccagctactcaggaggctgaggcacgagaattgcttgaacctgagaggcggaggtcgcagtgagccaagatcaggccactgcactccagcctgggcaatagagcaagactcaatctctaaataaatatataaaataaataaataatattaagacaaaactcataaggacattacataaaccaagttatgccagtgatttttttaaaatatcaaaacaggcagttttatagaaaaatataacttcaggccaggtggggtggctaatgcttgtaatcccagcactttgggaggccgaggttggcagatcacctgacctcaggagttcgagaccagcctggcaagcatagtaaaaccccaactctactaaaaatacaaaaattagctgggtgtggtagaacatgcttgtaaccccagctacttgggaggctgaggcgggagaatcacttgaacctgggaggcggaggttgcagtgagccgagatcgcgtgactgcaacagagaaattctgtctcaaaagaaaaatataacttcataaaaacaaagtagggagaagcagaaaagtttgtctagatctagaaccattaaaggaattgaatgtttattttaaaatctgtatcccggccgggtgcggtggctcacgcctgtaatcccagcactctgggaggccgaggtgggcggatcacaaggtcaggagatcgagaccatcctggctaacacggtgaaaccccatctctactaaaaatacaaaaaattagccggccctggtggcgggtgcctgtagtcccagctactccagaggctgaggcaggagaacggcgtgaacccgggaggcggaggtggcagtgagccgaggtggtgccactgcactccagcctgggcaacagagcaagactccgtctcaaaaaaaaaaaaaaatctgtatcccatcccctcaaaaatctcacaaaaaaacaaaaccaaagaaaagcaccaggcccagatgattttatggacagcaaacattaaaaagaacataaagtttttatcttctacataatttttaaaaattaattatttatttttgacaggaagtctcgctttgtagcccaggctggagtgcagtggcgcgatctcggcacaccgcaacctccgcctcccgggttcaagtgattctcctgcctcagccacaccagtagctgggactacagccgcgtgccaccatgtctggttaatttttgtattttagtagagacagggtttcactatgttggccaggctggtctccaactcctgatctcgtgatccgcccgccccaatctcccaaagtgctgggatgtgtgagccgccacgcctggccactactttttcttttctttgtgtgtttttttttttttttttttttttttggtgtgtgtgtgtgtgagatggagtttccctcttgttgcccaggctagagtgcaatggtgcgatctcagttcactgcaatccccgcctcagcaggagagcaggaatcttcagtgatccactggcggatctgcagccattgtgcgcgccaggtcttcccaagtcttttgtgcgcgcgcctctccttccagtacctatcaagccagcgtcccctagcctcccgccattgccagcaggtgctgagatcgcgccattgcactccagcctgggagacaacagcgaaactccgtctcaaaattaaaaaaaaaaggatgaaaattttggaaaaatatggaagaaaccaaatggatttctagctcaactaaatcgtaattattcagtgtctagtttttgcaagaaaccatatatttcatgtccacaatcggccacagtcccagctctcaagtgtaggtctttcctaagcaaattgaagaacacaggcataaaagtgcattaagtcaataaacatttttctctgtgtctctctctctctttttttttttttttttttgagacggaggttcgcactgtcacccaggctggagtgcagtggtgagatctcgggtgactgcaagctccgcctcccgagttcacgccattctcctgcctcagcctccagagtagctgggactacaggcgcccgccaccacgcccggctaattttttgtagttttagtagagacggggtttcgctatgttggccaggctggtctccaactcctgacctcgtgatccacccgcctccgcctcccaaagtgccacagccccggcctttttttttttaagacagagtctcggccgggcgcggtggctcacgcctttaatcccagcactttgggaggccgaggcgggcggatcacgaggtcaggaggtcgaggccatcctggctaacacggtgaaaccccgtctctactaaaaatacaaaaaagcagccgggtgtggtggcgggcgcctgtagtccgagctactcccgaggctgaggcaggagaatggcgtgaacccggtaggcggagcttgcggtgagcccagagatcaggccactggaatccagcctgggcgacagagggagactccgtctcaaaaaaaaaaaaagaaaaaaaaaaaagactctgactctgttgcccaggttggagtgcagtggcgcgatctcggcgcatcgcaatcccttcccagcccccgggttcaagtgattctccagtctcagccgccggagtagctgggactacaggcgcgtgccaccatgtctgactaaatttgtatttttactagaaagggggtttcactatgttggccaggctggtctccaactcctgatctcgtgatccgtccgccccgacctcccaaagtgctaggattataggcataagccgccacgcccggccttttgtttttctttttcttttttttatttgaagactgagttttgcacttgttgcccaggctggagtgcaatggtgcgatctcagctcactgcaatctccacctcagcaggagagcaggaatcttcagtgatccacgggcagatctgccgccattgtgggcacctgttcctcccgcgacctttgtgcccgcctctctccttccagtacctattgcatgaccccccacgtccgcctcccgccattgccagcaagtgcctcgcgcgggtacctggctgcgcttattaatccgttaagctcgctctgtcacgggcgccgtgatgtgctcacgcgcccgctccctcaggtttaaaaggcgcgttgcccggcaacagaagaaactgctggcttagccgttggccgagttggcggctggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcctgtgggatctccccgttgctcctgcccgtggactgagtggcaggccatcctacaagcacccggacacttgacatccgtggtgtcaagacaactctaagaaggttttccgtgatcctgcaagccctgccttcctttctgggatcctgccttcaatttgattgcacaggtaccacagcaagccagtgctgtgtgctccgagttccagggcgtcctccagctcagccactgcactgagaacatggactctctgtggggcccaggagctgggagtcacccctttggggtccacaacagccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatggaggcctctctccctttgtgcccgggcccgggcctctgcagacagacctccatgcccagaggtcagaaatcagatatgaccagtcatcccagacctcctggacgagctcgtgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcgggtcacacccagtgtgaaaaggtggcagagaaagcaccagggcagacactcgccctcaggaatgactcctccagatccgaggcctctaggcccagtacacgcaagtttcccctgctgccacacaggcgaggggagcctttgatgctgccacctcccgtagagctggggtaccgggtcactgctgaagacctggactgggagaaggaggcggcattccagtgcatcaagagtgcactgcaggttgaggacaaggccatctcagactgcagaccctcacggccttcccacactttgtcctcacttgcaacaggggcttctggtctgcctgccgtttctaaagcacccagtatggatgcacagcaggagagacacaagtcccaagactgcctgggcctagtggcccccctagcatctgctacagaggtcccctctacagctcccatgtctggggagaagcacagaccaccaggccccctgttctcctcctcagatccccttcctgccacctcttcccactcccaggactcagcccaggtcacctcgctgattcctgcccccttcccagctgcaagcatggatgcgggcatgagaagaacaaggcctggcacttctgctcctgcagctgccgcagcagcccctcccccctccacattgaaccgcacattggggtcactattggagtggatggaggcccttcacatttctgggcctcagccacagctgcagcaggtgcccagaggtcagaaccagagatcccagacctcccggaccagctcgtgccccaaacgaaatgccatctcgagctcctgcagctctacgggagacctcccgggacgaaagcggaagaggcgccagcctcatcccactgccagctgaccctcagttcctcaaacacagtgagtgaggacggacctgaggctgtctcttcgggtcacacccagtgtgaaaagacggcagatacagcaccagggcagacactcggccccaggggtggctcccccagatcccagtcctctaggccccgtagacacaagtttcccctgctgccacgcaggcgaggggagcctttgatgctgccacctcccttagagctggggtactgggtcactgctgaagacctggaccgggagaaggaggcggcattccagcgcatcaacagtgcactgcaggttgaggacaaggccatctcggactgcagaccctcacggccttcccacactttgtcctcacttgctacaggggcttctggtctgcctgccatttctaaagcacccagtatggatgcacagcaggagagacacaagtcctaagactgtctgggcctagtggatcccccagcatctgctgcacaggtctgtagtcccagctactcgggaggctgaggcaggagaacggcataaacccgggaggcagagcttgcagtgagctgagatcgcgcgactgcactccagcctgggtgacagagcgagactccgtctcaaaaaaagaaaaagaaaaagaaaaaaaaagttcttgtgacatttctgtatgaaatcagccttcactacatggataggaccagcacgcttccgcggcacgactctgcaatcttactacattttttttattttgtattttatttattccttttgagacagtcttactctgtcacccaggctgaagtgcagccgagatctcggctcactgcaacctccacctcctgggttcaagcaattctcctgtctcagcctcccaagtagctgagactacaggcacacgtcaaaaggcccggctaatttttgtatttttagtagagatggagtttagccatattggtcaggctggtctcgaactcctgacctcaggtgattgacctgtcttagcctcccgaagtgctaggattacaggtgtaagtttatttatttatttaagatggaatcttgctctgtatttattaatttatttatttgagatggagtcttgctccatcgcccaggctagggtgcagtggtgcaatctcggctcactgcaacctctgacttccagtttcaagcgattctcctgcctcagtgtcccaagtagctgggattacaggtgcctgccaccacagctggctaatttttgtatttttagtagagacagtgtttcaccgtcttggccaggctggtctcaggctcctgacctcatgaaccacctgcctcagcctcccaaagtgttgggattacaggcctaaggcaccatgttcggccatatttatttatttaattatttagagacaaagtcttgctctgtcacccaggctggagtgcagtggcgccatctcagctcactgcagcctctgcctccaaggtttaagcgattctcatgcctcagactcctgagtaactgggactacaggtactcaccaccacgcagggattttttttttctatttttttgtagagacacagtttcaccatattggccaggctggtctcgaactcctgaccttaggtgatctgacagcttcgtcctctcaaagtactgggattacaggcatgagccaccgagcccggcctctcactacatttaagtgatgccatggctcatgcctgtaatcctagcactttgggaggccaaggcaggtggatcacctgaggtcaggagtttgacacgagcctggccaacatggggaaaccccgtctctagtaaaaacacaaaaattagtcaggcatggtggtacaagcctgtaggcccagctacttggaaggctgaggcaggagaatcactttaaccgggaggcagaggttgcagtgagccaatatcatgccactgcactccagcttgggtgacagagtgagacaccatctcaaaaaaagaaaagaaaagaaaagaaaaacatatgatgccggggcatctcggcctcaatacctgcatgagcacagtcatgtccaggccagggctgctggtcgaggtccggccccatctcttccagcagaaagggagtaagcttgcagggaggctgggggacaagatcccaggatctcagcctctgctcatggatcagctctgagaccccgagtgagctgggggtgctctgtgcgcattggtttccccagctgtcaagtaaagggattggatgaggaagtcttgtcaaggtggaatgatctcagatttggggcagcagtgaaggatcccgctccctgggccatgccagtggcccggcctcggctgaacacagccccaacactctggaatggggatgagggggcagtcagctcttgctcctagtaagagagatgcaacagggctctgtggctgagctgggtgccttgcctcacacttgtaatcccaacctttgagaggccgaggcaggaggattgcttgaggccgggaattttgagaatagcctggacaacatagccagaccccatgtctacaaaataataagaaaacacacagctatagtccaagctacttggcaggctgaggcaggagggtcccttgagtccaggaattggaggctgcattgagctataatcgcaccactgcactccagcttgggtgacaaagtgagaccctgtctctaaaagaaaaaaaaaattggcctgtgagcatgggtttgatcttcaaacaggacctggagggtagggacagacagtgctgtcacccttaggtgctgaacactcagaaacgggccagcggcagcccttccctcacctgcagacaccagattgggcagaacagcacgtggcacttgcagctcttgcagtgagggcagaacccagtgtcaacccttctgcctgtgggaggggctgctgaggcctgcggagaggccagggtggaggctcgtccccttgtccagcccttggcgtggtctccaccaggtccccagcccaccagtgcagggcgcccctgagcctgctgctgccacgggccctgtctctacccaggacgtccccccaccctcgctgtgtcagggaaatgatcatggtggcggtgacactccgcaggcagggctgctgagagaagctgagaagggtcacactgcaggcagaggcccgtgtgacaagcccctctcaccccgagagagctgaccaggcagctcacgagcagagccacatcccgggagtccgagaaaggtcctggctgggctcagccacctcattggccacgggcagcctttgtcgtgtgagccttgctctcctggggaggctcaggctgacggctgatgtgggcattgccgagggtaacctgtggcccagtgtatatggccgggtctcctcaagctgcattcattcaagtaggacccagggtgcgtgcccatctccagcccagggcagctcccctgtaagctgggtgagctactgaagccaaggcaggaggcagctgacaacacccacggcccatgcagaggtggtggaaaggctggagtcagcagcaacaccaaatcccggaccaggcagaaaccacccaagactgaggggctcgtgccagagcggtggccacaggtaagaacccgggcccaggctgtgtggcaggaatcctccatgtcccagggcttagcatagcaaaggaagaccagccgggtcaccctggtggccatctgtccctgtcccacctgcagagtcagaacagcctctccccagtggggatcatctctctctgccaaagcaacagcggtccctgccccaaccagactaccccactcagtggagttacggatgctgctccagcatcctaacactgcccagctggtgcctgcctgtgctcacccgcaccccccaggccggccttccctgcagcctgggcttggccaccttggcctgattgagcactgaggcctcctgggcacccagccccatcactgcacctgctgcttccagccccaccccacaagctcaggggttcttcccagcggcgctgatcatgaagtcaacatgcacgcaagtcgtctcaggaaactttttaatgaaagtgttggccacggtggtgtgtaggtggctgagctcagattgcagctgctgagacaccagccacttaccaagagaaagccaggctgcttcaaacccagggcccgcggcaaaaaagcatcacttccggccggggagtctggaagccacgccttgtgggaggtcacactggcatctaggccttcgcctgcactgcagaaggagagccgggtccccctcctggagaacgctgcgttccccagccccacaccggctttgccaccacacaggctgttgaggcaggaggcgggtaagacgtagctgtagacccaaagcaaccaccagccctgggaccctgcgggagagaagcacttttagaacatggaaaagtgtggtcatcccatcattagacagcacacatcctacataaataaaaagtcgtatggggaaggaggttggggagggaataaaaaactggcacagacattgatagactggtttccagtttcaaggtaacagatgcacatcatgagaccagaggaggcagagacaagggctggatttggcttttctaagcaacatgtgttcctgcgcagggctgaatggtcactgagacagagatggaagccaggacaggggagcccactgggcccagataggtacagagagcagaggctcctgttctgtcctcaccacccatgagggtgacactgcttgtaaatggtggctgtgctctcccagcaagaaaaaagcacaactaaatccacactgcacaaagacgcagacagaaagccttcaagtggctctgttttctgctccctgcctcatcaggtccacaagcagagaggagtgtcaggtacatatccctgctgtcaggctccccagtaagctgcgggctcagcaggagctgcccactgacacacaggggacacccactcctgccaccttgggagcggttgccagacagagccgtactgggtgctggtgtcatccagggaccccacacacttccttaaatgtgatcctgcttccctctgcgcagctgcatcctctcctcctgcaggaccgtctggaaacttggctctcagtttgctctcccttctctcctctgcctgccccaagcccctctttctaaaaaagtgatgccacgttcatgggattatttcttgaaaatacttggcggcctccatgcttctgttttctttgagtcaggtagtcaggagggtttacaaacaatgcctgggctcccccgcaggtgccggcagatggggtagcgaatggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggacacggattgtccagggattacattccagcatcttattaggtatctggatctgttggggaaaaaattagaaactatgtataaaacttacaaatattcaagtatcaaaaggttatttaggatgaaagttttaaaacaagtcatcagcaagctgctaccaccaagtggagacttatacaaaagttgagcgagtccactgagctgagaggacagaaatgaagtcacctgtgctggggcaggggcagggacactgggggcagggagtgtgtgggcagagaagccagagaagtccaggcctgtggaagccaaacaggagagcgtgggccggaagggcggtcaggatcgggggacgaggtcgctctccctggagaacgaaccctaaggtgcgtagcctgggattccctccctggaggtcctgtcccccgacatttcacaggccttctgagctgctttccaaggaggactaacacggcaacaaaagaaccatttctgcacaaaaatcctggaaagaaaaagaagcaagccgagaatggagtcaaaacgctacccagtgctgactaagcctctcaaaccctgttctaagtggactgtggtttctaagtcagggaaatggaagaggccccacccacacagggacagggccacggcccccacaggatgaagcagcagcgtttattcaagatacaacagtgagggaatccggtcacgttcccttctccccagagagggcgcatcttgacaagtgatcgagtagaaatcttttaaactctaagttaagttcataaaaaccactggtttcactctgtctcccagggccaggcctggcctctgagatgcactggcttggggcgccctcaggtggctgcatggaaaacccacagtctgaggccagcctggggctttcagacctgggcgggatctgcccaggccacctgtccttctgctttgggccgctgtctcttggcagatggcctgacacctgggggtggcccaaggatgcctcagaaaatcttgattcccactctacagatagcctgattagccagaggtttccaggccatctgtccgcctccaggagatggactgggacctttagacatcggtggagaacaggatgctctgtcccttgctgtccggggcagggacggcctccagccgcaagaagtacagcagcacctcgacctgccctcgcggagtggggaagaggagagtggctcagaggggggctcacagctgctggtggggaggtctttggggcccaagtccccaagtccacctcaggtgctagaaacccctgctggtgtcatgaaccccttacagtgagacgggggtggggtggggtcctgacaaggcatgacttgttgggtggggggtggttatttattttagagatgcacagggccttgctctgtcccccaggctggagtacagtggctccatcatggatcactgcagcctctaactcctgggctcaagcaatcctcctgtgtcagcctcccagatacctaggattacagatgtgtgccacaatgcctgcctaatttttctttgtattttttctagagatggggtttgctacatttcccagactggtctcaaacacctgggttcagttgtcctgcctcggcctcccaaagtgctgggattacaggcatgagccaccacacctgaacacttggggtggttttaagcccccagcaaggtgcaccagcaggagcaggaggtggcctaggctccccctatcactcccatccatgcaaacctaggcaagtccctgtctctgaatctcagccaccaccacatacaatgcaagttggaagatgggcaggactgggggtggggcaggcagaggccacctctgtcaggctggggttgcatgggctggagcctgtcttcccacacctgggacatgacctccaaggaccagctgtcagtcatggtgatgggctggccggggttggcagggagcttgctctccttctcggagggccggagcagcatggggccaaagacagtggcaaggttgtgcagggacatcttattgactgcctccttctctgccaccctgtagaggaccaaagcagaaggtgctgtttcaacgccaccaccaggagagaggcagaggggctgtgccgtgctagagtcctcagggagagagtgacctcgaccctggctatgagccaatgcgcccggcctctcactcttctttattcagcataatttattctgacgtatcttcagtgtaggtattctctttttattctcctattcctgttaaacccattgggctgaatgctgtttatttctagaatgtctacacctgtttttctgcaaggtcatttttttttctcgtttgctgttcgtcacatatactttcaagctcatcggttccctccgtgagtacaggtaagtggaggagcctcatggtctgcctcaggtctttgagatgttgagtctctggatctggtcctgctgctggccttttctgtccttgctcatggggcattgtttccgtgaatgtgtggttacttttgactgcattactcattgtcctggaaaaatgactttgtgggaatttttcagacctagggtaaagatgcttcctccaaactaggtttacgcttccttctgccaggtacctcagggcgctgtcagcctaaagccaatttaaactaaatccatcaactgtgaggttttggaatcttctcactggtgtgaatttgggccataagtcccaaattctgtggggtgctctgtggggtggggaccagccttagagttctcatcggaagcccggggtggctggatgggggcagatgttttcagggcaagagcggcttggctcgcctctctggtttctggtttccccagatggtgcctggcggctcctcactgtcttgtcagcccctggatgcctttaagaaaacatccttttattttgtcagcatttttggtacttctcagtgtgagggctggtccaagtatttggcttatcatagttttacaaaaagttggtttctatgaaatcttaagtcacctcttttttaaaaatgtaccttttagtccgggcacggtggctcactcctgtaatcccagcactttgggaagccggggcaggcagatcacttgaggccaggaatttgagaccagcctggacaacatggtgaaaccctgtctctactaaaactacaaaaatcagtcgggtgtagggccaggcgcaggggctcacgcctgtaatcccagcactttgggaggccaaagcaggtggatcacctcaggttgggagttcaagaccagcctgaccaacatggagaaaccccgtctctactaaaagtacaaaattagctgggcgtggtggcgcatgcttgtaatcccagctgctcatgaggctgagacaggagaatcacttgaacccgggaggtggaggttgtggtgagccaagatcatgcgattccccctgcctcagcctcccaagtaggtgggactacaggcaagcaccaccatacccggctaacttttttttggtatttttagtagagacaggattttaccatcttggccaagctggtcttgaactcctcacctcgtgatccacccacctcggcctcccaaagtgctggattacaggcgtgagctaccgcgcccagactaaaagcgcgcccggccgtctactacttcttatagggtgagaggcgggaggatcgcttgagccctgaagtttgcggctgctgcagttggctttgatcgtaccactgcactccagccagggtgacagcaggaccctgactctaaaaaaagaaaaagaaaaaaaagcatatactattaatacttcctccttactataatatttaccgtggcctttatcagactagagagtgcttttatctctcccttttgtaagaaagagcttttagaattatcaatagatggtcaggtgaggtggctcaggcctgtaattccagcactttgggaggccgaggtgggtggatcacgaggtcaggagttcaaaaccagcttggccaagatggtgaaaccctgtctctactaaaaatacaaaaaaattagctgggtgtggtggcgagtgcctgtaatgccagctactccggaggctggggcagagaattgcttgaacccagtaggcggaggttgcagtgagccaagattgtgccactgcactccagcctgggcaacagagtgagactctgtctcagaaaaaaaaaaaaaattattaatagatggtgaccctcatcttcacgttttctgcatctattgaagtgcgccactgagatcgtggagttcttccctgtttgtccatatgatgaacaacactgattttctgatgttgaacaatccctggaataaactctgtttggtttccatggatttctgtttccctttagattttgttagtaatttattttggatttttgcatccaagttcataattgtaactggacaaataaaggcagattttaaaaggacaagttgggaggctaaggcggaaggatcacttgagcctgggagattgaagctgcagctagcttcgattgttccactgtactccagcctggtgacagcaggacctgcctctaaaataataatacttaaaaggacgagtttacctacagtctcaccaagcaatgaaagagcttatcttcttcctgtttcctttacggatcttgctcatgtattttatcttagttactttagcataaatgctaaatcaaattctttttcactagacatcataatagctctaggcataccacataatacccaagcacattttaatcattaaaattgtttcctttttttgtggctactgtaaccacttcagcgaaccatttagtgtgtagtgggtttaaattttttctccttcctgggataaatttcccaggagagggataattgggtcaaaagttacgaacatatttatgggttcttttccacaagagatcgatcagtttgcaagtgccatctgcactgtgggggaaccaatcttcaacttgcctgcatttggtattagtatttcattaacctttcattgatctaattacggctctttgacacaattttcatcagtgatggactaagtgtgatccggcctgacccgcctccggccggcgtgagaaggggcatgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggaggtgcgcggggaacgcccctctacctggcgggcgcgcgagggtcggtcccgcaggcagcgccgcgaggtgcttcgcagagtaccaggctgatccgcccgggcccgcatctctgctctaggcccttgggaacgggtgatccacccagcggacccaggtgggggactcggccaggacttcccagtcctcaatcatgagcctgcggctggtccttcctggcgactgcgggatcctgagcgacccagtccgccttgtagcgccaacctcagtttccctctgcaggctgctgcggaggcgaagccaggaagcgctgcttctgcaaggggaggtgcgcgaggcggcgcgggagcgcgcgcagcgggtgcgcagaagactggaggaggcggagcgccacaaggaggacttggtgaggaagagtcctggaatggggctggacccagggtggggtggggcagggcgggcggaagggggcaggatccgggggtggggtgaggtaggaccggcggtgaggccggcaccgccccaggaccctgtccgcaggagcagcacagcaggcagctgcagggcagtgggaggagctgtcgagtcaggtacgtgcaggagatgggagggcctgtctcttggttcctctcggaagtcctgcccttgccctcgctctcattgcctccccgtccctgtctcccctgacactcgttcctccagaagcccggtaaaccccgtccttacgagccccgcccctagctcttctactacggaggggaactgcagagccagaagagcacggagcagcaactcgcagcccaattggtgacgctgcaggtgcttgagcgggaccctgaggtctttagtaggggcggagcagcagcgtgagcggggccgtgaccacctgggggtgtggcttaaggcaggccctgaaggcgtgggcggggcggggatgtgggcggggcataatcgcctgggggcggggccctgagggctagatacgggcggagcgcggagggggcggggccatgaccagctggggcgttgcttacgactggtcctgaggacgtgggcggggtcatgatcgcctgggggcgggcactgagggccgggggcggggcccggaggcgcagcgggttgccggcctgcggacctcctgacattccctgggtccttctcaagaatgaactggagctggcggagaccaaatgcgccttgcaggaggagaagctgcagcaggtgagggcagaagcgggttctgttggaggagggtaggctttcgagtgtggatggggaagggcctgtcgccccgcccccgccgagtctaacccgggtgtccacacccaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcttgcgggcgcggcggggcactgtggggccgggccgggctgggctcccacctgcatgcctgtccccgcaggtgtgacgggcagcttcgcagagtgcagtacagcaccgagtcgctcatggaggagatggccagggcggaccgagtgagcgcctgcgcgggtccgggcggggtgggctggagcgggacacccctccccatcccccccgcggtaccgcctccccctcctcctggaaaccgggccggcgccgcgggcgcggaggtagctggatgcggccctctctccccgcaggagacgcggctgttcggcggtcctcgcgcgctggccatcaggtgagcagggcggtgggcgcggccgcggtcccccacgtgcccgcccgagccgccgcccacctgcccgcctttcgccctgcaggcgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcaccggctttatttctggtgcactcctctcctgagagtgtagaccaaggtcgcctaataaactcctcaagggatgaagctcgtgggttcgtcgtctgtctcccatgtcatgtaggagcttgactggcttttcagcctccaaagattccttcctttcttacagctcatggatttagatccactccccagtattgtaaacagcatttttagtttttcaggatacataatttgccatattgccagaaacttgtacatagcatttgacacttttttctttgccaatttgacaagctgcttttttcaagtattgtgatttgaaattatttctactatatttgaatttatttctaccatttgtaacatgttgatcctgatttttcaatgctcccctttccttctgtttgattatttgggaagtcacactctgtattctggtattcttactacttgagctcagctcattgctgtcatcttcccctaaaccgccttaaagcatcttaggtcttttccctctgatcacatgtgctactttttttttttttcttttcttttgagatggagtcttgctctgcgcccaggctggagtgcagtggcatgatctcggctcactgcaagctctgcctcccgggttccagcgattctcctgcctcagcctcccaagtagctgggacttcaggcgcctgccatcatgcccgtttaattttttgtatttttagtagagacagagtttcactgtgttagccaggatggtctcgatctcctgacctcgtgatccgcccaccttggcctccccaaagtgctgggattacaggcatgagccaccgtgcctggccaacattttctccagatatcttaccgagtcctaatttccactgcggacagagaatacactctgcgtgattttaattctatctcatttactgagacttgttttgtggcccagcacaaagcttgtaatgaacattgagaagaaagtgtattgttgctgttgacagagtgattttttttttgagacggagtctcgctctgtcgccaggctggagtatagtggtgtgcaatctcggctcactccaacctccacctcctgggttcaagtgattgtcctgcctcagcctcccgagtagctgggactacagatgcatgccaccatgcccagctaatttttgtatttttagcagagacagggtttcactgtgttggccaggatggtcttgatctcttgacattgtgatccgcctggcttggcctcccaaagtgctgggattacaggtatgagccaccgtgtcaggccgacagagtgtgttctaaatacccagcaggtcaaggtgagtgacaggcttgttcagggctcctgtgtttactttcttgttggtagcgccgtcaattgcttattgtgaaatgccccttcataaacacccatacacattttgattatggatggcccgtcttttttccatctgttattttcatcttagatctgtcttcatatgtaaagtgctttggttataatcagcacataactgggtctcacttcttcaattcatgtttataatccctgacttttaaattgggctggtaagtctattatgtttctccttttctgccttcttttggattagtatcttttaaaactccttttaacttatacgctgactcatattttttattaagacagtctcactctgtcattcagtgtggagtgcaatggtgtgatcttggctcactgcaacctccacctcccgggctcaagcgatccacctcagcttcctgagtagctgggactacgggcttgtgccaccatgcccggataattgttgtattttttgtagagatggggtcttgccatgttgctcaggctgttttcaaactgctggactccagcaatccacccacctcagcctccgaaagtgctgggattacacatgtgagccactgtgcccagcctatatttttatttgtactgctcaggactcaactgtgcttcctaaagctgaatatttgtctttttcaactctggaaatcccattagaaattgattggggccgggcacggtggctccaatctcagcactttgggaggccgaggcgagcagatcacctgaagccaggagttcaagatcagcctggccaacatgacgaaaccccttctcttctaaaagtacaaaaattaattagctgggtgtggtggcgtgcagctgaaatcccagctacttaggaggctgaggtaggagaattgcttgaacctgggagagaggttgcagtgagcagagatcacgccactgcactccagcctgggcgacagagtgagactccgtctaaaaaaaaaagaaaaagttgactggagcttttcattcaactttttttttttttttttttgaccctgttacccaggctggactgcagcggtaccatcatagctcactggagtcttgctcttcggctccagtgatcctatctttcttaccctcctgagtagctgggactacaggcatgcaccaccatgtggctaattttaaatttttttgtagagacagggtcttcccgtgttgcttatgctggtgttgaactcctggactcaagcaatcctcctgctttggcctgctgaagtgctgggattaggagccaccccgcttggctttcctttccttcacactgcatgtttggtcatttcactattctgatcactgattttctcttcttacctgctgctgtttagctgatcttttggagtttctcttttgtttcaggtctttattcctatctgcttcagatgcagggcctcggtgggtgggagtagatgcttgctgggtctagtcacacaaagattttggagttccagagcacagcacttcaaaatgagcaagagggaaagactagagcagtgggaagatgctgcggagagccacagacaggcccccacggcagccctgagggagacagttttggagcgggcagacagcagtcaggacaaacacaatgtgtgttttggtgcacctatgccgtggtgagattgtgggaatctcatgtttgttaagccacaacccgtgctcctgggccccagcctatgagtgcagccaacactgggcccccctctctaggggcaaatccaggaactgccctttggctgaaggtggacttaggacttgacacaaaacctcacagattccaacacagcactattttgggtttttattttgttgatgttggttaaatcttatctctttttttatacacaatacttcatgtacctatgaaataagacaggtagggaatatgtccagtgcaaacagaggactcacacctgtgcatagacagcaccatccattgattgtcgctgcagtccatggcgttaccaaggctgcgccacccacgtgctgccccaggaggcgctaccaggttctttgggccacaggcctctcctccactgcatgtggcggcagggcagggaggtcgcagggctccatgattgtgggacagctttgagggcacatggggcagaggccctcgaaggtcccctcctcagtaggggatgtcattctgatagtactggatcatgtcgtaggtccggctcctgaaaggccaaggaagagtgaagggagattcgaggagccagcagggtctggggtccctccccacagggagccctacctgtccaatcagccccttatggctgcccagcacctgaaggtacaaatgtcccaggcgtgccctcccccacccagtgaccacatctcctgctccaacccgggggactccgaggccacctcatgctcctcagccaaaccgcttccatccgtgggagccactgctctgccccatgggactcgggccccttggctcgtcctggccagatgcctccaaggggtctgtacgctctcctcgcacctctggagagccccttctcgccctgccccagcccctcttgaggtcctggccgcctggcttctctgcttcctatcagcaagagctccttccgtgcccagcctccacagtgcccttgttagggtgccggacccgggcgccacctgggggcaggtctcagcttcctctcacgctcctccggcagttccccatgcagatggccacacctgggcccctcctcctagtctgtgaatgtggtctgtcccatggcacagccttgggctcccacatgcccctcagggccttaccaaccccacatgtttaagtgctgcccccttcggggatggctcacttgctgggatcgccatcctccctttgttcaggccggacccctcaaagccacctctgactcccacagcagggagcctgtcagcccggtgctctgccttcagaccctgagccagccctccccagggccccctgcacccatctcctcccaccacagtagtgaccagcagcccggcctgcacctccagtcactgcccacgaagcagcccgaggcaggcgcagggaaggagtgggctctgactcctcagccctcctgggaggagggaggcctgacaccacactcagttctaatactcctggccttgtgtccctattgctccttcggcctcacgagccctgcccaggtgggcccggcctctgccaagtgttcccctcggcacaccacagccccctaaaccagcaccccactgctcctcaagagctcctgtcaagacttgggtcttcatgagaggggcggcttggggacagcagaatcctcatcgcctggtgcaggcaaggccctgcaggtgcccagtggccaccgaggcagtgggagaaggcaggggggcggggcactcacctgttgctgaggaagcagctctggatgaccttcatgatgaaatttgcagcctcgcgctcagtcatgttggggctaaacctgtgcctgggggagaggctgtgtcagggctgccatgggcagggccgtgctggctccctggcccagtgggaggagggtcttccatggggacggacttcagctgagagccacgccctggaaatgtacctttggggtccacatgttggaagatggggtgctgtgaaggccacgcctggcctatcatgggccctgtccccttcccagcatcacctgagtggccccatggcattaggggactaagcattggggagctaagctactgcagccccagaccttagggtggaggtgggttgggcgtagcatccttgacataaagaggcccctgggtgggtctctggtgtggccggcacaagcaggggcccctcacagttgtggtctaggggcagagcctcacccaagaaccctgtctgctctgaggttccaaggagatgacaaccacagtgacaattacatgaaaggtacctatcttggatggagcctcagctaatggacaactgtcccccagatggcctgcgtgtccaccaaggaacctacttcaagagcttgattgtctggccgcgaaaacagggcaggcccgtgtccaacatgagagtgaccagggagacgaccgcgtccatgtagggcctggggagagataggagggagcggtgggctgaggccagcctaggtggtggccctgcctgtagtcctgtggactggctgatgccaacagcctcaggtgtgggctcctgccacccacctcgcctgccacatcttgcacatccccgaggcaactttcgatctgctgcacttggtaacccataccgcccaggcaagggctgcccacacgcactctggacaggctgagtgtcctgccctgtcccccacataaggctgccggccatggcttctgcacttgggtgggatgcagacacgctgacctgcctttctctgcagggcagtggggatgaacccaggttggactgtggccttggccaagtgacctgtatatgaaactgggacaaagcccatctttggcacgtagcctgtggggtggcaggtgctcaggctttggtgacagggtggatgggatgcccagaaagggagagcccatggctgaaggcgtgggcaggatcgtggggaaggtggttggaattagatgtccagagcaagaatttactggcacaggtgggcagacagaggtgaccaaaggacaggtgtaggtcagcaggtggctgctagcacctacctcactctctggaaccggattcccttcatcctaaaggggatctcagaacgttccacacaccccctccgcctccaccctggccctcacccaggctcaccgcacagccaggtagcctcggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacaagtggtctgttttgaggagtggaaaaggactgcaacaggagcaccccctccacccccaacaggcaggttgtgttttcttggagacagtgatggggtgggtggtggggcagcaggcagagaaagagaagggaggaagtggaggaaggagccaagctggggcactgaacctggaccagccccactccgcccagctccagcttctgactcagagcaatggcggctctcgccctagctccctggggccggggccaggcaccctctacagcagaacagcttggtggccgacagttcggacctcagagctggaccctgacactcctggcagggtggtcctgggcattctcctctctgtggggtggggatccctatccacccctgggtgccaggggtgaagggagaggagggtggcgctgtggctggctgaccgatgtggatgatatgacccttcttgtccagcataatgttgccgttgtgtctgtccttgatctgcagcaggaacagcaggaggctgtaggcggccatgcttcggatgaagttgtagcgggcctgtgcagagagcgccctgggctcaaaaaggccctggggcctgtgggcattctccctggtcccacacccaggatccctgggcctgtgggcactctccctggctctgtacccccactgtggaagcagagcccgaatcagcaagccagtcttcggtagcaggagtgacaggggctctctgtggaagtgggcgtgcaggcacttcctcccacactcagaacttaactttcttctaaggagtccaacccagccctacattcttttgactcccaaagtggcttacagatgccctggtgttttttttttaaatggagtctcgctctgtcgccaggctggagtgcagtggcatgatcttggctcactgcaacctctgcctcctgggttcaagagattctcctgcctcagcctcccgagtagctgggactacaggtgcccaccaccatgcccagttaatttttttacttttagtagagatggggtttcaccatgttggtcaggatggtctcgatctcttgacctcatgatctgcccatcttggcctcccaaagtgctggcattacaggcgtgagcactgcgcccggccaggtgccctggtttttttgtgtttttttttttttgagatggagtctcactctgttgcccaggctggagtgcagtggcgcaatcttggctcacagcaacctctgcctcctgggttcaagcgattctcctgcctcagcctcctgagtagctgggactgcaggcgcgtgccactatgcccagctaatttttgtatttttagtagagacagggttcaccattttggccaggatggttttgatctcttgacctcgtgatctgcccgcctcggcctcccaaagtgctaggattacaggtgtgagccaccgtgcccggcccaggtgccctggttttaacccttaacaaaggatgactgaggagagcagggtgtgggtggaggctgggtatgggtggctggggtggggtggagcacacacgacctcccccggcctgtggccaccctggctacctgctggaaggccagagtggactcatccccgtactggcgtgtgaagtagtcgtacatgccgaagtctgtctggcggcccagctggtcccgggaggtgcagtcggggatgcactcgatcaccccgcactaggaggaaaggccagttctgaggcccgctgggtgcgaggtgcccagggctgccctactggctccactcagggaacttaccccaggggcagtggccaccacgcggtagggaaaaacaaagaggtccaggccgaccagctggaagatgttcttgaagaggtcgatgatctgcagggccagcatgtcctgggaagccgggaggcgcaggatgcggtcagttggcgtccttgcaccccagcagctcttctggctcatgcagggcaaaagccaagcacccagagatggagtgaggtggggagaccacagccgagcaagagtctggaaggccttcctttctgaccaccgggggctggactcaggctgctgggaccaccaggccctgggctgagcatgaggctgagctgtctggtggggtgtgtgagataaggcacccaacccctggacagttccctcaggtgggcactggcatggcggggacagtgggaaaggggctggaaggagaggcctctgggttttgcagaagccctaatttaccccgtggcacctgaaccatataagagaaggaaaagattcacatttctgcatatgagattggactctggcgggcctggagccttggggagcagcaagcccagtccccaagcctactcgaggcctgaccctgcttacctgccggcagtcgtctcccaccttgaagatggctgcctgccaggagatcttctggccgtcggcctcctgcgtgctgcactcatcctcggagtctgagcggcaccgcagacctgcccgcagggagagaggccgctgttagcctgtaggcagtgagaagccctctgagggggccagggatgagtcctctcacatgcctgaaaggaaccccagcaatcttggggatcacttcttcaaaaccccaaggaggccaaggaggagcccagcagggcccaaggaaagccttggaacagcaggtggaatccagggttggagtctaagaacatttaggcttaaatggaactaaaaacagagccccatttcatctgcagtgaagacccaggtgtgcctgggtcagtgttgggtgctgtgagctagggggcaggaggaatgtgtctgtacactggggtcctgggagggctcggggccagcgtgcagacatggccatgggaggcaggtccctgcaaggggtggcagccccctctccacagctggccacaccgtctgtactgggttgaagagtgtctccctaaaattcatgttcaccccaaaccttaaaatgtgtccttatttggaaacagggtctttgcagatgtaattaggttaagacaaggtcacagtggattaggacagtccctaatccaatgactgatgtccttcaagggagatcatcatgtgaagagggaggcggagatgggagtggagcatctgcaggccaaggagtgccaggactgctggcaacaccaccagaagctgaggaggcaaggtgtgacctgcccagagccttcagagggggcacggccctgatgatggactccagcctccagaactgagatcgtccgtacggtagccctgggaaactaacaccccccaacagccccgggcccctcagcctcaggaaggagcctgctggagcatgccagctgactcacggcagacagacctctggggtggcacatctgtcagtgcatttgagctccctgccatcccccaatgagggatctgactgagtgagggcagacagatggacagacatcatcttttatggagagctatactaaatttaacacatgccagaagaaactggcattagcaaggaaaagcactgagctcccaaacaaaatcagggttctttactgaccttctttttcaagttcactaactccacatcgcttcaccttgaacttggccagatatggggcttttgcagcactgaaaacaacaaaaagaatgtggcacccatgatgcagccgagaaaaacttcgcacgcggacgcgtggaagtgggggatgggtagggtgaggcgcccacctctgcatcggggtcccagacttgtagtcgatgtccagcacaatggcctcagggttgctgggcaggtagcagcctgtgcagggacagaggcagtcacagggagtgcatgtgtcaccacaggtgagccagagtcagtttccaacacggatgttacatgcgtgtccaccctgcaggcacaccccgcccctgtggaggggcctctggtccttgtccagggcaccactaacttattattccatggccgctaagggtccgtcctccttgactcttcgactcttccagccatcaaccaaataagtctgcaccttctgggaaatgctcttcctggaggagcactgagccccatcctcacggatacagccctactgcttctgggggtgcgtgtgaggcctgtcctgcctccacctgcctgagcaaccctctgaacagccctccattcttggagtccttttttttttttttggatagagtctcactctgtcacccaggctggagtgcagtggtgcgatcttggctcactgcaacctccgcctcccaggttcaagcaattcttctgcctcagcctcctgagtagctgggattataggcgcctgtcaccatgcctggctaatttttgtatttttagtagagatggggtttcaccatgttggccaggctggtctcaaactcctgacctcaagtgatccacctgtcttggcctcccaagtgctgggattacaggtgtgagccactgcgcctggccttccttacccatttgaatactactctctcaaaaggcttacttaaatgtcactatgtccatgaactgtccttggttctcccagcctttaggacttttgtctaagacgtttctttttttctttttgagacggagtcctactctgtcgcccaggctggagtgcagtggctcggtctcagctcactgcaacctacgcctcccgggttcaagcgattctcctgcctcagcctcccgagtagctggaattacaggcgcctgccaccgcgcctggctaatttgtgtacttttagttgagacggggtttcaccaagttggccaggctggtctggaactccttacctgaggtgatccacccgccttggcctcccaaagtgctgggattaaggcatgagccaccgcgcccggccaacattgtttctttatgtttattttatatctctgtgagttcaagcttcttcagctcagggaccatgtcttactcatctttttaacagctacaatacctaatgtcatgccttttcttttcttgtttttgcttttttgagatagagtctcactctgtcacccaggctggagtgcagtggtgcaatctcggctcactgcaacctccacctcctgggttcaagtgattcttgttctcagcctcccaagtagctgggattacaggcacgcgccaccatgcctggttagttttttttttttgagaccaagtcttgcactgtcatccaggctggagcgcagtggcgcaatcttggcttactgcaagctctgcctcccgggttcacgccattctcctgcctcagcctcccgagtagctgggactacaggcgcccgccaccacacccggctgattttttgtatttttggtagagacggggtttcaccgtgttagccaggatggtcttgatctcctgacctcaggtgatccacctgccttggcctcccaaagtgctgggattacaggcatgagccaccgcacccggcccaggctcccctttctcagtgagtgctcagtaaatgtgtgaaataagaggacaagggaaagcctgtttctggccaaggaactgccagtccccaagggggatgtgtgctccttgagccctgagaggtgggctttgaggggagccaagcttggccttgctgtggggtacagggagaggggggcatgccatctcctcctcttcctcacctgcccttcttcctgctccaggctgtggctcacactcaggcccctctgtgctctcctgctagagccctgctggcttccctgacctctggggcaagactcagccaacacaatctagagccaggggctggggacttctgtgcatgccccctgcagtacaatgcttccagctctttttgcccctccccagcagttgtggccttcccgatgcgggaacagaggccctgcatacatgtcctgccctctctgggaagccgtgctgttgtgtgagctcaacacaatgtgttgggaagaaatggttaaaccggggtcctgcagggcactccacagctgagaccagccgctgtgaacatctgcacaggacagagtttggaagacaagtttgtgccaatagttagaaatgcagagagaggccgggcacagtggctcatgcctgtaatcctagcactttgggaggccgaggcgggcagatcacaaggtcaggagattgaggccatcctggctaacacggtgaaactctgactccactaaaaatacaaaaaaattagccgggtgtggtggcgggtgcctgcagtcccagctactcgggaggctgaggcgacacagcgaaactccatctcaaaaaaacaacaacaaaaaaagaaatggagagagagctgcccagtgaagtctggatttccatcttctcttgaaaagctcagcttgaattcccatgtggccacagccacaggcacccaggagcgacttcccatggaggcggtgggggggtggtgctgatgggtcccagcacacctgagccgtcccacactgggcccgccatcccctcgtctgtgtgacctgctcctgtaatgctggagcctaggaaccctcttctagagtaacagctactgaggtcactgtcagcctccagaaaaacagcaggcagcaaggaagatgaagggcacccactgacgagcagctcccgctcactagcggcagattctggggaggggctggggtcctggggcaccaggcaccgtgggcccaagcaggtgtggggctggccaagccactgtgtccacatcctgcagtgcctggagagggcagcagccttcacgccccgccgcccgcctgcaggaagaggttggtctgagcctccagaagccacctgctcacccggctgcaccttcacttcagacagggccgacagacaagccttctttctctcgtcgcctttagggtagggcctgagaaacaggaaagaaattcttgctttgtctcctggaggaactggctgctgggggacagcccagggcccctcctgcctggattgccctctctgtccctctcttcccggctctagctgctcctagcgcagccaggcaccactggcagcgattcttgccctgcattcctcatggagaatccccgacagccccggaagggctgttttctggcaggctctgcccctgctgtgtgcgggggtgtgtggctgggggtggtgggggtaataatgcctgccacctgctgccacccaggaaacgctagctcccgtccttcatctcgtgggttagaagctgccagcactgctattctcagcacccagcccagaaaaggacctcaaagtgaccaaggtcagagcagtgtaagcactggagacagcccagccagcgtgcccagcattgatgactccagggtttcatcccttatgaatgcacaaagccatcaacatccaaggatggtgtcaggtccacatgaatggaaggtctaggaaaacgatgacaggacctgcaaaggcagtctggttttcctgacaccatgaggatcgatccttcaaagtgtggagagggcagggtggcctcaaattgtggagccatgtgctaaattccacaaacctcaggaatgaaactaagctgtgtttcctgaaactggcgtggccgtgcattctgccataccttcaagagccctggctcaccccaagcagtgcttccccacccaccctggctgtccatcagaaccaccagcggccccgctgctagagactctcattcatctggttggggccaggcacgggtatttttaaagcttcccaggcaattctgttaagctgcagggactggaaggagatcccagaaggtggtttctgaagcactgcacttacttgatgatagccgacacgttggtgatcttgttaaagaaatcaaactcccgctggtaaaagtccttcgctgggccggacaaggagcctgtgatctcctctaccaactgatccaggaggtcgccgatgtcagctgccaaggaagcaaagaggcttaagtctctgtggctgtggcagaggcccctcaggaataccagccctgtttcccaggccccagactggcagtgcccagagtatgctctgcaggcttggtgagaccataacagctgccgtgtgccccttttgctgtgttgacacagctgacgctgctgggaagctaagctggtgcctaagcggagctcaaggcaggggccaagcgcacaagtggacgtggaatcctcactgctgcacacgctacacacgcaggaagaaaaaagcccgtgtcatttatgaatgtcacagggcatagaatcctcactgctgcacacgcagggagaaaaaagcccgtgtcatttatgaatgtcacaggtgaagcaatgaaaactaattcttattaaactctaccctgaatacatgtctttttttttttttaatagaggcacacagtgggcggggctctatattaaatagtgcctctcactattcaaatcccaggctgaatttaaattcctgggctcaagagatcctcctgtctcagtcacctgagttgctgggactacagctagtaggtgggactacaggtgcgcatcaccacatctggcttttaaagtatcctttgtgatgaaatgggatgtgcacgaagcactcttgccgcatctaaggcaggcgctgtcctgagaagcacctggagcttgtctgattttggagcctggactaacctttttcacagacctttgtttttacttgaagaaatgactgacagacaacatatagctattcagacttagggatgtggcagatgttttcctgaaaatgaacaaaaaataaatcttccactcaaaggaactgaaacatttttttggaaaacttggatctgctgctgtgagctcaacagcttcccttaaaaactctttctgggccgggcgtggtggctcatgcctgtaatctcagcactttgggaggccgacgtgagtggaccacaaggtcaggaaattgagaccatcctggctaacatggtgaaacaccgtctctactgaaaatacaaaaaaattagcaggcgtggtggcaggcgcctgtagtcccagctactcgggaggctgaggcaggagaatggcgtgaacctgggaggcggagcttgcagtgagccgagatcgtgccactgcactccagcctgggcgactaatcaagactctgtctcaaaaaaaaaaaaaaaaaaaaaaaaaaccctttctggtaagactggcagatgtgaacaaatatgatttttccacactgtacaaagaaatgcatcaacctttgaaagatgtgcataactcactggcctatattttacaaatgcccaccgtttgatgttataaaagcttttgtgggtccaggtgcgacgtagacagacttgaacaaaacacagcatgagaagtttactgccaagtttaagatgccacactgcaattaaccttttttttggcgatcctcctgccttggcctcccaaagtgttgggattacaagcatgagccaccatgcccagactgcaagtaatcattaagaagctaggctgagctacaaaaaattaaaaattagccagtcgtggtggcgtgcacctatagtctcagctacttgggaggatgaggcaggaggatcgcttaagcccaggtggtcaaggctgcagtgagccgtgattgcgccactgcattcctgcctgggagagggaccctgcctctaaaaaaataaaacaaaagctaccacttctcaagtgtggtgcagtatcaaaaagaatctccacaatgacctgagagactactaacatacaacttcctttttcaactacattcacttcaactgaaacaacactgcaacagatcaactgcagaagtggaacgagaatgagaatccagccgtcttctacaaggaaatgccactcttttggctcattttttagttttttggggaaagttattttcccaaaaagatgttatttatattaacatgtaatgaatgggcttacattttctgaaattctgtcttaatctctaatactcgttaacactgacagctaatgctcacattaaacagcgctctttgaggacctcaataaacatttctgacagtgcaggggtcctgaggctgtgctatttgggaaccgctgccctgggctgacggccccttcctcacatgcagtcacagttgtgttgaccatggagactctgcagaagcagccactggagcagaagggtctcactcgcacttgggagtgcagggtggcatcggacagcaagttagcaaaggtgtcatgaaggaggggtcctgctcccctgtgtgctgaaaggtgagaagtgccccagcaaagggtgggagtggaggggtcggtgagctggggcagtgcaggctggcgagagccctgggggctgtagaaggtgcttggcagtgcactgaagacagtaagtgaggcctgtgggaggacaaaatactcacggtctttctggtggccctcttcatctagataaatgttagtcttcatgttccagatgaactggtgtgccagaagctgggatttagacgctgcccacagaatatactcccgcacatagcccatctgcaggagagcaaggtccctgtcagccaggctcggccctctccatgaggagggccttgtcagcagctgctgactcccggcatttggtagaccaggcaagggtaaggcccggtggctctagtggtgtggacaagctctccaggattgatgttgagtccagccagtggccaggccaagttccagctggctgggggctgggacctggggggcagggttgcaaagcgggcgacagtcagcctttgtctcctctgtgtcttcccatgggtttaagaagcacaactctcaaaccaatttctggagttgtcaagtacgagaaaaagcaggctgggtactaaaaactcacttgtgagctggttgtttagaacaatgttccaaagtgacagacaggttccagaaacatgcagagatacctccttcacaaactgacacactgatatgattaggttttgtgtccccacccaaatgtcatcttgaattgtaatcctcaggtgttgaggaagagacctggtgggaggtgactggatcatggggacggttcccccttgttgatctcatgacagcgaatgagttctcaggagatctgatggttttataaatgtttgacagttcctcctacacacacacttgctctctttcgcttgctgccaggtaagacggacctacttccccttccaccatgattctgtttcctgaggcctccccagccacgtggaactgtgagtcaattaagcctcctttataaattacccagtctcgggaagtttttttgtttgtttgtttgtttttgagacagagtctcggtctgtcacccaggctgtagtgcagtggtacaatctcagctcactgcaacctccacctcccaggttcaagcaattctcttgcctcagcctcccgagtagctgggattacaggcgcacaccaccacatctggctaatttttgtatttttagtagagacagggtttcgccatgttgttcaggctggtcttgaactcctcacctcaggtgatccacccacctcaacctcccaaagtgctggaattacagttatgagccaccgcacctggccaggaagttctttatagcagtgtgaaaatggactaatatacacaactgtggtcaccatcctaaggacctatcctcctcttccttcttggtcattttccgccactcatagtagtaactccagtttttctttttaattaaaaaaattttttttgttcctagagccataagttttgaaactccagttttaattccatgccctaggtttaaaaaggtgagctggcctttctgggcagcctcctggagtctgtggccactgatctggtgaagtgtcccttggatggacatttttgacctgggtgagtcgggggtggtcttaccacacaggcagaagtcttcactttgggtttcccaattctaacccggcaaatggatctaaagacaaactatgaatgttcaatgtgtagtgtttttaaatataagtttgctttttaattatgtaaacactgacagagttccaaagtcaaaattattaaatatggtacatatctgtcagttccatcctgatctctccctctttggccatttttattaacttttgatttactgttcctttttttttttgagacagagtctcgctctgtctcccaggctggagtgcaatctcagctcactgcaagctccgcctcccgggttcacgccattctcctgcctcagcctcccgagtagctgggactacaggtgcccaccaagcctggctaatctttttttgtatttttagtagagacggggtttcaccgtgttagccaggatggtctcgatctcctgacctcgtgatccacccgcctcggcttcccaaagtgctgggattacaagcgtgagccaccgcgcccggcctactgttccctttttttgtaaaagtataaacaaatatgtatatacatttgtattgccatagtgatataaatttttttaaacttaaaaaatattccaggctgggtgtggtggcacacgcctgtaatcccagcattttgggaggccgaggcaggtggatcacctgaggtcaggagtttgacaccagcctgaccaacatggggaaacctcatgtctattaaatacaaaaataggctgggtgtggtggctcacgcccgtaatcccagcactttgggaggccaaggcaggtggatcacctgaggttaggagttcgagaccagcctggcaaacatggtgaaaccctgtctctattaaaaatataaaaattagccaggcgtggtggtacacgcttgtaatcctagctactcgggaggctggggcaggaaaatcacttgaacctgggaggtggaggttgcagtgagccgtgatcgtgccactgcactccagcctgggcaacaaagactctatctcaataaataaataaatatttattatttttttgagacggagtctcactgtatagcccaggctggagagcagtggcatgatcttggctcactgcaagctctgcctcccgggttcatgccattctcctgcctcagcctcccaagtagctgggactacgggctcccgccatcacacctggctaattttttgcatttttagtagagacggggtttcactctgttagccagtatggtctcgatctcctgacctcgtgatccgcccgcctcagcctcccaaagtgctgggattacaggcgtgagccactgcgcctagccattaattaattaaaataattaaccaggtgtggtggcacatgcctgtaatcacagctgcttgggaggctgaggcaggaaaagtgcttgaacctgggaggcagaggttgtagtgagctgagatcacaccattgcactccagcctgggcaacaagagcgaaactctgtctaaaaaaaaaaaaaaattctggctgagcgcagtggctcatgcctgtaatcctagcactatgggatgccaaggcaggtgaatcacctgaggtcaggagttttgagaccagcctggccaacatggtgaaaccctgtctccactaaaaatacaaaaaataagccgggcgtggtggcatgcaccttcaatcccagctacttgggaggctgaggcaggagaactgcttgaatctgggaggcagaggctgcaaggagccgagaatgccactgcactgcagcctgggcaacagagcgagactctgtctaaaacaaaacaaaacgaacaaaaaaaaattccctaaaaatggaaagcaagaaagaaaccagtgaaactagctgagtcctgagttggtacaaccacacacagaagaatcatttcaggcggcctttctctggtagccaccaccaagagttcacacggaggccctgggtactggctcccctccccactgcctctggatctcacccttatgctaggcctgtatgcaagcagagagccaagcagtcaagggaaaataatgtgggaggggagccagggggaaggaaacaggttgctgaagagaaggtgcctcatgacaatcctgtaagttgccaccagtgtgaaggctccggcttggtgagtgtggctccacacatatcaccactcagaggcgcagagagtgtggcactacctagtgagggcagtgaatgattccacaggactcagtctttcagcagaggctggctgctgttctagaagcactttggtctacagactccaaggctagcccctgggacacccagccatgtaactcagccagcccacaggtgggccagagtggtgaggactcagccaggacacatggagtctgctgcccaattcatccagggaaatgaggtcagccctggggttggggaatagggcagacaagctgcactcagacacagggtgcagtgggcaggctggcgcgagggcagaggcggctcgggctcctggctgtggtcattcccatggatattttctgtgccatgacctgtgctgagcactttatgtccatggatactgttacgggctgaactgtgtcccttcaaattcatatgttacaggacctcagaatggtactgtatttggagatagggtctttatagagatgattaaggtaaaatgaggtcaatagggtgggtcctaatctagtatgacaggtgttcttataaggggagattaggacacagacacacacaaaaggatgaccctgtaaggactcagggagaagatggctatcaataagccagggagatgggcacagtggctcaggcctataatcccagcacttttggaggcggaggtgggcagattgcctgagctcaggagtttgagaccagcctgggacaacatagcgaaactccatctctacaaaaaatacaaaaattagctgggcgtggtcgcacacgcctgtcatcccagttacttgggaggggtagcggggaaggtgctgaggtgggaggatagcttgagcccgagaggttgaggctgcagtgagctgagatcacgccactgcactctagcctgagtgacagagcgagaccctgtctcttaaaaaaaaaaaaaaagccagggagacaggcctcagaaggaaacaaccctgttcgaacaatgaccttggacttctggcctccagaattcatgttttttgtttgtttgtttgttttgttttttggcctccacaattctgagaatgagaatagacatttctgtcgtttaagctgcccagtctgtggtgcttcgctatgcagccctggcagactaatgcatatgtcatctcgttaattttcctcaccacttccggctgaagagggcaggattcagggatttgaggggaccccaccgatgagagggaagcctggccaggctgcctagccaggctggcaacagccccagaaccggctcgctccacagagcatgcttgggcctcagggtgaggcagtgggtgaacatgggtatcaagggacaatcacagggcctggggtagggggagcaaggggactgctgggcagccctgcccctgaggaggctctgaggagcctgtgagggctggggacagaccgggcacaagctggtgtggaacacactctgtgagtgaagaggacggccatgcaggtgcaggcttaccttgtcgtacctgagggcctgcacaatctgggggatgtagaagaggatggcgtcctgtggaggtggagcagagttggccatgacttctgagagcagagccacccaaccctacggcccaggccctgcctctgcttctgctctgcccacagcagggctgagaactggggaaagcccagaggatggcaggcaaaatgaccgatggctcagaacacaggaatggaggaaacaggtaaaaggagcaaggctcccgctctacagcgggcgagggcctcgtgctcctcactagggagcctgcctcagggaatggtctgctgtgggtcagactctagaatattccagagacccttctccaccatcatcatggctatctcgtgggctccctgggctcccacaaggagtgagggaccctccacgggtgaggtcactgtggggttccaaggcacagctagctgcactgctgtgtggggtgtgcacagctgccgcgccgcctcgtaatcaaactcaagttaactttatgtctttaactcaaacgcctcactagattaaaaaacaaatgtaactagagaacacatttgaattagaactaaatccatcttctacaactacttgagcaaaaaacagggaaaggaccagtatgtaacggggcgacctcatggccaatggtggggcctgtgcctctcaccaggtaagacccctcccaacagtcctaccagaggccagctcagcagggccctgggctcaccggagggaaggaccgcaggactttcaccccgtactgcgccgtgagagggtgcggcgggtacatgctggagaagtaggagaggcctgtgggtgggtccgtgggcgcccagcacagcacatggctgagctctggagcatcggcgtcgatggtgtgccaggtgaccaggaactgcagagaaggtggggagatgctgtggcttgggcagtcccgggacctctggaaatacctggtccacgggccacacaaggacggccatgagaagtgatgtttctaagcatcggtaaccatggggaagatgcttctgatgtgttatggaaaacaacgtaactgcaattagggtgaagtgcattacatttttttctactgtgaacaaaataaatgctacagacaagaaatagaaaacacaggaaatcagaaaaaccatgaatagcactgaagttgccaagcggctgtttttgtctcatttctagtttcaggcatttctgggtgcagtgtgctattttgtgcagtttgaactcaggccctggtacgtgggctacactaccttgattgcttcaggcacatcactaacggctcccgggtccaaccgaacgagacgggtcacttcgttcccaatggcttctgtgttcttaaacctacagtgcacagagggtatgggtggtgctgcctcgccagggaacctgcactctcccaccacactggagtgaggggagccagggggaaacactgaactggagggattcacatcaataccaagtgacggcttgggtacaaacaaatagaaagaatgaagacctgctatttgatagcacaacagggggactacagccaataataacttaattgtatattgaaaaataactttaaaagagtgtaactggattgtttgtaactccaaggacaaatgcttgaggggatggataccccattctccaagatgtgcttatttcacgttgcatgcctgtatcaaaacatctcatgcacctcataaatacagacatctactacatatgcacagaaatttaaaaaaaaagtttaaataaaaaaatgtttagccaggtgacggctaaatgttctattatgccactaactagtaggtctgaacattagtgttttttaaaaagaggattataatctgctgtgatgaaatgctggaactttcttaaagaaacaggaatttttctacacttaactgtttaaagggcttcctttcaccatccttgtcttaaaacccctgcctcttactccttttcctaccatatcctctcctgactctccacagctgctcatccagtgagtcagtgtctcagtcaacagtccaggggccacaaggcacctggtccatgaaggggcagctactggtttccaggtgttcccacctcaggctaatgcaaggcggatgtcccatgagcactgtgctttgagacaatgcagagctgcgctgcgatcctattccagaggatcaaagtagggctggagagaggatgcagtacattggcaagtctgggctcacaatggagaatcacccaccctggacacattcacaggaggctgtggaccatctggtgggattctaaacagggactctgcagtccctctcagccaccatcggtctgaagttctgtccccataagagctgccacagagagatcacaggaatgtcactgctgtctgcagcatgtgcctcctccaaatactctgccactgaaaggtgacatccaggaacaaacccaaaccctccccaaggcggttccggcagccacctgccaggagtgacagcctccacatgcttcctatccggcaggaatcagatcttggctctgaattcaccctgctgctacctccctaggctccagctgctgcagcaccccaggcaggcatctgaaaagatcacgagggttgctgggttatctctgcacagaagggctcggggagtgtcctggggctcgaggactagactacttcctgactatccttgaaaggggctgcagggcactcctgagaactcatgacccagctggcaagcaccctgcgctggacctctggtgaggcctgtgtcaggctgtggtgcccgggggcccacctggcaggcagctgcacggctaggtagggagagatgctccaggcgaggttcacgttgtccttccactgcttctcactcaggctgatgtacttagatctccagttggccacgctgttctctccggcctggtctagttccagttccggggctgacagcgggttgtaccatgtgatgagacgctcgatctcagtggcctggcaagataagacataaggcctgatatgcaccccttctgtgagtgcccacacactgccccggccaccaggtgtcgtacaggcaggtggcgggcagcaggcacagctgcacctgtgggccttaccagcagggacagcagcagcgtcctgcgcttcatgtagtatttgtgcagctgggagccccggttggttttcttagacatgcctaggaggaaagacaaagcacaggtgtagtcctcagatgctacctgtctgccctgagattctaaacctagaggaagcttgcagtgctctgttctgctgtctgagcaagtgtccatcaagcagcttgcaactagaatgatagcttgcatgtgatggccccagcagcacacctcccaccgacctgatttcttggagatggtggacatgccgctggacagggggtatgtgttgatccagccttgggtggcttgttgccgagagccgacagttatgtccaggttgctccgggtgtcctgattatctgagggcaaacacattgttgattctagagtgaggtggctcaagaaaaggtaccacaaaaaataaactactattcaccagagataaagcaattagtggcagagcaggcattttctggagtcctggaatcgactgcaggaacaaatctgtctggatggtgggttttccaaaagcatgagaagttctttattttaactattctagatggaatgtttaaacatttttattatatttcttttaaccttttcaaaatttatttatttatttacttatttatttttgagatggagtttcgctcctgttgcccagggtggagtgcaatgacgtgatctcagctcactgcaacctccgcctcctgggttcaagtgatcctcctgcctcagcctcccaagtagctgggattacaggtgcctgacaccatgcccagttaatttttgtatttttagtagagacaaggtttcaccacgttggccaggctggtctcaaactcctgacctcaggtgatccacccacctcggcctcccaaagtgctaggattacaggagtgagccactgtgcccagcctatgttttatttttgagaaggagtctcgctgtgttgcccagactggagtgcaatggcgcgatctcagctcactgcaacctctgcctcccgggtttaagcaattctcctgtctcagcctcccgaatagctggactacagacgcccaccaccatgcctggctaatttttgtatttttagtagagatggggtttcaccatattagccaggctggtctcgaactccttacctcaaatgatccacctgccttggcctcccaaagtgctgggattacaggcgtgagtcactacacctggacttcttctagcctttaaaatagaataggctgagcacagtggctcatgcctgtaatcccagcactttgggaggctgaggcaggtggattgctagacgccaggagatcgaggccagcctggacaacaaggcaagacgccctatctctacaacaacaataaaaattagccaggggacctggcatgtgtctgtagtcttagctgcttgtgaggctggggtgggagaattgcttgcacccaggagtttgaggctgcagtgagctatgattacactattgcactctagcctgcgcgacagaatgagactgcatttctaaaaaaaagtagaaaataaaatagaataaaacaaatatcataattttcttgataaaagatggcagttatctgatcaccggcaacgtatagtcctttagtacggtgacaacttgagggcctgtgggggcagactgtaaggactgtttgccctcttctaagtggagccagaaagctgccttagaaagtcactgcatctgcttttttctttccttttcctgctagttaggttgtcagccgtgggtctgctaaagaaaaccatctcagccaggcaatgtggcccacacctgtaatcccagcactttaggaggctgaggcgggcggatcagaaggtctcagccaggcaatgtggcccacacctgtaatcccagcacttcaggaggctgaggcgggcggatcagaaggtcaggagtttgagaccagcctggccaatatggtgaagccctgtctctactaaaaaataaaaaaattggccgggcacggtggctcacgcctgtaatcctagcactttgggaggccgaggtgggcagatcacgaggtcaggaaatcgagaccatcctggctaacacggtgaaaccccatctctactaaaaatacaaaaaattagccaggtgtggtagcgagcgcctgtagtcccagctacttgggaggctgaagcaggagaatggtgtgaacccgggaggcggagcttgcagtgagcggagactgcaccactgcattccagcctgggcgacagagtgagactccgtctcaaaaaataaaaataaaaaaaaaagtctgggcgcggagatcgagaccatcctggctaacacggtgaaaccccgtctctactaaaaaaatacaaaaaattaggcaggcgtggtggcaggcgcctgtagtcccagctactcaggaggctgaggcaggagaatggcacatacccgggaggcagagcttgcagtgagccgagattgtgccactgcactccagcctgggcgacagatcaatactctgtctcaaaaaaataaaattaaattaaattaaaaaataaaaataaataaataaaattaaaaaattagccaggcatggtggtgagcacctgtagttccagctactcaggaggctgaggcaggagaatcgcctgaacccaggaggcagaggttgcagtgagccaagattgcgctactgcactctagcctgggagaacagggcatggcctccttacagaggtttgctgcttctttgcgtggcatgttttcattcggcatacccttccctggaatgctttgccctgtccaccctgcatgccggtgcagccattcagactcagctcaactgtctctcttccagaaaaccatctctgattcctcaactctggatgggccaagtgcctgtccccgaggagtgctcccatagttccctcatattgaaatcacctgtccatttgactgcctcctacaagacaacaacagaccataccccagtcatgtgggtgtgcaccagcctcagcccaatcctgggccgtcagctgctcagaggggtgtgtgaacgcagctggtgccagtgcagggaaagtgcggtgagtggagtctgctcagctgcctcgggtgcgtgtttatgcttctcagctcaggccagaggagaagcagagccaggcatgcaccggcctccaatgaccgtgcaacacagccaaggccagggctcaggggggtctaactgcttttccgtccctacctctggcaccctcggggcagcccacgtggcacccctgtcctgcctgcctccaccatgagcagctgcactgttgagggttacctgggggaacaagctggctggcggtcaggtacttcttatctgagaacatggcggtccaaaatttaatcatgatgcttatgtcttcacgcagccgcttctctccttgagtagggaactttgggggacagcttcaaacaaccataagaggacaagggctgagtgtctggagtcagggactagaggccagtcacacaaagcagtgagaaggtgatgcagacagtttcttaatgacaaaaggtcagcccaaagccagtcattagcaaggatgatctggcccattcccatgggaaggtgtggtggctcgggagccctcttatgccctcctccctcactgcccacagcagcccctacagctttccactgaagctgcacttgtggcagatcagggcaaggaagctgcactcacacaacagcacagcctatgggtgcagagccccaggcagtgggtgtttgcaattcttcgtgcaataagccttcacattaacagggaaattaaatggacgcacttaatctcctaaatcagttgaactgagggaaaatttgcctacatctcgctgggaggctagctctaagtacacgggacacatgcacagggctgaagggtatttaaatccacagggccagggatactgaaggaggaggttggtgagcacaactgggcaactgtgtattcctgtgagtgacttcctgggggtttggggcgatggagcacttggaggggctgcgccgtccctggacgctgcacagcacatcttgggggagtacctgaagtagtcaaaggcagtggagtagatcttctcgcgaagcacattgcggatggttgcatttggaaccacatcggcatgcaggagggacagccccagggtcagcagcctgtgagggagccccggacccagttagagcaggagcctggcctggggccaagttcaccttatggactctcttccctgcccttccaggagcagctcactgaaatgtgttccccgtctacagaagtaccgtgatacacagacgccccatgacacactgtacacaccaggggccctgtgctccccaggaagagggccctcacttgaagcggggcccgatggccgccacgtgccggttcatgctccccttggccccgccgatgttcagggacatggagcgctgcagcaggctggagaagatctccacttggtcagagctgcagtacttggcgatctcaaaccgctgcaccaggaactgagcgaaaagaggaagacgctgtggtggtggggctgagccgggctaaccctggggccggcagagacagctgaggaggggttctgggctgactggccgagcttgccgaaggccttgggctcggctacccccaccccaggaacagtcctggccccccaggtggagcaccccacagccttcgtgggggaacaggcacgtacgtcgatccagatgtagtggggggtcacttcggggggacagggtttgggttgacttgcttccgaggcagccagggggtctgcttcctttatctcagcagaaaacaggccaaatttctgctccaccgtcatgtgccaggcccctgccatctcccgcatgaactacaggtacagaaggaatgttagctcctctgtgaaacacaaaaaggggctactgtcaagttttctctaattaaaaaaaggaacacgtgctcactgaataagatttagaaaccaagaaaagtatgaagaaaaaaatgaagatcgcctatagtcccacatcccagggtcatctgtgtcagtgcttggtgtattttctccagcctctcgaggctgccttctgttcaacccggttcaccgtgtggacattgcaggtgtgaggtggcagcacccgggatgtacctgatgccctgacaggcactgggtaggtgactcttctctataaccctgataaccctctgtggctgtgagcgggaagacccctctgtgggatgctgagctggcaagggcagaagagggttctggatccagagcctggctcctcctctccaccccacacagaccctacctgatgccttcatcccgctaaccagattaggaaaggcccatggagccgaggcgagcctgcagccaccatggccaggcctgggagcccagggtcaggctgctcccatggcccagtcatgctcagccaggtccccattccgtgggggggcatgaggggtgcccagagggagcagcatggtgcccgggagacacctgggtgctgcagagagtaagaggtgcagctcacacatggaaagcccccatgatttctgggtgtttttacaaggagaccaacaaacagcatttggcatctggccaaagaggattctatccctctgttgtcccagcagcaccagcttctacaagggctccaagcgcctgtgcagaggtggcaacgaggcctagtgagtagaacacacaccgcggctccctccccagtaccatcccctcccttcttcctcatgaggtggatcagggtggccacgtggccagtcacagggctctcagccagggtccctgctggctgaggcggccactgttctccccggccactctaatgagccagggagagtgaactgggcaaggccctgggaacacatgccagggtgagcttcataaggtcaaggcagctggcctctgccttttgcactctgtccttgtcttccttcctgctgggaggcacagaagccatctggaggctgtgagggtggagacaaaggccacataagcccaggatggccaggagccgacgggagcccggggcggggctctgtctgctgcttccctctaagctgcccatggggtgaggactcctgggggacgaggcactagagcctgctttctgtttcctgcagaccgattagtcttatggaagcagacaagggagaaaaaaatgggggggaccccagaactgccatggacaagaagccatggaagagacacactcccacctatttgttacacaaccacatcctggtggctgcctctgtgccagggcctcgtggactctgggcatggtgctctgaatgaagacaaacatgaccacacagtctatggtggggaccacagacaacaagaaataagctacacacactgagaaacactaagaaacagcagtgcgagtgagcgtgtgacagaccaggtggccagggagagccctggcaaggaggggatatctgagatgagccctggaggagacgcaggagtgaggcgcaaggcacggccatctgagaagagggaatgcatgacgcggcctatggtgggagcagcccaggagggcagcttcaaaagtgaaactgatgggatgtgctgagaatcatccgtgggaagtgcaagcaggaccccagcatggccacagcacagcaagcaaggggaagagagaggatggaagtcaggtgggaagggggcttgcaggtcacagaaacaagcccaccttcgagtctgtaggggggctctgattcccccctggcttgcgccaaccgcatgtggagaaggggaagatgcctggggttggggagcaggaggccaggccagagggcagcagctgggatgctgggacttgtcagatcctggataaacctcaaaggtgaaggtgatgggatgtgctgagagtcatctgtgggatgtgcataagagggagtcaaagacgtctgagcagacagaaggacctcgctggcatctacagtgaagggaagggccatgctggcatctacagtgaagggagggaccttgctggcatctacagtaaagggagggacctcgctggcatctacagtgaatggagggacctcgctggcatctacagtgaatggagggacctcgctggcatctacagtgaagggaagggtcacactggcatctacagtaaagggagggacctcactggcatctacagtgatgagagggacctcgctgacatctacagtaaagggaggggccacactggcagctacagtaaagggaggggccacactggcatctacagtgaagggaagaaccaccctggcatcaacagtgatggcggatgggcgaccagtgtagcggtgtctggagctgtggttggacccattagttggggctgctaatcagttcaccatgcaggctgtgggccaagccactgaagggatgcacctggactaggagtgactgggctgggtaagcagtggagctggccagagtacccaggcagggaggaggagccctggggcatgccagtactgagaaggccctgagctcaagaaggtccctttattctggaggatgaaagggctacaaaaattacaaaggccttaagtccctgggaaaagcagttaggctcccagaacagctgctttcaagacccagaactctgaaggaggctgtgagcagctttccctaggctgatctgtcctcctaccatctggggcctgctagtgatatctgtactccaactgccctgcccccaggggtcaaccaacccactcctatctgaggacccactcctatctgaggaccagacagggaggccagaagttcaagggcacctggactaaggaagtggagaggagagaggtggatctgggctccagagccccaggtacaatgtgagggctgacacgtggtcaggagcacccccagtgccctatgaaatgggaacggctacagcccctactctttttcttttttttttttttgagacggagtttcgctcttgttgcccaggctggagtgcaatggtgcgatcttggctcaccgcaacctccgcctcctgggttcaagcgattctcctgcctcagcctcctaagtagctgggattacaggcacatgccaccacacctggctaattttgtatatttagtagagacagggtttctccatattggtcaggctggtctcgatctcccgacctcaggtgatccacccgcctcggcctcccaaagtgctgggattacaggcgtgagccactgcgcctggctgagcagcccctactcttaaggcccaccgaggtctgaggctgaagcagcatatggaaaggaatcctgaccatagcagcactgtgtcctgacagtcacaatttgtggtgaaaccagggcttccagaagaccctgagaggagggcacacttgtcctcttctgggaagtggagagtcccaccaagagatagtgtgtaggcaggtgtgtgtaggcaggtgtgtgcaggcaggtgggcacctgggcccacacaggagtgagcgtggctaagacttcccaggatcgggtccctcctgagcccacaggaggacagcctcagggtgtgggggaaactgcaaccatcagcctagaccccaaggcctgggttcaatggacaggagagtaatatacatataatgccctgcttaagttgggcacacagcaggaccagagcaagttatcagttactagtgcagcccacatgcatttattttgggtcatgaattttaagtatcatacaaggatcatgaatctttcccctctcagtgaaatgaaggtcccagacccctgtaaggaggtcaggctccccactgttcccacgctgagatgcgaacagcaagtgtgacatctcttcatctcctgggcactatgggacctggacaggtcaggtccttgtggaggcagagacagggagtgaggacctgaatgaccacgtgctgctggggccagtgccaggtgtgagtgtgagtgggtggagaagcctgacacaggccaagggacctgaggccagctgagccactggagatggtaggagcaggaagtgcaagctggactccaaaagaccccaaatgaaacagtaatttggtttgtataaaaatccctttaagacacctttcccaattttgcttaaaataaaaaaaaaaggaagtggggtaaaaagcaggaagaacccatacttcctgccaagaccagctattgagtaggaggaggagccaccagacataagaaagacatctcggacaggcgcggtggctcacgcctgtaatcccagcacttggggaggccgaggcaggcggatcacaaggtcaggagatcgagaccatcctggctaacaaagtcaggagactcagtcacaaaaaaaaaaaaaaaaaaaagcaactggctgggcgcagtggctcacgcctaaaatcccaacactttgggaggccgaggcgggcggatcacaaggtcaggagatcgagaccatcctggctaacacagtgaaaccccgtctctactaaaaaatacaaaaaattagccgggcgtggtggcaggcgcctgtagtctcagctactcgggaggctgagacaggagaatggcgtgaacccgggaggcggagtgagccaagatcgggccactgcactccagcctgggtgacagagcgagactccatctcaaaaaaaaaaaacaaaaaaaagcaacaacaaaaaaagtcccagctactgggtcaggaggccgaggcagcagaatcacttgagctcaggaatttgacgtcagcctgggcaacatagcaagactgtcttcaggaaaaaaaaaaaaacaaaagaaaaaaaataaagacctccttctctctgggaaaatatacagcagtcctcctcaactgtcagttttatttaaatgtacaatgtccagtatagaaacaaaaactttcaaacattgaagaaaaaagataaaaagaaactgacccaagatgactcaaatacaagaacagaccagataacgatataaaaataattacaataaatatgctcaaagatttataagaaataatggaaagaatgcatgaaggtaagagaatctcagcagcagaaaatgcaaactataaaaaagaattaaatggctgggcgtggtggctcatgcctgtaatcccagcactttgggaggctgaggcaggtgcatcacctgcggtcaggagtccaagaccagcctggccaacatggtgaaaccctgtctgtacaaaaacacaaaaattagccaggcatgatggctggtgcctgtaatcccacttacttgggaggctgaggtgggagaatcacttgaacccacgaggcggaggttgcagtgagccaagattgtgccactgcactcctgcctgggcaacagagtgagaccccatctcaaaaaaaaaaaaaaaaaaaaaaaaagaattaactagaaatcctagatctggaattgtttctttttcttatttttaaattaaatatttattttttgttttgttttctagacctgagaattgtatctgaaataaaaaatatacaagatggttttacagcagaatgaataaagcagaagaaaagaacagtgaactggtatacaggttaaaaaaaaaattaaccaaatgaaagagtgagaaaaaccctgaaaaactgaaaaagactacagagaatgtcgatgatctatgggacaataccaagtcactaatatatgtgtacctggaatccaaaaaggagaagagagagagaatgaagtaaaaaaaaattaaaaaaatattgaccttaagagcctaggaagtaaaaaaaaaaaagaaaaagaaatgacaaagaaatactgacctcaagatttccaagtttgatgaaaatcctaaatccctgaaattaagaagctcaatgaattccaacaggataaatacaatgaaattcacacacagtcaaacaactaaaaatgaaagataaggagaaacatccaacaagtagtcaaaagaaaaacaataacatatacagtcatccttggtatcctcaggagaactggttccaggatgtggaacccatggatatggagggccggctgtactgagaaacaaaaagactgttgacttctctccagaaacaatgcaagctactagacaatagaagataatatctgaaatgctaaaaacaataaaacaaaaaactatcaacctagaatcctgggcctagaaaaaataatccatatgcatcaaagatgaaggtgaactaagatgagagaatttatttccagcagacctgcattactggaactgttaaagaaaattacttggcagaggagatcacaggaagactgtaaaagtgtgagtgatgaaaaacatttggataaattataatgctgtaacaaagccttgtcttaatttctttgaaagacttttgatttttttgaacagaaacaacattataaggtctaatgcatatagtagtaaaatatgaaaacaggacacaaggaattagagggagaaattgggtgtcataatggcagtgggtatccacagtggcaatggtatacagctgtctctgcagaatcctctccctggcaagaactataactgatgtggccactccagttgtcatttactgacagctcactaggatgcaggtgctcttgtaatgatgtccaccatgcaggtgaggagccccgcccaggaatcagagccctgcaggctgaagcgtgacttccacaggcccttctgcatatctttgatgggagcaggctggtcaggctgagaacccagcactcccctgacttcacaggtgtccccctgactagacaacctcccccaggcgcccactggaccaaaatgtttcctaacagcgctcaatggtgtgattgatacaaaccccacgaggttataaaatagcaggcaaatgtgagatattatcatcactgccaccaccaccagcccggaacattttaattacatttttggaaatattccaattttcctgagggaagaagaaaatcaaaatccccctttttgaccactcatttcaactaatcctaagaaatacagaaagaaaacatgtcaaattccctgctaccctgacagttaacagaatctttgaaaaataaaattgttcttaagcgtttatctaatcagctgaaacgtgagtataaacttccttgtgggcaccccctgcagtagcaactccagaaatacggatgcagggaaagggggctgatcccaagattaggtcaagaaaaacattcccgtggacaaacacaactgctcccaatcaaattcaaagttaacaggtgttcaaaaagctggatttccaatttcagtagagaaatggctccccctaccgaggttttgggagataacggcttctaggcaccagtgggatgctgttaacatatattctattttctgtgactgtcaggtataataatagaatctgtaaggagactgaggcttgagaaggtgaggggcttgcccagtgtctccatgcttggtggtggcggcaccagggaaggctcttcccgtctgttatcccatcccatcctcactgccaacccgaggtcagggtcctaccggcacttccactccatccttgccagccagcagccactcccagcaggccagggccgtctccatgccatgctcattgaacatccggaggggaccccagcacagatgatgaaggagctgcgggtcacaatctggaaccaaacacacgtcagtcagaggcctccaacaacagctgaaccccaaaacagcttccctgggccaacaagagttgaccagctggggccagtgatggccttttattgactttccactcatgagagatactcctctactgggggagctcctgctctttctccggccagtactccagctggctatgggtcatcaaggccagcattcatttagaaacgagcccagaattccacagtgcttcagtgagttacctttactgctaatgagcattgcggtcagcttgaacatggcctgcgtgtagtgctgaggatgactgcggtctaaagctgaatgtagatcctggaccatcattttgttcaggtcagacatctggcctgtggtgcctgagaaccgaatcattccatacacctgcaaaaacattctcatcagcaactaagcatataatccaggcaatgtgggtaaggttctggaagccaccagaccacacttgtggtggcactggtgggtgcctcgctgccccaaagtggagctcatgcatgcagagagacaggctcatttcaatgatgctaccactgatcacagctttttttttttttaaagaacagctcctctagaaatgcatgttggcagtgccaccactgcagatgttccccaagggtgggaaccttgtccctcatcattgtacccagcagtgagcccggggtctgacccatggtgggactgcatgaatgtgagctggataaatacatttcctcaaactcaattaatgactcaaacaacaatatcagcctcattattattttttgagagagggagtctcgctctgatgctcaggttggagtgcagtggcgtgatctcgactcagtgcaacctccgcctcctgggttcaagtgatcctcccacctcagcctcccaagtagctggattacaggcatgcgccaccacgcctggctaatttttctattttagtagagacagggtttcaccatgttggccaggctggtcttgaactcctgacctcaaataatccgcccaccttggcctccctaagtgctgggattacaggcgtgagcggccacacccagccctccttactattattaataattttttctttgagacagagtcttgctctgttgcccaggctggagtgcagtggtgcgatcatagttcactgcatcctcgaactcctgggctcaggtgatcctcctgtctcagcctcccaaagtgctgggattactggcgtgagccactgtgcttggccaacctatctatttttaaagacaaatataacttttttttccagagagaagaacatacaagtgacagagtgctaagaaggagtgaactcccactcagaccaggccactgatagactttcagagtcaccagggagcttagaaatggcatagactaggctgggcgcggtggctcacgcctgtaatcccagcagtttgggaggccgaggcgggcagatcatgaggtcaggagatcaagaccgtcctggctaacacagtgaaaccccgtctccactaaaaatacaaaaaattagccgggcgtggtggtgggtgcctgtagtcccagctactcgggaggctgaggcaggagaatggcgtgaacccaggaggcagagcttgcagtgagccaagattgtgccactgcactccagcctgggcaacagaacgagactctgtctcaaaaacaaaaacaaaaacaaacaaacaaaaagaaatggtatagattagcttctgagtttatggagcaggaaatggaggcccacagatgtgatggcactggtgaggctggaataaactgtggtgtggtgggtgaaagcccacgatgtggagttggaagatgtggttccagaccccactccacttgtgcgactttggcaagttacttaatcttgggaacctccgtttatctataaaactggaataataatacatacatcttaccgagtgcccaagagcctatggcatgtaagtgtttgttactgctgtaaaaaaaagccaaaaaaattaaaaaccttcattcagtgtagccaaagtgtacacagagttaccctcttgtggaaaaaacaagtaactggtcattaacactctggaatgtgccaagaatcctcctaaaatgtgctctttaaatcctcctaaaatatgttaattccacatcaccgggacgctttgttcattttccactaggaagcggccaacaggcctcaaaacaagaggacacgttaaaggccctagggcgcaaggacaagagaagcacctcgcccgcgtagcggttgcgcagattcagggatgccatgaagttggagtagtctttcttcacacaggccgggcgctcgctcagctgagttgcctacagacagataaccattattgtagactatggcagcactatcctttcctcgtgtttaccatggctaagcctaaacccaatgaagcagtcacactcgggtctgggggttactattaataaaaatcttcactgctggcaagttaataaagcaaaatattttagaatacccagcagtttgatatgttccataagaaattaaaaaaaaaagtctctggaaggcagtttctgctactggtaaataggcctttgcaagaaaaagaatcactagattgtgagagcaatgtcacctgtgatggaaacgccatgaaagcattcacagccgtctccttgagagttgcgtgtgcagcttataaatgtcacttacagaccgtaaaggggctgaaggggagagccaaggccagcaggctcttaaacatctgctggctgctcttcagtctaatgggaagagacagaaaagggtacaccttgaatacaaaggcaacccacagaatgggagaaaaatatttgaaaactaccgcccacccactccacccctccagccactctctctgcttcagcctcagcctcccagccccagggcctcagtgacctggcttcctaacccaggctggctgctgtgccacacctttcagttcctgttcatccacggtcactgcagagtacagcatgcattgaaaaggacctcctttcgcatttccctttagcatcagtactaatggggaaagtgagcttctcaactgttttgagtttagagggatttttttttgaggggacatggtgtggagaaagaggaccaggagaagaaaatacagatgttggggaacatcaaaatataaacaagaacaaaaatacatgatttctctcatgaaattattaaactggtttatttaaaaaaataaattacgtgaaactgctttacattttctggaaacaatgcggtctttggcaccaagcaggactgagttagagcttggctctgatactaatcagctgtgagaccttgggaagtcaatgtctctgagcctcaatgtgctcatctgtaaagtgggcataaccctctcacaatgttgttacacgttcaacgtaatgacacacacaatgtcctggcatggcaaacagcacctggtgggcagtgcaggccggctccctcccttccaccatcactcctcactgcccaatgcgatctcggctcactgcagcctccacctccctggttcaagtgattctcctgcctcagcctcccgagtagctgggattacaggtgcatgtcaccacgcctggctaatttttgtatttttactagagatggggtttcatcaaaaaaaaaaaaaaaaaaaagaatttttttttttttttttttgagatggagtcttgctctgttgcccaggctggagtgcagtggcgggatctcggctcactgcaagctccgcctcccgggttcacaccattctcctgcctcagcctcccaagtagctgggactacaggcgcctgccaccatgcccggctaattttttgtatttttagtagagacggggtttcaccgtgttggccaggatggtctcgatccactgacctcgtgatccgcccgccttggcctcccaaagtgctgggattacaggcatgagccaccgtgcctggccccagaattaatttttaaaaattaaaaaaaataacttagagaaaacctaacttacatcaaattttctggggaaaaagaacaaaatattttaggcaaaacagatctttcacaagtcagctggctagagtctagaaaaggcttacaaatgagaacacatattctattttatgtaataaagctttgctcctaccacccccaaaaaggaaaaggcttatgactatcataaacacttacagtctatgagttccgcctctggcctctgtggccacccagtggcagagacgtccaggtcagggcactgatacctggtgccccgtcagagtaggaggcccagggcgggtggccctgcaggtgcaggctggacccagctcaaccatgtctgctagactggtgtctttagagatagtgcagtgacctcgaggagagtgccctgatagcaaaatgaggcgagaagacaccagcattctctggcacatcctcaggccccacaaaagccagagggcactcaggcccctctctcccgccggtatcccaagggaggcctgtcacccttcctcctgggtacacagcctctgcacctccacatatcccatcccatgctccatttggagagagttgggaagcacacatggccaggctctagattcacattaaccaacaaaatctctgaccagccccagtcacatggccaggtggaactgcctgctttaatcctttttaactcttagctctaatttaactcagaaagtattgctgtgtgaaccctctgtcctctagattaatctctagcagaacaagaagctgaaggcattcatgtgcggttcagcacctgcagaaaacagaactgttcaggagtccagtatacgctccagataagtgcaactgtggcatcgcgctgcccgtgtcaggcggagctctgtttccatcctctcagatggggacattcaaatcaaaatctgatcactgacatatcaagcactgatccccataaatccataaatttaaaaaaaaaaaagcacaataaggaaacactcatttcaatggccacctcttctttgggccaaggtgcggcttgcaccactaccattgtcaacagacatccacagcaccctgcatgtactcatgtgcgtcatgaaaagcgacagccgagctctaagccttcccctgcactgtggctcctatggtctaaggggtcactgctcttcagaaggctcgcacataccccaagagttgtgttctgcttgttgtagccagcaaagtgaaggatgctctcagtggccatggccagccccgtgtgctgggacagtcccgatacccagttctgatgtttgttcagatattcctgaaataggaaaaacacatggggtttcagttatttatctgatttttttagaggcagggtctcgctctgtcacccaggctggagtgtggtggcacgatcatggctcattgcagcctcgacctcttagactcaagccatcctcccgcctcagcttcccaagtagctgggactataggggcacgccactatgcctggctaattttgcaattttttttgtagagatggtgtctcactatattgctcaggttggcttgaattcctgggctcaagtgatcctcccgcctcagcatcccaaaatgtcaggattacaggcatgagccactgtgcctggccttgctatttcatttaaaggggaaaataaaactttataaattaaggtgtgggcaaatggaccaaacactgggtttctgtcctgggtctgcccctccctaactagctgtgggactgtcagtaagtcaaagcccctctatgaccagctactgctcatttgactgaggacaaggccaattccccgagcggctgtcatgcagtcactgcggtgttgcaccgtcaatgggagagggccatttattctttcagcacatccttgctgagcatctgctgtggtagccaccaggcaaataagctacaaagccttggccttgcggtcaacaggcaggctgtgtggtgtggagcctcggttctctactgcagcataccagcagcctggtgtgggtgaactggacagcaggaacgaagaacaacacctgtgtccacctggccacccagtgggagaagggtgctgggcaatgggatacctggcagagcccaggggtgtgagggaggcctcctgctctggggaccacagggggctcagcctgcaggagtaccaaggacaagggtctcgagggtgggggcaagcctggaacagatgcaggccctgtttacaggcgtgaaccaactaattcccttaagaagaaatgtacaggagtatatacatgcagaattgtctcaatggttttgggggactcctggagctccagaaacccatccttggacactatgacgatgaagagtgactaataatcaagtttaaaagggaagtacactgaccagataccctattaaaaccagactactctggtgggtggaggagagggcagattcggggaaggctgaggctgggcacggagggtggggaataagcacactgcaggggaagtgaaagggcaggcctggggcacgccaaggggacacctggtggaaaaatcaagaccgcttcaagccttttcattttccatttccttcttaggccagacctgcgtgagaaagtaaaaagctctatcagctgctttttttgtccacttaaactttctaggcattagagggggcctcccctcttcagacgacagacagccttgggacctgaggcccttttgctgtaaatgaacaaagggaaatagtttcttgccactgcgtttccacacagctctcagggctcttggagctggctgctctatccttcctggactccacaaccagaaacacttttgagcctgtttcatctttaaagtgctgccagggtaaacctcacaagagttcctctcagcacacccactctctgctaacacagattccttccagaggtatttttctcatctttgattccttttaaggcaattctttcctctcacaccctgtggcattacatggtttacttcgtggccatctgagtttccaaaccagtgtttttgtctgaaagactcccatgcacctacatgtgcagcttatgtggagctttaatgggacacaagtccccaactctgcctctgctccaccagccttggtcaggcccctgcctttgggcacaggtgccagcaatgcacttggcacttagagatgctgccatctggcagcctcccacatccaccacacaagcccttcctctcgtgagcagcccccaagtcttgccacagacctggcacctcacctggtgtgagccgtcagatgccctccttgtgccctggccagcactggccccacaggcgctcctaacacacagagcagcctctgaggcatctattattctcaggccctagactgatgcttccagtctccattcacactagtgctatttggattttgagttcttcatgtctctgtaaagcttttttgggagtttgaaggagcttatggcaattgccttttgatggtttcaagtacctgcaggtgggacttggtgacggtaggtgcccacttcatggcctcctggaggatcatcccacagcgtgcagcgaagtccttcacaatgctctggaagagggtgaagctgcttctcaacaacccgaggtcagttcatctgagctgccgtagtgactgtcatgggctgaactatgtctccccaaatccctatgctgcgccttaactggtaccagtacctcagagtggaactcatttggagatagggctttaaagaggtgattcaattaaaaggctgatagggtaggtcctgatccaatctggccagtatccttccttacgtgtgtgcagaggaaatctggacacacagaaatactggggcagggaggagggtgtgcacagagggaagaacacgtaaagacacagggagaaggctgccattcacaagccaaggagagaggtctccacagaaaccagctctgccaacactttgattttacacttcggccctcagaactgtaagacaatcaatgtctgtcaagacctttcaagctgcccagtctattgtcttttgctacagaagcccaagagactagcacagccactaagtttgaacctcaaggcccctggggccaggaagcccacacacactatgatctgtatgtaattcctgcacaaggtttgtggcagaatctacaagaataacatgtcacagggacactgtgcaacttgtgtcctgggtctgggactggatggaagggcaggctctgcgtggcaaaatcctcttcggtgccacaccactctgtgggaaactccccattgacagctggtctggcagaggtccagaggtaggacatgactcagcccaggctgaaggagctgtgagctgagttgcagtcttgccacagtgagggctctgagaccgagttggggagaggagagacccagtacatcctcctcttttggagtgatttattctgccagtttccccattggatagcacaagtcaaaggcatgatcccctattaccacaataacaaaatgtcagtgcacctcagagaagtgaagtccacctgaaaatcatgcttgtgcgacgcagactcgagaggctataaactggctggtagctgaagacctctttggcagctaaaccgagaacacagctgagtcaacatggctgaggtgggggagctgggcttggaagacagagcgacctgggggcagccagctccccttgcactcggtggagcctggcaatggcttggtctcctcactgggggatggggccagcaccacccacacctcaaattgctggggactgggtgagctcatgcaggttgaccatctcgtggaaatactcagggaattgtggtaaagatggcccttagtgcaggggatcgtgtcgggcctacctcacgggcttcgtacgtgtcaggaaccgtgatccggtagggggcgtcggggatgtcatagtaaggctgatccttgtgaatatcctgcaagcacagcaagactccctcttccaaactgccttccccaagttgccactagcaaccacatgggccacccctacccaccacctgtctgtctgtgacaggcctccatacttgatgcaacttattgcaaaacaccaggtggatttgggccccctcacccccaactcgacacctgtagcattaattatgttcaggcttattgtcagagaagcatgccacaacacagggcggacagggccggcggggtggtggtagagcgggtggtgtttgggccctaggtctcctggggacactcacagcgctcagtgacagtgacagggtctgcaggatgtccagcatggtcttcagcacagtcccgctccagagcaagtggggaaacctgcaccaagagccagctctcaggaccaagagccaaacctccaaggaaggtctgcttctaggagccccctcagctgccagcccgagcccatatctgcttcaggccagctgaaggaggaggtcgggaggcccttgcagcaggatgcctggcctcctcaggctcattgcagtaaggtgagcaacgcctggtcagaaaggctccccaggcccctgccagccccacttcttagggccagacaaacctgacaccaactgccttggttatgcactggccaggacacccctcactttccaaagcaatcctcttagtttctgaccagggttctccattatttctcacataatggagaaaacaacagtatctacctgacaccctggggtaagacaggccatgggctccgatggccccagggctgaaggagaggtgtctctgcacagctgtgacccaccagtggcccactgctcaggaagcccagctcagacacacgccacgtgtgtgctggactcgttctcgtgacccctggctggctcctgaccacctgtggtggcgctgctgcctggaccaggcacacagtatctgcaacaggctccagaaccactggatacctctggggagctgcaggcagcctccatgtgggtgttttgctgcctctggccttctcaccttggagaagctggtccagcccacctgtgagagttctcatcagtgtggggacatgtcccaacagggtctgttttggctcccagaacaaagagtatacagcacagaagggtctgtgtgggcttttgttcctgagaagcccaaagatactgatcctaccaggggacctctggctgggccctgggctagaagatggtgcaccaggtcatgccagagtgggtgggactgagagacacagggatgtggcacccagcaaatgtgctgtaagtaacatcgatagctcagaatgaacagaagtttctgcaccaaaattcagactctgcaggaaactcacagacattggagggaggctgcatcacccttaggagttttcattctgactccattttttcctagattaataatataaggatgatttttcccagcatttgaaatcacagaagtttatatacatacacacaaaacattagcaggaaaatgagcttacttatccaccagaccagatagatacttgtctgccaccctccttatcctcttgtggatgtggttgaagttcaccaacaggaactgagcgtgccgctccagctcctcctcgttctccttggtcttggcctagagatgcaaaagaaacaggtaccgcagtgccccagatgcctccagcagacagacacgcattcatgctggagaggcttactttatccgccatcatgttcaggaaggcatcgaatactttgtccgcgactgcaatcacacactgcatcatccctgaaacgagaaggtttccatggataaggtgcagcaacagagagagaatcctagcaactttcaatcattttcttttgaaatgattttagacttacagagagtggcaaagacagcacagagctcccatatacccttcacctagcttccctggattttaacatctgcagtaaccaggctgatgtgtcaaaactgagtcagatattgatataatcctattacctaaacttcagacttcgtctggatttcccaggtctcccacacatgccccgcttctgttccagcatccaacccaggacaccaggtggcatttaatctgtgtctcctactcctgtccaatatgtggtgactcctcagtctgtcaatgtcttttgtgactttgacacttttgaagaacagttattttgttgaatgtcccctaatttaggtttgtctgatgcttgtccatgataagactagggttacaggatttgagggagaactccatagagtggatgtgccctttcttttttctttctcttttttttgagattgaatctcgttctgttgcccaggctggagtgtggtggcgcgatcttggctcactgcaacctccgcctcctgggttcacgccattctcctgcctcagcctcctgagcagctgagactacaggtgcccaccaccacgcccggctaattttttgtatttttagtagagacagggtttcaccacgttggccaggatggtcttgatctcctgacatcgtgatccgcccgcctcggcctcccaaagtgctgggattacaggcgtgagccaccgtgtccggcctggatgtgctctttctgcatcacgtaagtggtatgtgataacagtatctcttattactggtgaagctaaccttgatcccttggtttgagttaccgtttttccctttttctattttttttgagacagggtctcactttgttgcccagtctggagtgcaatggtgagatcatagctcagctgcaaccttgatctcccaggctcaagggatcctcccacctcagcctccctggtggctgggattacagatgtacaacaccatgctcagctaattgattattttttgtagagactgggagtctcactatgtagcccaggctggtcttgaactcctgggtcaagcaatccttctgcctcggcctcctaaagtgctaggattacaggcgtgagccactatgcccagtccctttctctattctttagaagcaagtcactaaggacagcccacactcagagccaaggaattaaatgctacctcctgaaggaaatttgtgaatgagaattacagccaccacagcgattgatattttggggaagatactttgaagttatgcagagatcatgtcttttaagattttgccccttcactttggcatccacgagtgaattctgcctgcagtagttactgtggttgtcataggaattttctatttccctcaattctttctactttttaaaaaatgttggccaggcatggtggctcacgcccataatcccagcactttgagaggccgaggtgggtggatcacgaggtcaggagttcgagaccagcctggccaacatggtgaaaccccatctttactaaaaatacaaaaattagccaggcatggtagcgtgccactgtaatcccagctacttgggaggctgaggcaggagaatcgcttgaccccaggagacagaggttgcagtgagctgagatcatgccactgcactccagcctgggtgacagagcgagactccatctcaaacaaaacaaaaatttattttttagggacagggtatcgctttgttgcctaggctggtcttgaactcctgggctcaagcaatcctcctgccttggcctcccaaaatgctaggattacaggcatgagccaccgtgcccagcctcttctatttttattaatagtaactggaattctgtaaggaaggttcagcctttttccccattttttatttattcggtagtctaatcattacagaaccgtggatgtttattcgttgggttataatccaataccatttattctattcaaatcattccagctttggccactcggagctctttcaggttggctcctgtgtcattcggacaggccccatgtcttgtcttttcttcttctttcttggcgtgtccttactttctggtgtaacaaggtgccccaggctcatcctgtacaggcctccctagaatcaaccatttctccatggagccctggttccttttattggagaatactatttagaaaccaagatctgagcaccggatatgctcattgttacagaggtgccaagtaggctgtaaaaggcaacagaatgggctgggcacagtggctcatgcctgtaatcccagcattttgggaggctgaggcgggtggatcacttgaggtcaggagtttgagaccagcctggccaacatggtgaaaccccgtctctactaaaaatacaaaaattagctgggcacggtggtgcacacctgttaattccagctacttgggaggctggggcatgagaatcacttgagcctgggaggtagaggttgcagggagctgagattgtgccactgcactctaggctgggtgacagagcgacacactgtcacataaaaaaaaaaaaaagaaaagaaaaagaaaaaaagcaacagaacacagtgatcatcacagtgcagatgaagaaactgtaataaaatgccaattcacactccataatgctgtttctctatccagtgtttttaatttgcatgactacatgctgggtctgccctctgcctccaggcagagagacaaggcaggtgctatcagcttggcacctcacacccagcatgaagcctgagacataaagaggcctttcatagctatctgttataagggtaagtgggaccgcagcaatttgaaaagttatcagtgtgacctggacagatgctcaagggtagtgagaggctgctttcttaagaggctgggttgggtgggtgaaatcttattttgggccatgtgtttagtataatagcttttttttttttttttaattttttgagacagagtttcgctcatcgcccaggctggagcgcagtggtgcgatctcagctcactgcaacctccgacgggttgcattcccagattcaagcaattctcctgtctcagcctcccgagtaggtgggattacaggcatgcgccaccatgcagggctaattttgtattttcagtagagatggggtttctccgtgttggtcaggctggtctcaaactcctgatctcaaatgatccacccgccttggcctcccaaagtgctgggattacaggcgtgagccaccacacctggcctagtataatagttttttcatatagttctttggaaactgaaactgtaaattcctgataatcagatagacatcagatgccaatcaatgtcatgtagtagcatctaaggagattaaaaaaaattttttttttgagacgtagtcttgctctgttgcccaggctggagcgcagtggtgtgatcttggctcactccaacctctgcctcccaggttcaagtgattctcctgcctcagcttcccaagtagctgggattacagtcacctgccatcacacccagctaatttttgtatttttagtagagatgggtttcatcatgttggccaggctggtctcaaactcctgacctcaagtgatctgcccacctcggctcccaaagtgctgagattacaggtgtgagctaccacacccggccctaaggtaagtaagatttttactttaaaaaggccactctcctcttaaccccttagtttagctctggattactggtgaactgactcacaggatggtgggcaggtgagcagcaggctcctgccctcacgttcctgtgcagctgagaacataacagaggctcatcttatacctgcagagaggaggcagaagtccccactttagtggggctgctagatatttcatataccctctcctcctggtaggttctgaaaattcaagaataatatatgtctccaaagacatttccttcttatctttcatgttttagaggaaaaatataagagggatatacactcaatagctgtacatttactggctaagtgccacgctcagaacaaaaataatcagtttgaaaccatgtggaagagtacaatgtactgcaaaaatgaaaatcgctttattttgaattaaggtgaggaggaacaatcagtcccccggaacaatttaacgtcctctgatgtcacaggaacagaaaaacagagctcagagagaagggcgaatgagacatctcacttcagaaagggatctgattcggtttatgaatattctctagaaggctggcaaaatctgctaggttctccttcctttttttttttgagatggagtttcactctgtctcccaggctggagtgtgtggtgtgatctcagctcactgcaacctctgcctcccaggttcaagtgattctcctgccttggcctcccaagtagccaggactacaggcacacgccaccgcacctggctaatttttgtatttttagtagagatggggtttcatcatgttggccaggctggtctcgaactcctgacatcaagtgatccacccacttcagcctcccagagtgctgggattacaggcgtgagctaccgcacccagcctttttcttcctttttttgtctcctcaggtcttgtctgaataatgtgctaggtgcttaattcttctagaggttggcagtttcaattttgttgttgcttagtctctctcctagaaccaaagaatcgcagggtgggccaattgtctagcacaagcttttccaatctgcagtccacacacagcccaggatggctttcaatgtggcccaacacaaatttgtaaacttaaacattatgagattctgggccgggcgcagtggctcatgcctgtaatccctgcactttgggaggccgaggcgggcggatcacgaggtcaggagatcgagaccattctggctaacacagtgaaaccccgtctctactaaaaatacaaaaaattagccaggcgtggtggtgggcgcctgtagtcccagctacttgggaggctgaggcaggagaatggcatgaacctgggaggcggagcttgcagtcagctgagatcgttccactgcactccagcttgggcaacagagcaagactctgtctcaaaaaaaaaaaaaaaaaaaaaaaaacatgagattctgtgtcttaaatgtcttaaaatattataagattttttgtgtgtgatttttctttcttttcttttttttttttttttttgctcattagctatcgttagtgttagtatgttttatgtgtggcccaagacaattctttttcttccaatgtggctcaaggaagccaaaaaattggacacccctggtctagcacaaaacttagcacaaaatctgctactacatggacaaatgcaaggtggacggatgaggggaacagatcaatgaacagttcagccagagcttgacagcatctctcttatagccccaactggtcctggggcatgtgtgtgagactctctgaatgtggcccccaccccgccctgtgtctacatcccctctggaagaggcttctctgtagaaactgcctgcctgcacctcccatccctggcctcaaatgggctccttgctcactccaatcccctccttactgccagaagggggagcttccagaaccctcacagtctttccttgccaactccactggctcccagctgcaaaaataaattcatgcacctgacttcctgactgttgtacagcagtgtgaagtgctccacaaaggacttactagaagagtcttacctgaagcagtatctcagagcccctggggcatttttttgtttgtttgttttttaagagacagggtcttgctccgtcacctaggctggagtgcagtggtgcgatcctggctcacttcaaccttgaactgggctcaagggatccccctgcctcagcccccagactagctaggacgacaggcatgttccaccatgcccagctaattatattttttgtacagatggggtattgctatgtagcccaggctggtcttaaactcctggcctcaagtaatccacttgggttggcctcccaaagtattgggattacaggcgtaagccactgcacctggcctggggtgatttttaaaaaacatttcttgaagcgttgatttttctttttcttttcttttctttttttttttttttttttttgagacagagtctctctgtcacccaggatggagtgctgaggcacgatctcggctcacctcaacctccgtctcccaggttcaagcaattctcctgcctcagcctccccagcagctgggactacaggcgtgcaccaccacgctcggcttatttatttatttttgagacagagtctcactctgtcaccaaggctggagtacagttgcgtgaactccactcactgcaagctccacctcccgggttcatgccattctcctgtctcagcctcccgagtagctgggactacaggcgcaggccaccacgcccggctaattttttgtatttttagtagagacagggtttcaccgtgttagccaggacggtcttgatctcctgaccttgtgatctgcctgcctcggcctctcaaagtgctgggattacaagtgtgagtcaccgcacccagccaatttttttatttttagtagagacggggtttcaccatgttggccaggctggtctcaaactcctgacctcaggtgatctacctgcctcagcttcccaaagtgctgggattacagctgtgagccactgtgcccagcctgatttttcaacaaaagaaaaaatggtacaagaagtatcggaaataatttctccataagcaagaacaagttgatagattcaccaacctatcaaaggcttctggtgcggaaaggactacacactgttagttgtacttcattaatactaaatttgtcaatctcaagaatttatcaataagcatgcctcaaagaatttattcatacagttaatcaaaatttgtggattctccccaattcccttgcatatttaaacatgatttcatcataattacaaaaattatcaaattattctaagcatttaattaaaacttaggtctaacatttcagcatattttaaatttttgattttaaacaccttataaatcagacttcttagtgcccttacactaaaactggccaaaaagtgcttatacgcagcatttaactttttcctttgttgtctctattttaatatctttttattggctaaatacacttttgtaaaactaatattagccttttgcaatttaaaaaaattaaggtataatttgcatataataaaatccacaggtcttatgtgctcaattccatgacttaacaactgtacacactcacgggaccactacccaaacaatctagaggacacttccatcaatccagagggtctcctggtaaccttcccagtttccatctctcctttttattcttatcttagctttgtcttcatagggttttgatcattgtaacatttttatgccttcctacagtttccaccatttctctgtcttcccaggagttggtctcctgggctagggctggtaacagctgaggccctctgtgcactcagggtctgacgacaagttgcatctggaagcaagtggcatgatcatagctcactgcaatcttgaactcctgggctcaagcgatcctcccactcagcctcccaagtaacttgggactacaggcacaaactactgtttcctgctcctgacgtttaaaaaccatgactgctctctggcaacagcaagttgctgcaggtccatcagtgcccatccgaggagccctggtccctctagatgagtgctggagcacacttgagcatagatagtgggctagaatgaccatccttctgttcggggcccttgcaccagcagtagaaccattaaggcgtatatttgaaggctatatgttttatactgatctttctcatgcaatatttaacttcataaaacattttctacatgtagacagaaaagaggaagtagtacgcctttttaccctattaaagctcaattcatcatgaaagcaccataataatgagcttaccagatttgtctttctgaatagctttatcctcaaagtagcagaacattacctggaagcgatcaggatctgttgaacgcagtaccctaagaagaaaacagctttaaataaattttgaaaaatctgggccctccctatcacagatttgacactgcccataagtggtaaggatgtgaagaacatttgccctctgtcattcataagggtgcacactgaggtggactttttggagggtgaggtgcaccatctattatacattcccatatttttcactccagcagccccaccattaggatatatcttcagggttacatgcacaaggattctcctaacagcactgactgcattatccaaaatggaaagactctgaatgctcaccaacaggagactgggcagataagccaaagcatacccattcgatgacacatcatgcagccaccaaacgagaggcagctctctatgtgagctgttacaaaaaaagtctgagacatactattaacagaaaaaaggaaggtgcagggaacacatgtccagcatgaccccacttacaggtttcctaaaggtctgtctttgcatgtgtatgtgtaggctatgcatgcttgcctatgcacagaaaatttctagaggaaaattaagaggccattaacagtaggatagtagaaatgaagtattcacgtctacaaaagtgatacctgtattttttcatctttagtatcttctgtactattccagtgttttctcttctcttttttgttttatgcactctgtacatttttcttttatggtaaaaaaaatatctttaacctcagggggaaagggagaaaaaggaaaaagcgcatgcacttgtcccatgggtgctgtgaagggctgttcagagttccaggggctccactaaggcagcagcggctcggcaggccatgtcttttggcctctgcaccaacctgtcaagagttaagcctcaggagggcaggccaggtgactttcagcacacgcattcgagtgtgcacgtgcacacacctttaacttgatttcccaaattctccactttgtggttttaaagctctctcaatacccagtggctgggaacctgagccaggttcctgaataaaggctttgaggttgcctctctatgctaacagagtgctctcaagggcctggtaggcagcccgaggtggaaggtgggctcacaggagctgctatgggctgcgtcttagagtcttcctctgccagttaagagcccgtcctgagaacctgagaaaactactcaggggcatactcatgggaaaggcagaggtagctctgccttcaaaccacatgaggttgagagggtctggagatacctcttctagccgtacatgctgggatgaaagccatgtttttgctctgtttgggtctggcttgttttgttttggctgttttttctttgaaaatacattgtttagaaaaaagactacaaacagctatactaacaggctataggggatgacagtgaggtcagtgttttttctctctctacttattttgcaagattttgtataaatgttttgtttttataagacagggtcttttgcccaggctagagtgcagtggtttgatcatagctcactgcagcctcaacctcctaggcttaagcaacccccttgcctcagtctcctgagtagctgggactacaggcatgtgccaccacaactggctaggtttttttgcttttttttttggggggggggggggttagagacaagttcttgctctgttgcagaagctcaaaacttccgggctcaagtgatcctcccacccctcaaaatgctgggattagccatttgtttttttgagacagagtctcactctgtcgcccaggctgcagtgcagtggcaccatcttggctcactgcaacctccacctcctgggtcaagcaattctcctgcctcagcctcctcagtagctgggactacaggcatgcaccaccacatccagctaatttttatatttttagtagagacggggtttcaccatgttggtcagactggtctcgaactcctgacctcaggatctgcctgcctcggcctcccaaagtgttgggatgacaggagtgagccactgcaaccggccgtgcctagccatttttgtgcaatgttctttttttctttttttttttttgagacggagtctcgctctgtcgcccaggctggagtgcagtggcgcgatctcagctcactacaagctccacctcctgggttcatgccattctcctgcctcagcctcctgagtagctgggactataggcacccgccaccacatctggctaatttttgtatttttagtagagatggggtttcaccacgttggccaggctggtctcgaactactggcctcaggtgatccactcgccttggcctcctaaagtgctggggttacaggtgtgagccaccacatccagccaaaataaaagacacttacaatgaaaaaagaacaaagtcaacactcccttggctctgtgggacttggggagaatgcgtcactgatttccacatttggctgtgtgtggagccccgggctgagggcagggaggaggagactgagcaggagggtagggtgcattcccatgcaaccaaagcactctgcctttcttttatgtattgagctttcaaggactattttactagagggttggtggcaacaatgaaaggctaaaatagtgttttccaaatagcctttctctcaggaacactttctttttcaaatcatttgggaaagaaattattctacgacttatttgcatccctcccgacttaagctgagtgtaatttgaccttttcttgacaacaggaatcatcattttgtagccaatgtactcagctgctgtcccagggcgcctgaggcctcagcacagtgggtctgtatagcactgcctacctcacaagcatgtcggggagtgcgtaaacatgtgtaatgcagcacagtacctggtacagcacagacactcaatccaagcttacttctgaggtcaacatgataacagctgtagatcctaagtgtcactaccactgttaggactgctgtggccacagatgtgtcctgagcatcgggccacatgcaggactgttttggagccggccccaccccatgtcgcatttgctgtttgtactcaaccatggtcctgggaaacagctcagtgagtgtcctagacacgcactcagcgaggctgggtcctcagaagggcctcgctcagtccgtgggctgagttcacaacactgactgcaactgctcagaagcctgtttcctatcagagagaagatgatgcggagcttagatactgggaggtgttactatacgtggtgtctggtggtcatgaaggaggggcatacgagaaaagtagagggtgtttttgcttggtttttcagaaagtttgcatgtcttgggagaagttgaaaaaagtctcatgcttacgagggcacaaaaatgaaaaccctgctcaaatgtggatgtgcatgtgcatggtggtgaaggcacgtgtacctcatgtactccagccggtacacagagaggaggtaggtggacatggcgaagtccagcttgttgatgagtgcggacacctcgggaggggggtccagcaggttgatgatagtgctgcggagctcactcagctcagcctggagggagagaaacatccgagggctcatggggcatcccccaggacaaacaggtcccagtggctggcaacatgtgttaataatgacagtgaaaagatctgccctaattggcacagagagcatggtaaaaatgagatgtgaatccttacgggggtgaccgtgtcattcttcatggctgagttatactggaggacggaccgcagtggctccttgctgggaaaggtgagcaagggggacttagtggctatttcacagaccccctcgtaccattcttctggccagagtcctgcaataaagtgaacataaatgaggaaatcaccttggtcggaaagcactgcagtgaggttgactgacaatttctatagtcatgggtcctttgagacaattatcccaaaaactaggcacagaaacgaagtctgttacctgacttggacagacttttcctaaggtgtatggcattctcagcaccctaaactacatctggggacagtaacacttgctaatacttgcagaaagaagcagctgcatgtggactcatttaaacatgctcacattcataattacgtgggctctgacctcacctttaccttcactctgcactccgtcttcactgggagagagatgatccccctacctgagccctccacagcgaatcccatcagaacggaatacagccagaagtctcggaagagcttctgtaaccgaggcttagcttctttgatgggtggcagtcgtcgggtgagctgatgtgccaagaagagagggagaaaggaggttatttgctgaggaaaccctaagccctgtaggtgtaaaatcaaccacagattcattctctaagagcattctcagaaactcagactgggtaggaaaaggcacactgagcagtgatgattctgccaataagcattgtccatccactcatttactgagtccctagtgtgcaccaggtgctgtgccagggaggaaaaagccctgttcctgcacttgaaggacttcctgtctagtttggaggcaggtgagcaacagttacagtggggtggagttcccagagaaagtgtcatgggtctcagagttaacatttgaggaaaacttagccaggaaagaagagaaggcagcctgtccagccacaagagcattaggtcctaagcctggcactgtggagggtaacaaatgctcaggaaaggcaaacaatggatgcgagccagagcttgaggaagggatgccactggggaggcagggagagcacaagaactctcatgggccaggcagcacaaattttccaaacagtaatcttcggcagaatccccatatatgtaacaggtaaagcagagttgcttgggtgcaggtgaggggctattgtccttgtgttcctgctccaaatgctggggggaggcagggagagactcatcagtggtataaatggctaaacttggccaagcacggtggctcacgcctgtaatcccaacactttgggaggccgaggtgggcagatcacctgaggtcaggagttcaagaccagcctggccaacatggtgaaaccccatctctactaaaaatacaaaaaattagctgggcgtggtggcaggcacctgtaatcccagctactcgggagattgaggcaggagaactgcttgaacccaggagacagaggttgcagtgagccaagatcgcaccattgcactccagcctgggcaacaagggcgaaactccatctcaaaaaaccaaaaggtttaacttgtgcacgatgcccagctggacaggctgatccttacggaccccccagtggatgttgagctcccatcagtgatgttgagcctgtggtaagcgggggctttgctacccccaaacacttatgagcacctggtatgggccaggcactgggccgggagagaggtgggagagatgaagacaccatctcttgaggcaaggagggcacaatgggatgggctgtgacacatcatgcacagcaggcaggactgtaaactgtcacaacacttctttgaaagcaatttggtaatatgcatcagaaattctaaatatccccacatatttcacccaaaatcccatccctgagaaatctatccaaaaaatgttaaaaagctgatttaggcacaaaaatgttgcaacagcaaaataaatagaaacacactagatgtctacctgaaagggacatttaaataagtaatggtatattaaaagtataataaattggccgggcacagtggctcttgcctgtaatcccagcactttgggaggccgaggcaggtggatcacgaggtcaggagatcaagaccattctggctaacagggtgaaaccctgtctctactaaaaaatacaaaaacattagccgggcgtggtggcaggcgcctatagtcccagctactcaggaggctgaggcaggagaatggcgtgaacctgggaggttgagcttgcagtgagccaagatggcgctactgcactctagcctgggcgacagagcaagactctgtctcaaaaaaaaaaaaagtataataaattaattatttttgagatagggtctcactctgttacccaggctggagtgcagtggcacaatcatcactgcagcactgacctcgatctcccaggctcaagtgatcctcccacctcagccttcccagtagcagggaggacaggtgtgctccaccatgtccagctaattattattttatttatactttttgagatggagtcttgctctgtcgcccaggctggagtgccgaggcacaacctcagctcactgcaacctttgcctcccaggttaaagcaattctcctgcctcagcctcctgagtagctgggactacgggcatgcaccactatgctcagctaatttttgtatttttagtagagatgcggtttcaccatgttggccaggctggtctcaaactcctgacctcaagtgatctgcccgcctcagcctcctaaagtcctgggattacaggtgtgagccaccacacctggcctaattattattattattattattattattattattattattatttccaattcaaaaattttaatttaaaagtaaactttaatgtcaaaaatgcaaacttggggaggggagaaagatcacacgcaaagctgccacttcacacttgcagggctgcacggcagctaggcaaaggtgttcctcaattcccagacggtgcggcggccagacagaggtgctacttactcacttcccagatggggtggtggccaatgcccggcttaattattgtttttctttttttcatacaaacagacaccttactgactttttacatttttttgtagagaaaggctctcactatgttgcccagggtggtattaaactcctaggttcaagagatcctcccgtgttggcctccccaagtgttggaattacaggcgtgagccaccacactcagccaagaatcatattttctaagactatttggtgacacatgtagaactcacaatatgtcaagagaaaaaaatccaaaacgtataaataatatgatatagattttaaaaaatctaaatatatacatatagaacaaagatgggaaaaagcagccacatgttaagattatttctgggttgctagggatttcactcttcttctttaatgtctatatttcctggagctcttccatcaacatgttccttttacaatcaaagggagggtgcaggtgccggtccagggcttggcaacctgtgtggaagaaggctccacacctctgcttgagagccgccagggcactgtgtccttgggaagagtgggccaagacctgggggtgcagggcaggctctgggtaggtgctgaggaggtggggcactttggagagggctgtgtggagggcagcagcagacggaagcgacacagggcaggaaatctagagccacacaggatgtggccacaaaaggacagttgacaaggggcttccagttcagctagtggccaaggacagtgacagtaagaacacgcaactgtgggactgactgtctctgaagtgaccggcctcccaggataaggtcccaagtgatggtggagatatgaaggggtttccagactacagaattcaaggcctatgtggctaagaggttctggtaccttctaaagagaactagactttggtggttatggaaagggttgcgcttctagaatgcttccctctcaatgagaacagtagctccacgtggctgggaagttcaaagtggttttgacacagaaaagaggaagtaagtggactctatctttgatttgggatcctactcctgaccctgtgaacttcttggctccctcttgaggacgttggcttgaaagtggctctgtgggttctccctgctctctgacttctccgagcctgctggccactgtcttggctgagactgctctagtctccagaaaggagatctgctcactcctaagaagtatcaaggtcaggccaggtgtggtggctcacgcctgtaatcccagcactttgggaggccaagacaggcagatcaggaggtcaggagatcgagatcagcctggctaacacggtaaaaccccatctctactaaaaatacaaaaaattagccaggcgtggtggcacacacctgtagtcccaggtactcgggaggctgaagcaggagaatcgcttgaaaccaggaggccgaggttgcagtgagccaagattgcgccactgcactgcagcctgggcgacagagcgagacgccatttcaaaaaaaaaaaaaaatcaaggtcaggggggaagtgggaagactgaaatagataaaggattctaaagagatataacagtcaaatgcgacacatgaaaccctgaccagataaaaattaaaaacccataaaatacatgtttgaagtcatagagtaatctgacttggactagacatgtgatatatgtgaggcttgtgatcttcccaggagtgatggtagcacagcacagggcagagacccgtccatggaagaaacactggtgctagtgcccagggcagaagtgagtgatgtctttaagtggatatggaaaaatattaactattctacctaggttgtgggtgtatggatatttagtattcaattattccaatttctctgtgtatgtatacatattttttttagagacagggtctcactctgtcgaccacactggagtagggggtacaatcatagctcactgtacatactcaagtgatccttctgcctcagcctcctgagcagatgggactacaggtgtgcagcatcatggcccagtttttttttttttggtagagatgggttttgctagccgggagcagtggctcatgcctgtaatcctagcactttgggaggctgaggcgggcagatcatctgaggtcaggagttcaagaccagcctgggcaacatggtaaaaccctgtctctactaaaaacacaaaaattagccaggcatgatggcaggcgcctgtaatcccagctacttgggaggctgaggcaggagaatcgcttgaacccaggaggcagaggttgcagcaagctaagattgagccactgcactccagcctgggcaacagagcaaaaactccgtctcaaaaaaaaaaaaaaaaaaagagagagagagagatcggttttgctatgttgcccaagctggacacggacacacacacacacacacacacacacacacacacacacacacacacacacacaagctggacacagagacacacacagtgacagggcaaaggttccaaaattttaaacctggtaaatctgggtacgggtatacaggagttgttctactacactattctttcaacttttttgaaagtttgaagttatttcaaaagaaaaagttttccaaactttagtgatcctcctgcctcagcctcccaaagtgctgggatgataggcatgagccaccgtgcctgacccctctgtatatttttagaatttcatgttaaaagatggaaaagtctggatgaggtagttcacgcctgtcttcccagctctttgggaggccaaggtgggaagactgcttgaagccagacgttcaagaccaacttggccaacatagtgagaccccgcttttttctaactaaaaaaatttttttccaagttggaaaaaatatctagccataagacaaaccttgaaactgcaaaagaacaatggagtatgtgtgacaggaggtactgctctacagtggggttaaagccatacacaagctgtggtggctcacgcctgtaatcccagcactttgggaggccgatgcgggcggatcatgaggttaggagttcaagaccagcctggccagcatggtgaaacccgtctctactaaaaatacaaaacattagccagacgtggtggtgggcacctgtagtcccagctactagggaggctgaggcaggagaatggcgtgaacccaggaggcggagcttgcagtgagctgagattgcgccactgcactccagcctgggcgacagagcgagactctgtctcaaaaaaaaaaaagccatacacaagctgttaccactaaatgggaaaatgactgaaaaatgtcaatgtcaagagggactgaaatcaaatttttccaatagtgggttacatgatcagaaatccaaatagacaggaaatatgttggctttatttatttatttatttatttatttatttatttagacagagtctcactctgtcacccaggctggagtacagtggcatgaactcggctcactgcaaccttcacctcccaggttcaagcgattgtcctgcctcagcctcccgagtagctgggactacagatgtgtgccaccacacccagctaatttttgtatttttagtagggacggggttttaccatgttggtcaggctggtcttgaactcctgacctcaagtgatccacccgccttggcctctcaaagtgctgggattacaggtgtgagccaccacacctggccggtactggctttaaaaataacaaaagtaatacatacacatagaaaaaggtcaaacaaagaagtacatagaatgaaaaatgaatgctgtgtcccctcccagaccatttctgtgaataaatatgtaataccatgaaatgatgaggactaacattttctgaatgccaggcaccactctatgtgctttccacacattcattaacctcatttaattttctcatttaattaatgagataaattaatgtatctcatttaattttcacaacaacctcatgcagtaggtgtaactgtcaccctcatttcagagagcagaatactgagagctggaggccaaggggcaatttcagccagggtggctggtgacgcctcggtgaaaccaagagcgaacagtgagagcagcggccacctgctggtctgcagggatggtgtcctgggcagaaagaatagcaagtgccagggctgtgctggggccgggctttgcatgtgtgagaacaagacagagaatgagggaggtgggcccacgaggagtgtgggcacagacagcagcctctgcctgtggtgccacgctgaagactcagtattgtatgtgacagatgaaggctctaagaagacagctctgacaaaagctagagtgcaaaatcagactcagacacaaccaccggtctgtgtcctgaacacaatggacctttacactctggaatttctcaaacggagcaatgcacagacacccccatgggccccttgcacacccgcagattctcctaggagtcacattctctcttcagatagactctgggtgccgacactcccaaacatgctcttgaggagcagtctctgtgataagctgatcttccagacaatccagaatattcttaaaactttttagatcataaaatttaaaacacaaattaaaaaacaaattatcataaggccgggcacagtgactcatgcctgtaatcccagcactttgcaaggctgaagcaggaggatcacttgagcccaagagttcaagaccagcctaggcaacatagtgagaccctgtctctacaaaaaagtcaaaagttagctagacatggtggtgtgcacctgtattcccagctacttgcagggctgaggtgaggaggattgcttcagctcgggaggttgaggctgcagtgagccaagatcacgccactgcactccagcctgggtaacagagtgagaccctgtctcaaaaaacacatagggccaggcgtggtggctcacgcatgtaatcccagcactttgggaggccgagacgggaggatcacttcactccaggagttcaacaccagcctggccaacatagtgaaaccccgtctctactaaaaatacaaaaaattagttggacatggtggtgtgcgcctgtaatctcagccactcaggaggctgaggcaggagaacgcttgaacttgggagacagaggttgcagtgagctgagatcgcaccactgcactccagcatgggcagcagcgcgaaactctgtctcaaaacaaacaaacaaacaaacaaacacccataaacacaaaatgtatcacagcctcagagatccccacgaatgcctaagtggccctgaatttgggaggcactgctcagtaatagtcctatctgtcccacaacagacaggagtgctgggctgcacctactggcaacaaacacagcaacccttgactgaagaaaggtccatgccacaatccccttattctgtaagccactaattttgtcctctctcctccacctttcactgaggaacgagctcttggaaggacagggacacccgcctagtagctgagccagccacatcagtcctggagagcaggtggagggcagatgctgtgatcatcccagaagagaggacacagttggaggcagatgcatggtctctactttcagctaccctcaatgcagcctggtccccagaggcctgaagagcgccttgtttatgtggtgacctcaagaggggctgctcctgcaccaaggctatgtgtgcatgctaacacagtaaccgtcatatactcaaagtgtcagctctaagaactggagatgaggagctgcaagccactctacagttatcaaaggcacagctgagggggtttgtgctgaccaagctggttgcctggtgtttggattgggacttatttactttggaaaatatgcagcaacagcccagcaccaaagttcacatcaaaatcccactgatgaccttggctgctttcatctctgaagcgccacttctcagaaacacagaggtaagttgggtttctaatgtttctgctgattataaattatttttggtgtttacggataggcaactggttcatttttctagcaaactaagaattcagaagctttctacactgttttagaagtgggaaatggtttcatttttcagtgtgcctattataaaattgtgtcagttccattgttgggagagttgacaaacttagaataggagctgtggaatagatgaaaatattgtacttatattaaattaatcgaattggataactgtcctgtgattatgtatgagaatatccttgctcttgggtattttccctgaagtattagtattaaaggttagaggggccgggtgcagtggctcacgcctgtaatcccaacactttgggaggccgaggcgggtggatcacgaggtcaggagttcaagaccagcctgaccaacatggtgaagccaagtctctactaaaaatacaaaaattagctgggcgtggtggcacgcgcctgtaatcccagctactcaggaggctgaggcaggagaatcgcttaaacccgggaggcagaggttgcagtgagcggagatcgtgccactgcactccagcctggacaacagagttagactccgtcaaaaaaaaaaaaaaaaagaagaaaaaagaaaaaatgttagaggaacaagatataggagacctactctcaaatggtctagaagaaaaaatgtgtatgtgcatgcctgtgagaacacacacgtacgtacacacacacacagataatgacagggcaaaggttccaaaattttaaacctggtaaatctcggtacgggtatacaggagttgttctactacactattctttcaacatttttggaagtttgaacttacttcaaaataaaaagttttccaaactttaggcagttacttctctcccattctgcctgctctgttgggcctggagaccatacaccaggagggatgacggtttatcaagtgttatgctctgatgcgtgactgaaaaggccaacccagctctggcaattagcaagaaagcacaatatgaagttcccaggaaaaaaaaaaagcaaaacaaacttttgaatgatttatctttaaaatatattgtttctcttcaaacagtaatctggatttaatcacaacctagtgatagtttttaaacgtcttctacaatgtttgttatactaaatagcaaaacatcaggaagatttaccttcagatctttaatttcaatccataaaagatatcagagatattttctccttcctctggtaagggaatgacgaaaactatttttggctttttatcagataatgtgggaacagggtataagaagtttccaaatataacttctgaataccgggataaaacatgcatgtctttactctgccactctatctggcctcagatacgttttcctgaatgcttatttattcaagttggtttttgttttgttctttaaccttatttttatctgagaagaaaacattttccccctttgttccttcttcttttggctttcttttttaaaatagagatgaggtcttgctatgttgctccagctggtcttgaactcctgggctcaagcgatcctcctgccttggcctcccaagatgctaagattacaggtgtgagcccctatgcctggtcttcttcttcttgatcttagccaaaaggccaagaagtgataagaggaggacacttgaagtgtagttgggcaaggagccttctaccagctgcttactttctttgttcctgacttttaaaagtgtgttgctattgatacacagtctcctgatatgtaaaatgctgggaggatgaagctaagttactcaaagtgccattcagaaactgggcccagttctatttgcagctacatacattagaaatcatttctagaggctgagcatggtaactcatacctgtaattccagcactttgggaggccaaggcaggagaattgcctgagctcaggagtttgagacctgtctgggcaacatggtaaaaccccatctttaccaaaaacacaaaaaattaactgggtttggtggcacacacctgtggtcccagctacttcaaaaggctgaggtgggagggtctcttgagcctgagaggaacaggtggcagtgaaccaatattgtgccactgcactccagcctgggtgacagagtgagaccccgccgtctcaaaataaaaataaaaagaaatcgtttctagaaactgttttcccgtgtgtaaactagtggcactgcagcctgaggcaggtgctgagatggggacctggaaaaggcaacaggcattttgagtcagaaacaatgtgactttcctgctccaaaatgtgcaattcaaaagtctttcttagttgtgactaaaacaaactttgaacttactatttcaacagtattataaggggaagacccaaggaatgggactggcactgggaaaacagctaggaagctgctctgcacggccagggagtctggaagcatcctggtactccagagcgaacaaggctgagcgcttgatgtggggcttagaggcttaaccaacttggttcgaatctagccactgccacttattagtgacagtgacgaaaggctcagtctcctgatatataaaatgttgggaggatgaaactaagttacacgaagtgccttatacagcgtgtcaggcatccaacagaggccattatcaacattaaccacactgacagcatttcaagcagagtatccgaacagttaccccatcttcaggcctactgagttcaaatatttgcttaacaagagcagccagtaactcttacctggcctcaactggcagcagatattctgggcctcaaatatctatctaataggaaatggtcacagacacaaaataagcttaacaaaaggcagtttttttttgttttttttttgttttctgttttttgagataaggactcactctatcccccaggttggagtgcagtagtggcgtgatcacggctcactgcagactcaagtgatcctcctacttcagcctctcaagtagatgggaccacaggcgtgtgccatcacaccaggctaattatttttcttttcttttttttttttttgagacggagtttcgctctttttgcccaggctggagtgcaatggtgcgatcttggctcaccacaacctctgcctcctgaattcaaacgaatctcctgcctcagcctcctaagtatctgggattacaggcatgcgccaccacgccggctaatttttttgtattttttgtagagacagggtttctccatgttggccaggctggtctcgaactcccgacctcagatgatccgcccacctcggcctcccaaagtgctgggattactgacctgagccaccgcacccagcctatttatttaatttttcacagagatgaggtcttgctatgttgcccacactggtcttgagctcctgggctcaagtgatcttcctgccttggtctcccagtgttgggattataggcgtaagccacagcgcctggccggcagttctttctggggtgattagaagttgggaccatgtattacctgtctgagtcagcattataaacacctatggtcactgtcctggcaaaacatggaatcatcaaagctcatctaaccagagtgcagttaataaccaggaagtaagcaagagaaagacaaaggatttggcagtcaaaacagatttgacaggccaagtcagatcctcctctgaacgagtcagaggaacaaataaagacaggattgccataatgcctctgtgctaaaagcttatcttgtttacttaaataaagggagtgcccctcaggtcttgagtaagagcttgctgacatcaccctcacacagactttatctcttgtttctaaccctgtgttagaagcagtaacacagaagatttagttgctcctgacagcagtgggagctattgtctaagagatacaaaggagaaaaaagtatacctgcagcaagtgatatcacctctggggctgccaccacatcacctcactacgccctgagggggtctcagcactagacaagttccaaatcttttgcaaattaaacaaccccaggtcaggcgtggtggcttatgcctgtaatcccagcactttggggggctgaggtgggtggatcacctgaggtcaggagtttgagaccagcctggccaacagagcaaaaccccatctctactaaacaaaatacaaaaattaaccaggcgtagtggtgtgcacctgtagtcccagctacttgggaggctgaggcaagagaattgcttgagtccaggaggccgaagttgcagtaagccgagatcgcgccactgcactccagcctgggtgacagagtgagactccatttcaaaaaataaaaacaacaaaagccaattacaacaacaacaacaaaaaaacaacgaattaaacaaccccaaagattgcacaaatttcaagtatctttagaatatgttttcagaaagcctggcccatggacatttttcaacagcatctccattgcaaaggtggaatggtgtgagtcacacaggcatggctgagtcccactaatgcacatcccttctaggtactctccaatcaccagccccaggtgcccactcaagcccagctcttagtgaggtttccctgactctctgggcacttccactcctaccacacagggtagagccacacccctttccgtacccccatgtgctctggcagcattattttgagagccttcgctttactgcacgtctgtcccatctgtcccctgactggtccatgagcccctggtgggaactttgtctctggtaactaaacactgtctggaggtggtggacaaggtgtctggagaaaaacaaactcctccctgggatgcctgagctcccaggattctagaaggttagttttgcaaacctttaaagaagggattttcatcaaggggcccacagatccttcattgaggtttatgagtcccacatcaaaggttgggtgtctatctacatcagattctcttaaagtccatgatcctaaaacagttaagaactaatgctgtgagggcctcttcctgggtcaaagccacagggaacctgccatgtggatgctgcagcggggtgtggatcagccaggccgcctttcactgtgttctgttttccctcccagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggtaagaggcacctttacagttctcacagcaaacccacaacatactatttttgtatgtgggtagattgaatgccaagaactgtactgtagctataatttatccaggaaaactagacacaagattgactctggaacggggacagggaaggccaagctgaagtgacagtagcatctgacacttactgagccctaactctgtgctttaacacagccttgtgaggtcatcactgttattagcatccccattttacagaggaagccaccaacacatgaagtaaaaggatgggctgggcgcggtggctcacgcctgtaatcccagcactttgggaggccgaggcaggcagatcacttgaggtcaggagttcgagatcagcctgaccaacagaccaacatggtgaaaacctggctctactaaaaatacaaaaattagctgggcctggcggtgggtgcctgtactcccagctacttgggaggctgaggcaggagaatcacttgaacctggaaggcagagattgcagtgagccgagactgtgccactgcactctagcctggacgacagagtgagactccatctcaaaaaaaaaaaaaaaagaagtaaaacgatgctccaagggcacccagttattaaggggcagagccaaagctgaacccagggaggccaaccctagcaatctgttaaattggaagaaataatacaaaaactgttttagcatttggccagcctggatttgagttttctcttttcctttcccaattatcaataagcaggaatatagacaaaaggctaaagaaatgcacctgtgaactattcagcttgagcagctgacattgacacctacaagtgcttttcaggatacttttgaactactgggcaggtgggatggagaaataaattactatttccccagcaactgttctgggctgagcacaagggcactttttaaggaggtcaccccacacccatcacacacacataggacccctggaatcctaggaataaataagcatggatttgtaaaatccaaacctctcttttcaaatatcctcacctggaccagaccagaagaaacctctactttactctctaagctgagagtgtggaaggggaaacacgaggaatggttcggcttcaggactaattgcggtgacacacaaccacttctctttgccaccaaggactaccaggtacctgcaaagggcagtacttggaggccagtgctttctgctagttagctcccgtggttttatagcagcccaggcgaaggaaggagaccccccccagctcctggcttctgttcagggaaagggggccagagcccctcctgatctgtccacacacctgctctgtgccttggctgaggcccctgcagctctacaaggcaggcattctgctggataggccaagcagggtcactctgacacccaggtttccaccccaaggcatggcacaatgctggcctcctgtgggtggaatcaaaggctgagttctaacaggcttgcggcagacacacacacagagaccacatgtacatgatgaacacacatatccttttcattacaggttattagtacaagttttggaattgagcaaacaagagtctaagcgctggtttcaccacttctcgtttgtgtgacctcagacaagtcattcaacatctctatgactcagtttccttatctttatcacagagatgacacccactctgacagggccgagggaagaaccataagcgatggcaatgcaacagagtggcacatgacaagagctcagcgaatttgagggaatgaaactgtagattacaatactagtacaatatgataaacatatgatattgttagtgacatttattttacttctactagcaaataacctatgtttaggactgactttagaacaggctggcagaagcatttttggcagcatcaaagtcctccaacctactggtctgttggagccccccaagtacaccaaagagcctctgcattagccctggctgagggttcagggacaggcagagaagtacagcagtgagccatccctgcctgcatggaggtggagaaatgatcaggcatggtcagttgacaatctcctaaacacagtaacccgtgtcataccacagtgtaaacacacgtgcaaatgcttctgcttcctttccccatcatgagaatagtcactcaatgccgggcatcacaagggatcaaatgctaggagtacccaatcattcatggatgcttctcaaaggggacgagtgtctagaagtgtaattttaatttcacttaatttcatatggaatcatctccattactaattttgttctaattttaatgtgataatcactttgtaaagcacaataaacagaggcaggctctcatgaggaagtcagaaggaaagaatcccaagagacatgggacagctccatccaaactgaaagggccgtgattcccaaaagagcaattttgtccccaaggtctgaagacacttttggttgtcacaacctggggggttggagtaagcattactggtatctagaagggggaggctggggatgttgctaaacaccctaccatgcacagggcagcccacattgccacaaactattatgtggcccaaatgtcaaaaatgctgaggttgagaaaccctgggtgaggcagactcagggagaagggaatcgagcttcactcacaggcaggcaggagctgtctggtacttcaacctccaagacacctcctgctcatctcatcctggctgctctacccaccagctagaaaccttgaacaagttacttcacttctttgtgcctctgtttcctcatatgtaaaagagggataacaaaacgcacacaacttgcatgttgctaggagcagaaatgagataatacaggaaaggtgctgagaagaatgcccggcacatggccagttctcaactactagtcacccattactattagttactcacatcttagagctaacatagacatgggcttattcctggatacacagcactgtccccatatctacagtggtgatcctaagggcaacatggcatcacccaaatgtcttgttagtcactacagaatcacagtgtgagggatgaaggccatcaagacagagctgaggctggcagggtggctcatgcctataatcccagtgctttggaaggctgaggcaggaggattgcttgaggccaagggtttgagaccagcctaggtaacatagcaagaccccatctacaattaaaaaaaaaaaaaaaaagacagaaagaaaaaatagccaggcgtggcatgtgcttgtagtccaagctactggggagggaggctgaggcagaaggattccttgagcctgggagtgtgaggctgcagtgagctatgatggcatcgccgcactccagcctgcatgacacagtgagacctggtctcaaaaaccaaataataataacagtaataaaagctggaaagagctcaaagttactcatttgacagatgtgacagatgaagaaatagaagcgagttaggtgccttaccatggtcaaacaactagttcgtatcagaccctactccagaaactattccagtccgggtaacctctcgttaacctctcttgttagaaatgcaaatttctgcccaaatcaggcctcaggaatcaagagactgtggggtcggctctgcaggctatctgaatgaggcctccagggaaatcagattcactctcaagggtgagacgatttccctaaaggaaccttctcataacagcctcttcctgtggcctttacaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacaggtatttcacactgtgtgtttgttcttttgagctcccagatgctgggggtgtctgggaatactggaaaatggatcatttttttaaaaagggagaattatgtacaagtacccaagaacttccatacagggccactctgttaattcagccccaatttgttgcttgagataagagatgattagagagcattcataagggacacatctgccctctaggggccagtttcagaagttagaggcagatgacttagagacagcttggtgcttgctttgtggcttcgagtcccagcttcatcatccctaaaatgggtataattccattacttccccgggtcacttgagaaaataacagaatcagcgatgctgagcgcccctcccagtacttggaacctaggaggcactcaaaaaaagattggctcaactcttccctgcccaggaaattccaaggtcctcttagcctaccgaggacacatcattcatgatttcctctattattattcgttactttgtagttaaaactgcaggtgttaagtacttattgagattattattgggtcatggcagaaagaatggagaggtcttatttctgtcttactggatactggctaggcccatatgaagaagtgattctggtttgaacctccttataggacaagaatacaaacatatgcaaccaaactgagaaaagtaggctctcagaggaaggtatttgcccgggtagccagtcatcatgctctgtgaatttttccttaacaacgtcccttctgtacctgcctccttccattcctccctgcagcccggcagctcttgagaaagggactgcatcttttttttttttttttttttgagacagggtcttgttctgtcacccaggctggagtgcagtggcatcatcatggctcactgcagcctcaacctcctgaacttaagtgatcctctcacctcagcctcctgaatagttgagactacaggcgtgcaccttcatgcccagctaattaaactttttttggtagagatgaggtctcgctgtgttgcccaggctggtcttgaactcctggcctcaagcagtcctcctgccttggccttccaaagtgctgggattaacaggcgtgagccgctgtgcctggcccatttgacttttaattgagatcttacttggtgcaaggtatgagctaggtaaaagagtgaagaagatcaagccttcctgcccatccagctgggattgcaccttaaatctctttatcccctgcaaagtgccagactaactccacaggcactactgttgctatccgcccccttagggattgagtaagttgaggcaaagattgagaatattcagcattgtctagtatatacaggaaaggttctttttaaaagtacactaccagatattcgactccttaattacaaaaaaaaaaccaaatgcctaaaattgggaaaccaaaccagagaattattttagatgcctttttaaaccataaaccaggaaaagttctgctgctaaccttgaagataggaaacgaaccatacagtctcaaggaaataatcatgcaacagaaaacacacctcagttttcagtagcggaattacaaaggagtgtgcttcctaaaatcctcaactgacagtcccggaatataaattttaataagtgctatatcaattctgtgataaatataacccgtggccctttaaagggaaaatcatgattcttttgtaacttgtggttcaataaaactgggcccccctttccttttctgtctagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctggtaaccactcccttgtccacccccgacccgtccccagggtctgcctcagcacagccccacctccacttgcccttcctacccaccccccaatctcatgtcccagcttggggtgctgagtctgctcttcggcctgggtgggatacacagaatgcctagtttcatggatgccagctggagagcacggcacctggcagacacttactgggcaggggggatcccaagagcagccatggggtgagccccactcccgctgacaccagagacaggggagacatgtgctgcggtctgggaaatagctacccccagccaaatcatgaaagagccattaaacaccgcactatacacatacttaacttaaaccaatcgggcgctcagcaaaagagagagaacaccagtccaaacagtgcagcagacccagttccccatcccggagaagtgcgcagcagtgtggggagctggagctggggtggctgtcctgcaccagcccccacgaccctcagaccacaggcactgccaagagggaacatgaacctagccggcctctaagtgcaacggctgcccctgacaggtggtgacagatattttcaagagtgactctgaccagctgtgatttccaccttacatgttgtctttggatcctttccctgaatgatatgagattgtgctgggaactctagccctctgtgtgctgacctccagaatctgacaactttcctttccaaacagttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcatcgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgtatctgttataattctctattttttgaagctcaaatatcaaaagccaaatccaaattcctggataactccaggtatgataaaggctgagaggaagtcacttgagcaccacaatgtgccacagcagggcatgttctcaggacaggacaggtgtgtgctgaatcctggggagggtctgtgcagtaccccagaactgtggggtgctaagtggcacacaagccccagggctcccacagtctatgccaggctgctgcagctttcatccctcatacctggtcctgcagtgggtctggtttgacagagcagatgacacctgaggaatatgtttctggatccttcaatccctgggtaagacaagtgaaatccacagaggctgttcagcacgcaagagtgccagtgctctttcagtgaggggatgactgacggtcacaggtgctgtgtgtgcaggtgtctaactgtaacccccacagcctggcagatgaggaagacaagggttggaagagttctgaaacctgtccaagatgctgaagtagtggggctgggttcaagtgcaggttggctggactccagggaccacacaaggagtcctgtcacaggcttctgaccccatgagaccaataccagtaagaagagtggtaaaagggagtagggacggaaggggaacgtcactgccctttgtaggcatgcctgtgggttatctcacagagtctccttaccctcaatccctagggggctggcactgttacccctcctttttacagctgcagaagcaatttcagctcacagaagggaaggcctctgcctgaggcctgaatccacacccaggcagggggaccctgcagccctgctttcccctgctcccttcctgacttcccacactgggctctgcctccttactctgctgagagcagatggtgcaggggctggatgaattgccccaagccatcctctcggcttcctggtgaaccctgatgctgcggatggcccactccttcaattcattctccaatctgcttcacccctcttcttttctgtcattctccaaactgcttcaccactcttcttttctgtcattctccaacctgcttcaccactcttcttttctggtgcctgtcctatatttctcatcttgctgcagcttccttttggctcttctcatttctaaatgtaataatctcaaaaaacccttttagtcctttgccatgtctgtcccatacccagaaaggcagtggtcacttctgctcacccagcgccctctctgctacagccggtgtggagtcctccacactcttgagcatccagacacccccgtttcaatgccttttgttcatgtacacccactcagaatctctcagatcccctcttacagaaactagcccatctgttactcaaagcaggagagtactcattcagaacacaggctctgagccaggctgcctggtttgaatcctggctctgccatctagtagctatgaaactctagtagcaggttctgtgcctcagtatcctcatctgtaaaatggggagaccagcagcacttaccttgagggattgctgtgaggattaatcaaattaatgtctagaaagcatttatttatttatttatttattcatttattttatttttttgagacggagtctcgctctgttgcccaggctggagtgcaatggcacaatcctggctcactgcaacctccgcctcctgggttcaagcaattctcctgcctaagcctcccgagtagctgggactacaggcacgtgccaccacgcttggctaatttttgtatttttagcagagatgaggtttcaccatgttggacaggctggtctcgaactcctgacctcaggtgatctgcccaccttggcctcccaaagtgttgggattacaggtgtaagccaccatgcctggtctggaaagcatttagatcactgcttggttttagcaagaactaggaaaggttgtcacattattctcaatctaagagagtacataagccaggccttcttaactggggagccttgggtagattgcttccatttaacttcctgaggttacatgcaaaatcttgagagtaataaggatttccatggacagagagtgcacagttttcgaaaaggttctctgtgacctaaaacatgttaatccacacacacctggttttgcaggcactgagaaaataagtaaaccttccaaggccacaaaagtgactggtgacacaagtaaacttgctctcagtgaaatacatgaatgtttttccagaaggaggtgcatcttattaaatcactattatatgacagtggaacaactaagtctctaagcattagataccattcaaaacgtttaactaacaagctaagtaacaactgaagtaatttaatcaatgatatctctgaagaaatattattcacaaagttgcggtacaaagatcaccaaatctagccaggaaggagcctcagagattgtatgacccagcttcctagcaactccctcaaagtcactgagaacagctgcattagggccaaaacccaggcttcctgccccaaatccactggtacttccattcaacagagtaatctgagacactgtgtcatcaaaggtcacagaatatactctatatacaaaatagagtatatctttcttttaaaaaataaaataagtaggccaggagtggtggctcacacctgtaatcccagcactttgggaggctgaggcaggtggatcacttgaaaccaggagtttgagaccagcctggtgaacatggcaaaaactgatttctactaaaaatacaaaaattagccgtgcatggtggtgcacacctgtaattccagctgcttggaaggctgaggcaggagaatagcttgaacccaggagatggaagttgcagtgagccaaaatcacgccactgcactccagtctgggtgacagagtgagactctgtctcaaaaataaaaataaaaataaaaaaatttaaaaaaaacaaacacacacacacacacacacacacacacacacacacacacacaacaaaaaaaaccacctctggaaattagtttcttccagaaggtccaaggggtaaccataaagtaaatgcaaggacccatgatctctgtgctctttgttgagcaataaaatcaaatatttgtttcctcctccataatataaccattaactttcactaaaaatacacttattcttctcatgtaagaggtcacatcaggggagtatttaaatgagcatgtgctaagctatcacagataacagttctgcctgtaccacccaccccagcagcccggagaggcgcaggctcacacacgatcccacatgtaggaccaggagtccaacctggaaccctgtgaccctcaaatttgtgtaatttcaaccaacctcaccactcactgcttccctaaagtgcaaagtgcccgacagatttccactatgcatatattaagctctaaatgacaactgctcaacatatttgaaagttcacaagaatacaggtcatcaagttctgatggtcaaagatcctggaactcactgattttagtgttgccctaagcatcctccctatctgcctaaaacttgctctcctgcagagcctgctgccaacagagtggcttgggcttcatgccccttacttttccctccaggccacataaaaggcccacatacaacagcactttaaacacacaagcatacactactcaacattagctacacagtgggaaaatttctgttttgaaaaatcaaccaatggggccaggcatggtggttcacgcctgtaatcccagcactaagggaggctgaagtggggcagatcacttgagctcagaagttcgagacaagcctgggcaacatggcaaaaccctatctctacaaaaaaatagaaaaagtagctgagaatggtgatgtgcacctgtagtcccagctacttggaaggctgaggtgggaagattgcttgagctccagaggtccaggctgcagtgggctgatactctgccactgcactccaatctaggtgccagaatgagaccctgtctcaaaaacaataaaaataaaaataaatcaaccaatgggggtgtccatgaaaaataccatggcaggccgggcgcggcagctcatacctgtaataccagcactttgggaggccaaggcgggtggatcacttgaggccaggagttcgagaccagcctggccaacatggtgaaaccccatctctactaaaaatacaaaaattagccatgcgtggtagggcgtgcttgtaatcccaggtactcgggagactgaggcatgacaactgcttgaacccaggaggtggagactgcagttagccaaggtcgcaccactgcattccagcctgggtgacagagtgagaatctgtctcaaaaataaaaaataaaatacaatataataaaaaataaaaataaataaataacatgcgacatatgacattttactactaaagataaataatggcaaaccagtcagttactatttttcatctacctcggccagccaaaactggacaccctagaagtccccaggttgggaataatgatgaacactcagatggtgtgagcaggggaacgacttcaatgagaccaggagaggtgcctctctgtgcctgcaatgccacctgtctgcctgacctccacgtccctaggctgccctagcagttctgccaccaggcccacccctctggtgtacaaggtgaaggggacacatgcaagtgctcaagactcaaactactatggggtgaggaggagggaaggcactgtaaggcagacacaagggatggcctagaaggttggttaaatggaagggagagaatatggaatgaaaataaatactggaacataggtgctgggcttaggacttgcagctaggagtgacgaagaaagggaaaaacaacttctacaagtcatttgggaagaagcggacccaagctgggacaggacaggatggaaacaggctctccaacacgatggtgccacacaggaggcagggactgtgcccgccatgccaacaacgtcccctgaaggagactggggccatagctccgaggcctgagcgccgacaagaggcttccaggcctgcacttgtgggaaggagccaaggaagggatggaagcagggagctggcccagcatcagtcacaagggcatgagacacaggatgaaagtggagtcagatttaggacctgggagccacccggcagggaaccaaagcaagtgcccttgtcaattggttgagggggttcgggcaggtcatggagaaagggagtgaaggatgtgccatggtggacacacctatggggctgtcatggaaaagctggtgatggctgcagcagtcacatctagaggcataggggcctcaacactgcacctttctaaggaatttactgtgcgtcaccaggcaacacttaaagcatgaacacagtatctgcagtttttatcattcaattaatgaatactcaccacagctattacaggaatgagtactcccaagttccctgcactgctagaagcctagaaaagaacagaattattgtcattaacgagtatgtgtttcttttattaaaaaaaaaaaacacaagatacaacatagtgttatgtaaacctggaatgtcttaatctaagagaaatgatgagagatatgcagagagaggcagagagatgctcatccagcataattttaatagcaaaaaatgaaaacaaatgtgaaaaataaaccatggttacataaatgattacataaatcatggtacttctgcataattagatatgacacagctatttaaaatacaactttctgaaaagcatttagtcaccatggaaagagcccacagcacatgtcaaatgaaaaaaaaatcaagatttaagactatgctatgattcaatcccaattatgtaataaatacatatgcataaaaaagctaggaagaaatctgtcaaagtgttagtaatgattatatatctgagtcaagggataagtgctttttactttactatttataggcttctgtatcttttctaaaataaacatatattcttcccaagttagggaaatttggggggttacttaataaaagatagactctctggctagacacacaaatgtagctaatcttcagtacacactgattagtaaaaattctggaagcactggcctaagccgacttgatttatgctcttaatctataataacagcagctgaagaccttgagcatacactgcggccaggcactgtgctcagtgcttcgcatgcactaacttctgggacgattcatgggaggtctcagtagcttgccaaggccacacagcacctcagtggtggggacagaatgccaagctgtaaacatatacacctactatgtactcacaaaaatttttttgaaaatttaaaaagaatgccaagctgttttccctgggctgggggccacaagggtggccctgcctggtcccctctgggaaaccgatagcctaagggatgcgtgatgatggagaacaacccacagaccttagtttaatttataattatagctccttgtcctccacaaggtggggcactgaggtccaatttccaggggagagcaggctcctgaaacgcccctcagacaggttacagcctctgctttctcaggtgctcagcaccaccttgtatcatcagtaccccactcttatcctgatgcctaaggtcccgctagacacgcgggacacacttctctcctgtgcactgaggtggtcccagctgtgtaccccactgggagacttgggaagttagtcagccacatgactgtcggagggcccggcatagcaaggctgaattagggacaagagtcttaggatccctgcttgcatcggccactctctcttggctgagactttcacagggggactccttcatgcagttgtcatctcaaatgccactcttcagagaagccttctcaaccagcccaatctaaagtgcccctcaccaccctgccctgtttcactctcccactcagcgccacaggcagagaggaccctgtctgtctcgttcacttctgtaacaccctcatctagagcaagggctggtaaactatggcccatgaaccaaatccaacccaacacctgttcttgcaaatacaattttataggagcacagtcacgcctgttcgttcatagacaggtgaccacagaagagttgagttgagcagttacaacagaagctgtatggcctgcaaagcgtaaaatatttacactctggccctttacagaaaaagtgggctgacccctgacctaggacagtagctggcacagagtaggtgaacaataactgtctgggggaaggggaaggaagaaatggaagagagaggaaatgacaaaacagggtggaagtagagatatggttgtgggatacattggggtttttctttaaataatctgatcaatcttttattttttaatttatagtacccccgactttttcttttttttcctttttgcctttattaaatgcctaaacacgcctcagtaccaagtgttatcaacaccaactcatattcctttccttatttaaaaaaaaaaactttctagctcattacaaacacccccttcccctttctctccactttcttttacatacccaccctatctaaaaaaatcaaatgtttagccaaccaaaattagtttaaattatatgacccaaccccagccaataaaaaaaatacaaaaacaaaacttgagtcaaaaataaaaattctcgtgccctttattcaaatatgctcttataacagctagcccaaaagacacccctctacgcaaaaataaaattgctttactaaaactcttctgttcaaatattcaatttccttaaaattttaagggttattcctaacatggtagagcgactagtgcccacgtgacatgctactggggagttacgaaggaagaggcctcacctgcctcggccccaccatgaatgtatttggggattcaagacatgacgtttatctcagtagacctgtcttccttgggaggcctgagattaggtgaaatctggcccttctcatgttgccactgtgttctgatgatgggcccttaaagtcctcctaggcccagctaccacccctgggcttcatgataaaggcaaggacagagagaggtgcccgtggggagctgaggctagactgttgtcatgtcaccaccctaggatgggtcgggcagcttttatgagctggatataacccagtgagaaaactgccctctcccctgatccccaccagcatccttgagaaagaaccccaccccttcttacttgcattccaggcacatttaaatcattcacaaagaaagtgccatattccaaccaagatggtgcctgaagactaagccttggccagcagggataggacactgatggggaaggcatagccatcctccttcctacctttagggcagggcccttctcgcttgccctctcgctggctcgcttcccctccagccccagctgcacaaacaactccaacaggttcatgagcagctcatccaccaggtgctcgtcttggatgttggccgcgatgttggccagggcattaatcactgccagggagcaatgcctgaagaagaaggagtgaaataacagccactgccaggccctcaaccgtccccaagggacggcactgcaggggtgaggcgagctgagcgggccaggcccagcctgccttaccacactcctcccagtgtctgtaaaccaaagaactctcaagtggagaagaacatgtcatcttcgtgaaaaacaacctgtagaataaagccaactgatgcagaaatgactgcaatcctctctcctgaaatgtagtaaggacctccaggagactaagttctaggcatctgcaacactgggtacctgtgagggtctcaggacacttccctcagggctgaaaatgaaagggcccatgcccaggcattccaggttggatcttgcttcccccctacaaatcacaaagagccttaaagcatcatttaccacccacagaactttcacctcatgaccagcttctccctaacgctgcctccaccttggagctgatgtcagtattttttcacatccaatgctcagcaagtgttccagggtcctgcctcaggatcttggctggcccaatgtaaaccccggatgtgaagctgacattgcccctttggccagaaacctgaaaccactgaggccaaccaggcttctgtggccctggagactgccagactctgtcatgtccaagcggcacgaccctgggtaagtctctttaagtctttgagcctcagtttcttcctaagtaaaacaaggatgataatttctcttcgtaggatcacgggaagagtgaaacaccacgtgaagcactaagcatgtcgtctgctccactaagaaatcccagagcaacggcagccacggcaaaaggcactgcagttaagtaatacctggtaggtcaagggcaaacaaagggcagtaaatgcttccactggtgaggaagacgacaaatcatttttggtgacaatatgagaaaaggctttatggaaggagaggcaagctgagccagaactgaagaactggaaggatgaagactggcaggtgctacagacacagggtaaggcatggcagaacacctaggaggggtggaagcaaaggaaaccggggaggcagctggcgaggcagctggggacactcctggagaaagggcccagcagtcacataggcgcaaggaagcaatgtgttggcctgtgtgcaggttccatggcagagaatgggacagaggaaggaaggaaaggagagcctgaccccatccccaatccagtcttcaggctgttctagtagcctgggctcatgacggtggcagcaagaaggcaatgaagtagtatcgatgcgagagacagctctattgattgggagctttcacatatgcaatctcattcccaactgcaggcaggttctcatttggcagatgaggaaactgaggcacagaggttcagcattttctgaggtcatgcagctacatggcatggctccacagctgcactcccacccactaaactgacatggagagaatccagaggaaggcctggacttcacagtcagaagggaggagcccggaggtcaagaagagtaacgcctgcaaaggggctctcttcttccctccccaccctcctgtcctcatctgacttcacctctccccttccctctcttccaaacacggatgaacatgtccctgtcctcaaggcattcctagaggagggtaaggaatagccaagaagcatctctcaatctgtcagggaaaactggtcagactttatacaagtatcaaatgttcaaggacgtttaacgcctacttccttggacccaaaatcctacttctctgaatctaacccacagaaagcatcaaagatgctcagagatatgtagctgttaggctgtcaatgctgcatttattagtgggaaaactggaaaacaccctaacatccaagctagagactggctggttaaatcttggttctactataggataggacgctccacaacctctaaaggcaacctgcgcaggatcattcatggtgtggctgatgtgctgccccataaaaaagcaggtcagctgcatgtgcagcatgggcccaatcagaaggagagaaaggagctgagacctcgtgcgctgagatgctcagtggtcacctccaggtgggggccacattgggttttcacttccccccttatgtgtgcactgatctgtagcatatagttttcttgcaagaagagtttatttaagagacaaattcacaaacctcacatttttaaagtaagttaaatactgtcatgataaaaaagtgacaatgaggtccagttacctatagccgtggtccttgtaatctttggtggctgagtatacaacggagctggccttcacactgatctgctggaagaggttccacacttcctgatagatgtattgctgggagagagcaagatgcactgtcaccatgcaggatgccctcatgaggcccctcctgtcatcacctagagagaaagctctggaatcctggggcacaacagcccaaagactatcagcccaaagatcatccatttctaaagctttaatcaaacctcaaattaaaagctaaaagggacatggcttagattcaaatcttctgttataatacactgacaagaaattaaacctctttttccccagcactcacagcatcttacactattcttactactccgcattaaaaccgttgtcagcatttagctcatctgcaaggtatatttaatctgtatttgtacatcccttatagtcaagagtttaacgtagcttgcacagggttagtggtgttctggctctggcctcccttacatttccggtgataaccaggcagcccagctggtcaataatcagcacatcgaggggggagggtggctggcagaatttctgctgtaggatctgcagaatgggctccatgaccttcggggtgtccctcaaggccaccgcaatgtgtcccaaggctcggattgtgtggtcgggaatcaagtgagcgtccctacagaaggaagaacagaagcgccctagcaacagtccctccagcatgcagtagtgaaacagtacccagagactacgatctagaccttaatttcataacagtcttgatgcagtgttcatctgaaactgacagcccaggattttaaccacgggcagaaacataagccccaggcactagtctggatgacaaagatctttctcgacttccacacagtggtccaggaagtacaatccaaggtgggcttcaccttaaatcttgtgacaaccctgatacatgcctatgctctgagacaaggagataaggacagaggcatgcatacgcacaatgccaggtgccccacacgagcctgctgagaacaatgggctgcctctgagagacaggaataggggcgtacttgtcgctctcctgagagatgtagagccggttggacaggctggccaagaacgcctccacaatcactgggtccaccgtcaatccagccttcaggcacctgaggagcaagaaaacccatgtggcactgaggcatcaaaccaagataggttttttgttttttaatttttccttccttaggcctacaaagtttaaagaactgctctgaattttcttccccccaaattggaggtcataacacagaatgaattcaaagaattactccagattttgcccacttgataaatgtctcagtcggaaacaataatttcattattttgcccagaacagtttcctttggaatatcatgctcaccctaattccaatttcaatcccttgtactgtttcttaaggtcacagtgactgattccaaagacaaacggtcccaagatagcatagtaaacatcacaattatataccaaggttttcatggtaaggagaaacatttacgttacagagaaaaggggaaaaatttaaagcccctaaaaacataaaatcttgtaagatgtcctagctctccacatctgtttggctcctgggccagagtttggaaaacagtttgagtctgacagacaagctgccatcttgatttagcttctaagggcaaggaaccagaatccagggaaagaagtatttgcatggaaatcagactgtatgtagctctcaagttggaagaacaagagtccacagtgcaggagtctgggcagcaaggggtacctaatcatattttaaaacctcacatttatattaaacattccacagaaaacaaggtaaagaaaatatgatgatacgttactctggatgttgagctaatggataatccttctctttttacttttctatacattacaatttttctctagtaagaatttcttagccaggcacggtggctcacacctgtaatcccagcactttgggaggcacaggtgggcggatcacaaggtcaggagatcaagatcatcctggctaacatggtgaaaccccatctctactaaaaaaaaaaaaaaaatacaaaaaaattagctgggcatggtggcgggcacctgtagtcccagctactccagaggctgaggcaggagaatggcgtgaacccaggaggcggagcttgcagtgagctgagatcgcgccactgcactccagcctgggcgacaaagcaagactctgtctcaaaaaaaaaaaaggaagaatttctttttttttttgagacggagttttgctcttgttgcccaggctggagtgcaatggtacaatctcggctcaccgcaacctccgcctcccgggttcaagtgattctcctgcctcagcctcccgagtagctgggattacaggcacgtgccaccacgcccggctaattttttgtatttgtagtagagacagggtttcaccatattggccaggctggtctcgaactcctgacctcatgatccacctgcctcggcctcccaagtagctgggattacaggcttgagccaccacaccaggcctcttattatgtttatgatcaggaaaagaaaagaagtaacaagaaataattcctctttatagatcaagtgtaggtttaaaataatcagaaacaagctttaaaaaagtataaatgcagccaggcacggtggctcacgcttgtaatcccagcactttgggaggctgaggcaggcggatcacgaggtcacaagtttgagaccagtctggccaacatagtgaaatcccatctctactaaaaatataaaaaattagccaagaatggtggtgtgtgcctgtaatcccagctacctgggaggctgaggcaggagaattgcatgaacccaggaggcagaggttgctgtgagctgagattgcgccattgcactcccgccccaggcaacagtgcaagactgtataaaaaaaaatgtataaatggggtgggtgcagtggctcacacctgtaatcccagcactttgggagaccaaggcaggtggatcacctgaggtcaggagttcgagaccagcctggccaacgtggtgcaaccccatctctactaaaaatacaaaaattagctgggcgtggtggtgggcgcctgtaatcccagctactcgggggaggctgaggcaggaaaatagcttgaacccaggaggcagaggtagcagtgagccgagattgtgccactgcattccagcctgggcaacagagcgagactcaatctcaaaaaagaagtataaatgtctcttattttgtaataacccgcttgtctggagcactgctgtctactcgccacttgcccagcttcccacctgcagatgttgtcaatagcgatgtctcggagctgctcgtacatggagggctggctcttcttacccgacatgacgttcagggttgactcggaatgctcattggtcacactgatttttatatcattgccagcaactgaaagtaaaaaattcaaatatatacctagttaggcctatcattttccatcaccttctttgtaattcaaaaaccaagataatatgctgatcatttataaaagcaaaatgatcactctaaaaacatctgaccaaatatttcagaaagagaagagtctaagagcaacaggaaataatatgtttaaatcaaaaggaagaatattcaagttagaaagtgataaatacagaaaactaccaatttctcaatcaactgttcaaaagtactgatgaccaaccaccaaaggcagctctgagggcgactgaggcatggccctgtgcttggagttacctcactaatatgtacaaagcctggtgagggttagggatgcttgcgggagcaggggccttagagcctgagagaaccctccccactacggggttcagggaagtcttgttttttgtttgtttttgagatagggtcttgctctgtcacccaggccggaatgcagtggcgctatcacagctcactgcatcctcaacctcctgggctcaagccatcctacaacttcagcctcctgagtagctaggactacaggtgagcgccatcacgcctggctaaatctttaaactgctctgactttaagtcttcatctgaaggggaagataaaaacagccaccttcatgagactgtgggtaagagggtgatactacatcagagacactagcacacagcaggtgtttaattaattaatgttaattattgtttcatcatatgtggaaacatcataatccattctcgcaggggtagcagggactgggcccctggctaagtgtttggggcacacaggatttgcatttcagacttccacagtgaaagatgtcaaaaagaaaacaggacttgaaggggcctttggtgtaacaggaatacaggatgagagaaggccggggaagaaaggcctggagcttggaggggacgcaaagggaaagacagaaggaaaggtgtggcgaaggaatgcacccaggtacagtcatgaaacctgtgtgaggctcacacacagtcacagagcccctttctcagggcctgaagggcacatagtctgttattacctgtgtggtactgactgtggtacttgtagagcttcaccagaactggggacgggatgaccaggaagtctcgcaaggacggtgtcacagagtgcaccaccaccgggaacctctcgcacaggcggcccaaaccctgcaacacaccatcaacctgtcacatggcctgtggtatgggaccatctgagtaggccctgagcagggaggtgctcaacccttcagtacccaagtctgacccaaaacttcgaaggtcaaagctcccacaggccacctgcccaggacataaaaagatggaagcgatggtgctgactctcctccacctataggggacatcaactactatttttttgttttgtttttgagacagggtctcgctgtcgcccaggctggagtgcagtggcacgatcatggcttactgcagccttgacttactgggcttaagcaatcctcccacctcagcctcctgagtagctgggactgtaggcacacaccatcatccctaactaattctaattttttaaattttttgtgcagacggagtctcactatgttgcccaggttgggctcaagcgatcctcccacctctgcctcccaaagtatcgggattacaggagtgagcaaccgtacctggccaggggatatagattgttaaagtgtgctcatctcttttggaagcatactaaagaagaaagggacaaaatataatttttaaacaatggcaggtgtggagtcagtgggattgtgacaaggttaagagtctcggcagagcagagctagcactgtgggtgtcaggagacatccccttgcgtggccccatggcacatgtccacagtccttcccccacaggccttgggaatggcccccagcctcacaacaacggagaactgaagccagctgcacccatatgccactgacagaaagccctggcatcctgcagggggcagcccacactcagtgatgaactgtgcacagcacgcactggttaaagctcctaaagacagaaccggcagggtctccgctgctggtgtgcccaccacagcctgaacagcaacagcgtgacaagagggaggccctacaggtgggatctgagcctctctgggttcagggagactgacctgcagacagcagatcagcaggggcaagtgagcaataatgactttgctggacgtcttggactgcagcttctcagatagcttgatgcaaaggttttctgcaccttaattcaaaaccagaagaggagatgagtgatcagcacaggccagtctttctaacacacttatccaccaagtaagcacagaatttaataaaaccccagagacatactttaggcagggcttattcatactgagaggtcacacagtgtgtgacactctctctctcttctccgctggccctaagcccccttgtccccgcagtgttcattccacagaaaacttcccattctactcctcccccagaaaaacacttcacctgaaggcactgagcttccatgtcaccacagaaaagcctaaagaaccagcaagatgcagcagagagcatacacaggccctgaggccacgggcatccccatcctcccaggtccagtgccctccatgcaggacaggacaccagacgtgcagagcacagcaggggctaatgctccactctgcacgtgcccaggaggcctactgcaactgcctgtgctggtaacagagccaagtgttctagaagtagtttggggaaacttgtggcaagaaagcctctgggtcatgcctggagctcacatgagaggcaaggcagtctgtctcaccctgctcgtccttcacagcccacaccatgaggtccacacaggcagcattcgcctgacagcgcagtttgagggggctcagctcattgtggatccggtctgcgtcatgtagaatcttctggagctccccctggctcgtgttgaactgctccagcacaaaatcatggatctccttcacaaaagaggtcgggaggtctgtaggaaagagtgtggcatcacagctgggaacaaaactacagtagaacacaggcagtgctagcagcggctacagtcttccccttttaacaaaaaccccagaaaagtagcatttgctactggccactgtgggtcctagaatgcccactggaaagaagttggataggaattgcacagctgtcctccacgtgcacacaacctggcaatcagaggaaatgatcatttcccagggatgttacagccatgctttgttttaagcagtcaacgtactaaaacctgaatacatgaaacatataaattgggaagtatcgttgctggaactacttccactgacaatatgagatacttctgtgatttttttttcttttaagaaagaggttgtcagggccaggcgcggtggctcacgcctgtaatctcagcaacttgggaggccgaggcgggcagatcatgaggtcaggagatcgagaccatcctggctaacacggtgaaaccccatctctaataaaaatacaaaaaattagccgggcgtggtggtgggcgcctgtagtcccagctactcgggaggctgaggcaggagaatggcgtcaacccgggaggcggagcttgcagtgagccaagatcgtgccactgcattccagcgtgggcgacagagcgagactcccatctcaaaaaaaaaaaaaaaaagaaagaaaaaggttgtcagataagggcaaaaactggttgcagccttgagaagagaattatctggatcttcagagcactcaccctgagtttgagagacttttcaaactctcatccccagggcctggaaaattcaggagaaccaccatgatgcacgcacaagtcagcccagccaaggcagccagcaacacacagcaggggtggtggggagggcaggggtaatccctgatgccccttcttagggagtttcaacccttgccgtggcccagatgactcagcttctgaggaatgttcagaatcagattaggaaagtggttactaaattttggtataccttcctgacaaaatattatgtgctcatcaaaacttaagcttacgaagaacactcaacagtgtgaggggagagcataggaaaaacattttgtaaaatgcataaaagattgtttcctcacttctgggaaaaacaaaattcatgaaagagggactagaagaaaatgctaaattgttgtgtgtgcatgttaactattaagctattgtctcaggttgggtgcagtggctaacacctgtaatcccagcactttgggaggccaaggtgggtggatcatttgaggccaggagttcaagaccagcctggccaacatggtaaaaccccatctctactaaaaatacaaaaattaggcagacgtggtggcacatgcctgtaatcccagctacttgggaggctgaggcacgagagaattgcttgagcctgggaggcagaagttgcagtgaccccagatcatgccaatgcactccagcctgggcgacagggaaagactctgtctgaaaaaaaaagctagtacctctacattaacagattacatgtattacaagtacttcattttcttttttttaatgtttttgagatggagtcttactctgtcacataggctggagtgcagtggcacgatctgggctcactgcaacctccgcctcccaagttcaagcgattctcctgcctcagcctcctgtgtagctgggattacaggtgcatgccactgcgcctggctaatttcttttgtatttttagtagagacagggtttcaccctgtttggcaaggctggtctcgaactcctgaccttaagtgatcagcccaccttgtcctcccaaagtgctgggattatacgcataagccactgtgcctggcctcttttttaattttttaaactatctaaatggatatgtaaaactgtatctgtccttaggacaatataacatgcacattttagataaacaccttaggaaataaactcagcaaaggagccatcatcgatggtaccggggttgcaggatcatggacagattttttaaatttgcttttttcccaaaatttcagtaacatgaccactttgctcatatgtgtttttcagtggccccagcagaaagtgagtaccagtctgcaaccactagcatgcgacagtggcctgggagccagtcttgctgtactcacaaacacatgggcaaactgtcctcacccttcatgtagtacagagtgtcacgcagcatcttgaacatggtcaggtagagagggtcactgaaggaagtgtagtagagatcagcactggggttggcctgcagggaaggcagacacacatgactatagaacagaaatgcccttctgcccaccctttgccttcacagcaaggcccagcggaatggtgattcgtgacttagcattctaaatgaagcaactgtttatcatgactcatcacttggacactctactgtcttcatcctcttaagcatcagaccaaggaaaacaggaggctcatgcagtccagagatgcctgcgggggagcagccatctgcaccctagtaggaagaacctccttgctgtggctgaagctcaccatctttggccatcattggcccagacagggacatgggaagtggtgaaggaggaagactgacaaaggccaccagagtaagggatccacactgtccatcatcccaaggatacaaattacagccaggacaccttcagatacaacttatgttttgtaattaaaactcattttaaattattctttaggaatctatttgaaatgtagcactattcttcttctgaaaaaaaaaaaaaaattcacacaaggtctaatgagttaagaaagataatagtccagcccgggtgtggtggctcacgcctgtaatcccagcatttggggaggccaaggagggtggatcacctgaggtcgggagtttgagaccagcctgaccaacatggagaaaccctgtctctactaaaaatacaaaattagctgggcgtggtggtacatgactgtaatcccagctacttgggaggctgaggcaggagaattgcttgaacctgaaaggcagaggttgtggtgagcagagatcgcgccattgcactccagcctgggcaacaagaacaaaactctgtctcaaaaaaaaaaaaaggctgggtgcagtggctctcgcctgtaatcccagcactttgggaggccaaggcgggtggatcacgagatcaggagttcaggagttcaagaccagcctgtccaacatggtgacaccctgtctcttctaaaaatacaaaaaattagccgggcgtggtggcgtgcacctgtaatcccagctactaaggaggctgaggcagaattgctttgacctgggaggcggagcttgcagtgagccaagatcacgccactgcactccagcctgggtgacagagtgagactccgtctcaaaaaaaaaaaaaaaaagataacagtccttaacttctatatactcctagttgagtaggatggaaaattatggtttatcataactcgtttttttcatttttttttttagagatagggtctcactctgtaccccaggctggaatgcagtggtatgatcacagctcactgcagccttgaactcctgggctcaagtgatcctcctgcctcagcctcctgagtagcagggactacaggcatgtaccaccatgcccagctaatattataattcttgacaagtataaaagtggtctgcaaatatagcaaatctttaaggcgccagaagttggccagagtgggatagggcatgcagtgtgaggttgacagagggtgagtgagcaggtggagaaaaaaagaatcatgtggagagtgtgagagtcatgccaattcccaggaggacactgacaggaagagctgtggttgacagcactgcaatgatggctttacagacaacgtctggtggtcctcacagggcagaaatggagaaatgagactgggagaggttaaagcagttcagggctttgactctgggagtccagacaacacgagtgttaaactttggagccttggagaccaaccatcttacaagcccacagcccagctccatcactcacgagctatgtaaataaagttcctgagctaagcctcagtttccccatatgtaaactggggattgttgtgagattcaaggagtgagtgagtaaagttctggcacataataagcatgtaataattggtagtggttattacactgattatggatactgagtaatatattgcagactctaggtcaagattacaagaaacttttttttttttagctatgaaactgtttcttcaaatggatgtttatgctaaagaacaaattacaaaacaaaaaataccagaaactgccctggttcaatgagaaggagggtcccagaggtggagtgcaggcccactaagtctccacttgtctaactgcccagcccagctctcgccctggtcctcctggtctgccctcagtcacaaatgatcaaacacttatgatggaaaaccaaaggtctctgagaccacaagctcagtctatagtgagtgagtgagagagttaaagctcaggccaatgggcagaacgacaacctgaaaaagggttggagacaaggtaggaactgcccagatgcaacttggggagttataagaactctgttacttaaccaagaaccaacccagaccaaaccacggccagcacatacatctcacatctgcaatagctcgttggcaggggtacgaagcaggaagagacatggtctacagcacatgaagggccctggtagttccttccctgcttcatacctgagccccaggtacagtggtatcaggcactgtgtgtcttaaaatcaggtgagagaaggaacaccaggcttcaataaggaatctgggtcagggacatacccatggtaataattagcctggcaaatgacaacctgtctgcatcctaaccctcaagaggggcctgacccaaatgttccccgagatttttgagacctcccagcaccaatgtaatgatttcataaataatgctgtaggccttggttccaaatacattaaagacaagagttccagccgggcatggtggctcacgcctgtaatcccagcactttgggaggcagaggcaggcagatcacgaggtcaggagattgagaccatcctggctaacacggtaaaacccagtctctactaaaaaatacaaaaaaagttagctgggtgtggtggagggtgcctgtagtcccagctacttaggaagcggaggtaggagaatggcgtgaacctgggaggcagagcttgcagtgagccgagattgcgccactgcactccagcctgggcgacagagcgagactccatctcaaaaaaaaaaaaaaagttccctagttacgcaccccttacacttaaaaaccaggacttgcatacgcctagaaaagtgtagctctgagcccagaggagcagctttggaagcaccaaaggagtgaggaagataaaagagtaggagagacccaggccagactcccagctcccacagtaactatgtgatgtgggcacgttagtgagttctcactaaaactctatcttctgtctgtaatgccaccagtcagaggcaccctgaggtgacgtatttaaaagagcatgcaacggtacctaccacagaccaagccctccgcggcaggtggattgttaccacatgaacaaggaaagtgaaaacactgcaaaaccccttccactccagcccccgctcaaactcttcctgctttctctacacacgtttaagtcaggctgatctcatggtaatgccctcagaagcgacatacctccatcacactggctacaatggcatccaaagatttgagaacagcctcctcaacgatcttcttcacctaccaaggaaacagaacctcatgaagcaactgacatacacagagacaggaatgctagctccttctaccgaaaacccatgacaaactcacatggtgaaaaatgtgatgcagataaaggccaataaatacaaattatggctatgtatcaaactatatgcacaaaatgcctttaattctgaagtcacttgggactgcttttctaccttagatagcaatgacataaaaacaaaggaaaaaggccaaactccctcagatttgttgacctgagatttctgtttccaggatgtgcagacctcaggccttgctgccatttcacccactcatggttaacaggcacagttgtgtgacatcctcttgcaatcccctcccagacatcaaggacaccctcacagccagtccttggagctcatggcacctccttcctctccgggccaggtgcactggctcttctacaactgcttaggtactcaaactagagctcatattttaaattttcaatagaagcaattattttcaccagttatctgtacagtatttagtgtaggaatgaattgttctgtcaactgcagaaccacaaaaaaaaaaaaaaaactgcccacatccacaattgtagtatttgatgaaagtcatttccaaaatgtatagataatgataaacatcctaggaaaagaaatgaaaaaccgcctaaaagaaaacctaggccagccgtggtggctcacgcctgtaatcccagcactttaggaggccgaggcaggcggataatgaggtcaggagatcgagaccatcctggctaacaaggtgaaaccctgtttctactaaaaatacaaaaacttagccgggcgtggtggtggtcacctggagtcccagctactcaggaggctgagggaggagaatggcgtgaacctgggaggcggagcttgcagtgagccgagatcgtgccactgcactccagcttgggcgacagggcgagactccatctcaaaaaaaaaaaaaaaaaaaagaaaacctaaacttgaagaaagttaaaagttaaaatatactgcaaaaaataataccccaagaaaggatgtgaaacagtcagtcttcagttagaatttctgacatggtactgggaacagccatctgtgaaggtcatggctctaccaggccaccattctatctggggcactgacactgagaagcagtttaggtagttttccttcttgacagcaacttcaaaaacatcctagcctatttagtaattcattatggttccatcctcattaattattacctatgttgtaatgtcttcttacatcttcagcctgaagccattctctgagggatttctattcacactccacacagcagggaggtggccactcctcagcacatgctccatgctatccaaattgttctcatttccaagacagcaagcccaatcttgagagtctggccttgatgacatcatcacccgtacctattcaaatctgtcttgaaccatcctagcttgattgtaacaacttcagggcccctggatctttattttgtaattttttttgagatggagtctcactctgttgcccaggctggagtgcagtgctgcgatgttgactactgcaacctccacctccaaggttcaagcgatcctcctaactctgcctcctgagtagctgggattacagggatccactaccatgtacagctaaagttttgtgttttttagtagagatgggatttcaccatgttggccaggctagtctcgaactcctgacctcaagtgatccgcccactttggcctcccaaagttgggattactggcatgagccacggcgtccaaccagggtccctgaatctgaccaaagctctggccatttaaggaatcgaacaatggccctggtgttttctctggtatcaccctcaatgtcatccaaaggtacccaaatatgaaaaagtcaggttttgttattaacccaaatagagccaccccttagaggaagtcaagcccaggaaaagcactggacttggagtcagaatccctggactggatgcagcccagctgctggcctacatatccatgacgtgtttgacaccgatttcctgacctccaaatggggatgcatgggtgcctccccaacatggttgctcaagaatgaaatgagaaaccagtatacaatgattccatgaatgttactctacttccttcattaatctgcaagtttatgactattaaattgtactttgaaatactggtactctgagtttttcttttaaaaatacaagtttcaccactagcaattttactgacatatccatggtctgttcatccatcagttctttgcttaccaggtttaagagttcccgaagcatttccaatggaatgttaaactccttatatgtgacaccgttgaaaaggggagagactgagaagctggagctgatggttgaaaagtagtactcaggctctagggcagtcccatcgggcaagcaggaggctggtgggagataaagctggaaactcagccgtggtgacaggcaactagggtacttcctcaagctgactcccccaataaccaacaaaggtgcagattttgcctttatttatatcccaattctctgcatgtttttaaattaacaactacagggtagattgcaaatccttggggactgatgcccctcacctgtgtctttcaggtcaaagactcagatatgatggtcctaatatttccatcttagacaatataacttagtatgtgggaagtgaaaaaagaattgtatcttttttatttttatttttatttttttgagacagagtctcgctctgttgcccaggctggagtgcagcagtgtgatctcagctcactgcaacctctgcctcccaggttcaagcaattctcctgcctcagccttccgagtagctggaataacagatgcccgtcgccacacctaggtaattttcgtatttttagtagagatggcgtttcgccatgttggccaggctagtctcgaactcctgacctcaagtgatccacctgtctcggcctcccaaagtgctgggattacaggcgtgagccaccatgcccagcagaaatacacctttttaaaggtgaagagatatgaaagcttggggtccacagggcctcagagatattttctcaccaaaattagaaaaaaaaatgcacactactagaagtttcaaagtcagagcaactaagtgaaatacacctgtcactaaaagacaaatactgtacgatcccacttattagaggaacttaaatcatacatagaggtagaatggtagctatcagtgactgggggaaggggaaatggggaataattgatgtatagtttcagtttcacgagatgaaaagagtttttgagatgaattgtagtgatagttgcacaatattataaatgtattcaatactactaaactatacactttaaaataattaaggccaagcatggtggctcatgcctataaacccagagttttcgaaggctgaggtgggaggattgcttgagtccaggaattcaagaccagcctgggcaatatagggagatcctgtctctacaaaaaataaaaattagccggatacagcaccatgggcctatagtcccagctactcaggaagctggagcaggagggttgcttgagcctgggaggtcgaggctacagtggagctatgaatttgtcactgcactccagtctgggtaacagagtaaaatcctgtattaaaaaaaaaaaatgacatagcaaattttatgttatgtgtattttaccacaataaaaaaaaaagaaggaaaaaaatcaacaaaaataaagtcattcagtcatttgacatttaataaatataaacccagacccaatgcagtggctcacacatgtaatcccagcactttgggaggctgaggtgggaagatcgcctcatcccaggagtttgagaccagcctgggcaacacgacgagaccctgtctctacataaataaaattattttaaattaaaatagaaatatagtaaataggaacccaaaagcatataattgtttgaaaatccattatttagaaactataatagaaaactatgaggccaggtgtggtggctcacgcctgtaatcccagtactttgggaggccgaggcgggtggatcacaaggtcaagagattgagaccatcctggcaaacatggtgaaacgctgtccctactaaaaatacaaaaattagctgggcgtggtggcacgtgcctgtaatcccagctacttgggaggctgaggcaggaaaactgcttaagcccgggaggctgaggttgcagtgagccaagattgcaccactgcactccattctggtgacagtaggagactgcgtctcaaaaaaaaaaaaaaaaaaaaacaaatcaaaacaaacaaacaaaaaactatgattgaaaaacagatgaatttgtaatattttcataagacagtatcaattcataaagaagtgaatactaaattttatgactttttcaagcactagagaacagactcaaagagtttagtttagctccagttgtgtcaaagctggtatctcacagctggcagcacactgccaatctgtctaaagaggacgcaaaccagcaacttacagcagaaaggatgggcaacaataccactgggagctgagacgccaagaggccaacataagaaatggccactgaaagagggaacaagtaaggaaagaagggagggagaaacagccggattaaaaagggtagatgagggagaagggaaggttgtgattatcgggcacttctcagaaagacaccatgaaatatgggctaagtcctgtgtggctgaaccccacagaggacacagatgatggcaaacgacaggggctgcaggaactagggacctaacatttgggatttacgcagggggtgtcattgaaacttcttttttttttttcctgtgagacaagagtctcactctgttgcccaggctgcagtgcagtgtcacgatgtctgctcaccgcaacctgcgtctcccaggttcaagtgattctcatgtctcagtctcctgagtagctgggattataggtgtgagccactgcacccggctaatttttgtatttttagtagagatcgggttttgccatgttggccaggctggtctcgaactcctagtctcaagtgatccacctgtcccaaagtgctgggattacaggtgtcagccactgtgcccaacctgaaagtttttaagcaggaaaagaagtgatcaaatttgcgctattaaaaataattcttatttattttttattttatttagtttttaagggtctcactatgttgcccaggctagtctcaaactcctaggctcaagcaatcctcctacatgggcctcccaaggtgctgtgattacaggcgtgagccacatctcctggcctaaaaacaattcttaaaaactaaattcttacagcagtttggaagagggcctgggaagggagatagaaggaccggctgtaagaaaagtcttagtatgtggtgttgtatacctgaagtcccagctacttgaaagggcaaggccagaggatcattatgactgcacccctgcactccagcctgggtgacagagcaggaccccaactcaaaaaaaagaaaaagtccaagtaaaacaggtagtttgagaggaaactcagaaggcacagggtctgctgctgtctgtcctacagtgaggcatttcagagagcagggctcgcttgtctcgtcaccactacaggcaaagtgggcggcagccaagtctgatggagtgatacgtggggatctcgcagtcagccacattagtgtgctcccatctgccacttactggatgtgctcaaagtggggcagcggtcatggagaggagccctcaccacagagggtggacaatgagctgtttaccaggaaaagggaagcctccaagggcacatcatggccatcctaaaatgccccaaaggcaggcaggtggcagtgagattttcagagcctggaggaatacattctatacttaaacaaggagttgtctctaagaggtgcgattctgagtggctgaaattagctcttatattctaacacatatatagaatgtaacctgttacattctcacagatctaagagatggaaagcttcctacatttatgtaagcccagatattccctttttccttcaaaattcccctcacatctctcgaaactgtcttgagacatgctcttttaacaaatagcattattcaaaaaaggagagactatactgaagcatggaattctgccttccccatttgctgtcccttaatctgggtcttacttccatcaagtaaggtagaaataattttaacatgtgtctgacatggcacagggtagtcacatgaatccaattcagtaaattatgtaaaagtactttgtgaacagcagagctctataaaaagtagtaatgggctgggtatggtggttcacggctgtaatcctagcactttgagagaccaaggcaggcgttcccttgagcctaggagttccggaccagcctgggcaacatggcaaaaccccatctctacaaaaaatacacaagttagtgggcgttgtggagggtgcctatagtcctagctacttgggaggctgaggtgggaggatcacttgagcccagaaggttgaagctgcggtgagccatgatcatgccgctgcactccagcctgggtggcagagtgagactctctctccaaaaaaaaaaaaaaaaaaaaaaaaaaaaaaaaaaaaaagtagtaacagtagtattactacattctttaatattatctacatacttaatgtcattaaaaaaaaatgtccagccaggtgtggtggctcatgcatgtaatcctagcactctggaaggaagaaatgggtggatcacttgaggtcaggagttcaagacaagcctggccaccatggtgaaaccctgtctctactaaaaatacaaaaattagctgagcatgctggtgtgtgcctgtaatcccagctacttgggaggctgaggcaagagaattgcttgaacccaggaggcagggcctgcagtgagccgagactacaccactgcgctccaacctgggcaacagagccagactctatctcagaaaaagaaaagaaatatccaccattagtacttccacctgaaaagaacttttacaagttaaagtgcaaaaattctgatggcaggtatataggggtctgtaagttattttctgtacttttctctctaaataaaatatttgaaaattaaatgtacttttctctatatataaaatatttgaaaattaaattttaagaaacttaaatgaaaacagaaaataaatgcttcctaaaagcttggcactctaggtccatccatgacaacagagttagtatcagcatccttaatatcacgagaagtcactgtgagcctgttctccaagtattacgtcaaaatattcttcggaaaggtgaagcccaccttcaaagtagtgaaaggcagatcctccaggggaactgggagggggcatgccgcgttcagggctgacctgaaacacacaaccacagttacatatcagaaaagaccagtgagacctccatcagatttgtcttagacaaggtcctctctgccagcccaatgtttgtacttcaagttctggttgaagcctcatttccttcctaaagcccatcacagctacagcattctctactacatgctatatcactaaattctttgtgtttagccgtatatttgacacttgattactgagctgaattgtcctcagtgttttgtgtttttgtcttttctccatgagtcaattatatacttcttaagggcaccaactgtcttccaggcaaaatagcatttggcacccaactgctatgaaacatatactttatgactatgaaatcacttataaatcttatgttggggactagcctcaacaccacctgtagggtatttgatgtttggtggcgacaaaggaatgagaagaaacaggttaagagtttataaaggcgggagccaggggaccagagcaaatcagaggccgcaaaggcctagagttttggtttttacactatttattgagtataatcacttagatttaagaagcagatgtttagggcgaaacggtgaaagggaggcagtgtgtcatatgtgtaatctatagtagcggcagtttaaatgaattttttttgtgtttaaacagtatattttcaacttattggacagcagttagtgggagcaggcttaactaggagtctgtatgtttggccatattttcatgttttaaaggagtggtttttttttttttaacacagtgtttatggataagagagtaagtcttgctcagagtatgggaacataatggcgataaggctttttttttagaggccttttgtggctttttacacctcattgttttatatttttatggccagtttatatgtgcactctataagcccttccccccaacatcttaagagggacaagacaagtctttgtattaaagagaattctagtgaaacatttcacgttacttaagtttactccaactacaaagaagagggattttcttcgcaggggagcttaacagggtctttctcctctgctctttccccagtagcccaggcccacctgagagatgctggacacactgctggttttcctcttcagggtaccctcctgacagacagtcagcagattgctggggaggatggagcggaagtcattaaaggaacgccttcgaacaccttcaagctcttccaggacacggagggaatgaggagggattttgggaaagagctttgagaggagagactcttccatgttgctgtaacgcccaaatgctcgcgagattcctatcaggcatgggatagcatacttgcaaaggtattctagaagatcaagtgaaaacgttacaatataagaaagtatcctgatagagtcatatagtaagtactaacttgtaacattgactaagatttcacaacccacccactaataactgtgaaggttcacaataagccacaataatggggtccaccccaagggctgacaagtgatatcttcaacctgtcattaacaacttcagactatgacttcaatacacccagctgccctgcttggaaggtcttcatctattcatggcacacccaaatcaataaaatagctaggccatattatcaagtaccttatacatttattcctcttaggagcatattggtagcctcacaacacagaaaaaatgacctttggaagtcaactaatctacccacagatgttacaggtgaagaaactggggcccagaagggtgaagttacttgtccaaggtgacccagcgtctatgtagcagagcaatgcacatgaccccatgtggcctctgaggatactaacacacaacaaatcaaactaaaataggaaggttttctcccatcatatatattaggtacccaacaacagaaaagactggagaaaagcaagggaaagagtaaccacaaaaccattttaagaaaaaccttaaggatactcgtacctttgtcttgaatctccaaggcctggcacatccccaagaggacatgcaaaacctgcaaaagcacctctaaaatctgtaacagtcaaggaaacaagaaaaaaaaaacataaacaaaattaggtaaatatcacgaaactaagtcagaattagaaggcacttcagacattatcttaaccaaccccatatatgatacatccctccacaacgactgtgccaagtggccaaccagctgactttccagggacaaaaccctcactctctgggctggttccgagttcctcccaatactgggccaatgttgtcctcctggggcttgtacctaccagcccttggggctgctttttcctctattaacatattctgtaaacaggtgatgggtccccaaatcttctcttttcatgggtaaacgccctagcgcttttcaaccgtattcttcatgatcataaatcctttgtaatgctaattgccagcttctgattttacggtagtccagttttctgtctggaagtgtagtgctcagaataaaatacattaacatctgggatgctggaactcacccagcatactcaccaaactcatcacagattctacacttctatgtatgtgacattagcttttctgcagccacttcacactgcttatgtgaagctcatctcaatgagcttatacataatttttaaattttttttatttgtttgagacgaagtttcgctcttgttgcccaggctggagtgcagtggcatgatcttggcttactgcaacctccacctcccaggttcaagcgattctcctgactcagtctcctgagtagctaagattacaggtgcatgccaccatgcctggctaattttttgtatttttagtacagacagggtttcaccatgttagccgggctggtctcgaactcctgacctcaggtgatccacctgccttggcctcgcaaagtgctgagattataggcgtgagccactgcgcccagtccataattatttaagttaagaaatttttttttgttcctggaagggtggcttatgcctataatcccagcacttttgtttgtttgtttgttttgaggcgcggtttcactcttgttgcccaggctgcagtgcaatggcatgtctcggctcaccacaacctccgcctcctgggttcaagcgattctcctgcctcagcctccttagcagctgggattgcaggcatgcaccaccacgcctggctaattttttatttttagtagagacggggtttctccatgttggttagtctggtctcaaactcccaacctcaggtgatcgatccacccacctcggcctcccaaggtactgggattataggcatgagccactgtgcccagccaatcccagcactttgggaggctgaagcgggtggatcagttgagctcaggagttcagacctgcctgggcaaagtagcaaaaccctgtctctacaaaacatacaaaaattagccaggtgtggtggtgcgtgcctgtggtcaggaggctgacgtgtgagggtcacttgagcccaggaggccgaggatatagtgagccaagaacagtgcaggggttcaatgatagctcactgtagcctcaaactcctggactcaagcaatcctcctgcctcagcctcctaagtagctgggattacaggcatgtgtcactatgcccagctaatttttatttttatttttgtagggataggttttgctatgctgcccaagctagtctcaaattcccgggctcaagtgatcctcctgcctcagcctcccagaatgttgggattacaggcgtgagccaccatccatgacaataagcttatagatgaggaagatacctaagtcttctttcgcacctgcttctcctgaactatgtaatctctactaacgtagttggtattttttatctttcatctacccctacaaaaactcatggtattagctttagctcactgtacaaatctgtgattcccagctttgtgccttctccaaatgaaatcaacttgctttccagatcttcattcacagcactagcttgttttgctccaatgacaggagggtcctgctaggccgatacctcactgatcaccctttgggacagtccttcaggcagttctgcaaaccctccaaaccatttggccctcagcccatataactggtccaggatgtcaggaaaggtgcttgtccaaagcatttatgaagatccactagaatgcagcaacttcatttctctcaaccattcttcttagaaaacccaggcaaagaaaaaatgaagttggtgtgacatgacttgttcataaccaagtcaaatctcttacattttcctaatattaagtaatgctgaataatctacaaaagcttgaaaagcaatagtttttccattttatttatttattttgagaccgagtctcactctgttatccaggctggagtgcaatggcatgatctcagctcactgcaacctctgcctcccaggttcaagtgattctcatgcctcagcctcccgagtagctaggattacaggctcctgccaccacgcccggctaatttttatatttttagtagagatggggtttcttcatgttggccaggctggtctcaaactcctgacctcaggtgatccacccgcctcagcatcccaaagtgctaggattacaagcctgagccaccgcacccagccactttttccattttatatgttaaagtcatgttatcacctttggtgttgacctctttattctgataaattttattcatagaaaaaagcccttaatgtccaactttttaataaaaacacattattctaacatatttaagtatttctttagccaacctacaaataaatgaagaatctaaattagtcaaaatacatcactaactgggaacatttagaatgcagacaagcaactaggcactgtttggaagaacctaggaacagcagcatacaaaaactaactttctaagcgataaatttaagaaaaagttgtatgattacattctttgtttaaagaacaggaaagtatgaaatacatgtttgtaacatttctatcaaaattaacaaaatctaaagaaagtctgtgcccttaaagataaaagcttcagctacctagaagattctcttctagctgggcacagtggctcacacctataatcccagcactctgggaggtcgaggcagaaggatcacttgaggcccggagttcaagaccagcctgggcaacatggcgaaaccttgtctctacaaaaaatacaaaacaaattagctggcatgatggtgcacgcctatagtctcagctacttgggagtcttaggagggaggctggcttgaggtggacggcagaggttgcagtgagccaagattgcaccactgcactccagcctggatgacagagcaagactgcctcaaaaaaagaaaagaaaatgatcttctatgaatgacttcaatccccaacaaagagcaagaaaaatgagctgcctctgcctttttctgccgcctaccttaaaggactttctgaaaagctgaaagggatagtgctgctcatgtctctgcagcccctgcccttcattagaaaaaagaaaaaaaaaaaaagaaaagtttaataagataagactcgagatcctaaagagtagtgaaagacctaagcatgtcttaggtctgctgtcaacaggatgaaatagataaatatcaacaaacaattcaatcacatttcacgtttttaaaatcttttcatcactttgggactctattcaatctaatagaaatgcataccaaatcaaccaacacatgcttacctcatccctaagtgaaggatccctataggccacatcagacagcagagttaccaagcagaagctgaagctctctgcaaccgggagggcacctggaagatgtaaaaacataaatcagataaccaggaaccagatactgggtcacacctctggccatccaattcaatatgttccctctcaccatgacctgccaagggaccagtttacagcagctgccctccttgagacgagtctcaaaagaacagctatgggcccaatgagtttgctgagaaacacccttacctttcctttaagtaaatgttttggttcaataaacttaaatgtttcctgagccaatagctagtgtgagataacaaagcctctcaacatgacagattcaattttttattccctaagtaaatgtgataaatcacacacacacacacacacacacacacacacacacacacacacacacaaaacactcggctgggcgaagtggctcaagtctgtaatcccagcacttttggggggccaaggcagacggatcacctgaggtcgagttcaagaccagcctggccaacatggtgaaaccccgtctctactaaaaatacaaaaattagctgggtgtggtggcgcacacctgtaatcccagccacttgggaggctgagacaggagaatagctcgaagccaggaagtggaggttccagtgagccgagatcgcaccactgtactccagcctgggtgacagaatgagacgccatctcaaaaaaaaaaaaaaaaatcaattttgaatattgaatgttgaatcaaggaaaaaagagtatccactatttaatagctatattcatagtacatgacagaagacttacatttctactccagcacttaaaattttaaagtgcagctctaggctgttctcaaacttgaatgtgcccatgcccggcctaaaatttgaccttttagtaatgatgctctatttaatttgtagtccatcaaattgcaggacagactgggtgcagtggctcatgcctatagtcctagcactttaggaggccaaagcaggcagatcacttgaggccaggagttcaagaccagcccagccaacatggcaaaatactatctctaccgaaaatacaaaaattagccaggcatggtgatgcatgcctgtaatcccaggtacttgggaggctgaggcacgagaattgcttgaacccaggaggtggaggttgcagtgaaccgaggtcaggccactgcactacagcttggagtgcagacagagtgagactgtctcaaaaaaacaaaaaacaaacaaaatcctaacaaattgcaggtacatgcataatttgggatctgtcagttttaggcatgttaccagaaatgatgaaaacccaaaggttaagaggaatactggcacaaacagaatgttttttaatttttatttcaggttcaggggtacatacgcagttttgttatacaggtaaactgcatgttacgggggtttggtgtacagattatttcatcatccccgtaataagcatagtacccagaaagtagttttcccatcctcaccttcctcctattctccactcttaagtaggccccagtgtctgctgttcccttctgtgttcatatgtactcgaagtttagctcccacttacaagtgagaacatgcagcgtttggtttcctgttgctgtgctaattctcccataacggtctccagctccatccatgttgctacaaaagacgtgatcttggccaggtatggtggcctcacacttgtaatcccagcactttgggaggctgaggcaggcaaataacttgaggccaggagttcgagaccagcctagccaacacggcaaaactccatctccactataaatataaaaattagccgggtgtagtggcacatgcctataatcccagctacttgggaggctgagacaggagaatcgctcgaacctgggaggcgagggttgcagtgagcagagatcgcaccactgcactccaagctgggtgacagagcgagatcgtctcaaaaaaagataaaataaaataaaaaataaaaggacataatctttttctttttttatggctacacagtactccacggtacacatacgacattttctttatccagtcttccactgatgggcatttaggttgattccttatctttgttattgtgaatactgctgtaataaacatacttacgcatgcatctttacagtagaatgatttacattcctttgagtatatacccaataatgggattgctgggtcaaatggtaatcctgttttaaattctttcagaaattgccaaactgcattccacaatggctgaactaatttacattcacaccagcagtgtgtaagtgttcccttttctctacaacctcaccagcatctgttatttcttgactttttaataatagccattctgactggtgtgagatggtatctcattgcaattttgatttgcatttctctgattattagcatcagatgatgagcatatttttcatatatttttggccacttgtatgtcttcttttgagaagtatctattcgtccttggctcaccttttaacggggttttttttttgtttgtaaatttaagttcctcatagattctggactttagacctttgcatagtttgcaaatattttctttcattcagtagggtggctgtttactctcttgacagtttattttactgtgcagaagctctttagtttaattaggtcccatttgtcaatttttgtttttgctgcaattgcttttggcatctttgtcattaaatttttgccattaaatctttgccagggtctatgtccagagtggtatttcctagtatcttccagggtgtttatagtttaaggttttacatctagatctttaatccatcttcagttgatttttgtataaggtgtaagtaaggggtctagttccaatcttccgaatatagctagccagttatcctagcgccatttattgagcagggagtcctttccccattacttgttttgttgactctgttgaagatcagatggttccaggtgtgcagcattatttctgggctctctattctatttgtctatgtgctattttttttaccagtaccatgctgttttggttactgtagccctgtagtagaggtgaagtttgaagttgggtaatgtgatgtctccagctttactctttttcagactaccttagttattcaggctcttttttggttccataaaaattttaaaatagtttttttctaattctgtgaagaatgtcattggtagtttgataggaatagcactgaatccataaattgctctgggtagtatggccatgttaacaatattgattcttcctatctatgagcatgggatgtttttccatttgtttgtgtaagctctgatttctttcagcagtattttgtaattcttgctatagagatttttcacctccctggttagctgtattccaaggtattttatcttttcttttttttgagatggagtctcactctgtcgcccaggctggagggcagtggcacaatcgcggctcactgcaacctccgcctcccaggttcaagcgattctcctgcctcagcctcccaagtagctgggattacaggcgtgcactaccatgcccagctaatttttgtgtttttagcagagatgggtttcaccatgttggccaggctggtgtcgaactcctgacctcaagtgatccacctgcctcggcctcccaaagtgctgggattacagtcgtgagccactatgcccgactggtattttattatttttgtgaatattgtgaatgggactgtgttcttgatttggctctcagcttggatgttgttggtgtataggaatgcttctgatttttgtacattgattttgtatcctgaaactttgctgaagttgtttatcagatcaaggggctttgggcagagactatagggttttctaggtataaaatcatataatctatgaaaagagatcgtttgacttcctctcttcctatctggatgccttttatttctttctcttgcctgattgctctggccaggacttccagaactatgctggataggagaggtgagagagggcatctttgtcttgttctggttttcaaggggaatgcttcgagcttttgaccatacagtataatgatggctatgggtttgtcatagatggctattattactttgaagtatgttccttcaatgcctagagtttgttgtggatttttttggggtttttttttgagacagagtcttgctctgttgccagattggagtgcggtggcgtgatctcggctcactgcaacctctgcctcccgggttcaagcgattctcctgcctcagcctcccgagtagctgggactacagatgcctgccaccatgcctggctaattttttgtatttcaggagagacaggatttcaccatgttggccaggatggtctcaatctcctgacctcgtaatccgcccacctcggcctcccaaagtgctgggattacaggcgtgagccaccacgcctggcctgttgaggatttttaacatgaagggatattgaattttatgaaaagcctcttctgtatctattaagataatcacatggtttttgtttttagttctgtttctgccatgaatcacattaattgatttgcatacattgtatcgatcctgtatcccagggataaagcctacttgacctggtggattagcattttgatgtgctgctagattcagttacctagtattttgttgaggatgtttgcatctatgttcatctattggcctgaagttttctttttttgttgtgtctctgccaggttttggtatcagcatgatgctaccctcatagaattagggaggagtccctcctccttaattttttgtaatagtttcagtaggagtggtaccagctcttctttatgcatctggtagaattcagctgtgaatccatctggtcctaggctttcttcagctggcagactttttactactgactcaatttcggaacttgttatttgtctgttcagggattcaatttcttctgggtttagtcttggtaggttgtatatgtccaggaatttatccatttcttctaggttttctggcttgtaggcatagaggtgtttgtctctctgggttgggtttttttattattattatttctgtggagtcactggtaatgtcccctttatcaatttctggttgtgtctatttggaccttttctctttttttctttgtaagtctagctagtgatctttttttttttattcaaaaaaccaactcctggatttgttgatcttctgtatggttttcatatctcatttccttcagctcagctttggttttagttatttcttatcttctgctagctttggggttagtttgttcttatttctttagttcctctagttgtgatgttaggttgttaatttgagatctaacttttcaacgtcagcattcatgctataaacttccctcttaattctgccttagctgtgtcccagagattctggtatgttgtatcttcattctcattaatttcaaataatttcttgatttctgccttaatttcatcatttacccgaaggtcattcaggagcaggttatttaattttcatgtaattatatgctttcagtgattttcttagtatttaattctatttttattgtgctgtggccctatgagttcagtttttctgaatttgctgaggcttgttttatgtcttatagtgtggttgattttagagtatgttgcatgtgcagatgagaagaatgtatattctgctgctttcgagtggagtgttctgtagatatctattaggtccatttggtcaagtgtcgagtttaaatcctgaatatctttaacagttttctgccctgatgatctgtctaacactgtcagtggggtgttgaagtgtcccagttattatgtggttacctaagcctcttcataggtctctaagaacttgctttatgaatgtggttgcttccgtgttcgatatgtataaatttgctcccgtgttggatatagtcaaatcttgctgaatcaagccttttaccattatgtaatgcctttctttgtcttttgtgatcttcgttggttggaagtctattttgtctgaaatcagaatagcaatccctgctcttttttccattttccatttgcttggcagatttttttcatccttttactttgaatgtatgggtgtcactgtatgtgggattggtctcttaaagacagcataccattgggtcttgcttctttatccaatttgccacaatgtgtcttttaaagggatatttagtccatttacattcataatattgatatgtgtggctctgttcctgtcaccatattgttagctggttattatgtaggcttgtttgtgtggttgctttatagtgtcactagtctaggtacttaggtgtgttttgttattgttgttgtttgttctttttttgagacagagtttcattcctgttgcccaggctggagtgcagtgatgcgactgtggctcactgtaacctccacctcctgggttcaagtgattctcctgcctcagcctcctgagtagctgggactacaggcatctgccaccatgctcagctaattttttgtctttttagtggaaacggggtttcaccatgttggccagcctggtctcaaactcctgacctcaggtgttccatccgccttagactcccaaagtgctgggattacaggtgtgagctactgtgcccagcccttaggtgtgtttctgtagtggttggtaataatctttcccttccatgtttagcattcccttcaagaccctgtaaggcaggtggtggtaaagaaatcccttagcatgtgcttgtctcaaaaagatcttatttctccttcactcataaagcttagtttgaccggatatgaaattcttcgttgcaaattcttttctttaacaatgctgaatatgagccaggcccagaggctcatgcctgcaatcccagcacctttgtgaggctgaggagtgggggtcacttgaggccaggagttcaagaccagcctagtcaacatggcaaaaccctgtctctactaaaaatacaaaaattagctgggcatggtggtgtgtgcctgtagtccccagttactcaggaggctgaggcatgagaattgcttgaacctgggaggcggaggttgtagtgacccaagatcgcaccactgcactccagcctgagtgatggagtgagactctttctcaaaacacaaacaaaaacaaaaacaaaaacaaaaacaaaaacaaaaacaaaacaaaacaaaaaggctgaatgtaggcctccattctcttctggcttgtagagtttctgctaaaaggtctgctgttagcctggtgggactccctttgaaggtgacctgtcccttctctctagctgcctttaacattttttttctttcatttagaccttggagaatctgatgactatgtgccttggggatggtcttcttgtgtagtatttcataggggttctctgcatttcctgaatttgaattttggcctctctagtgagattgggaaaatactcatggataatatcctgaaatacgttttccaagttgcttattttctctctccctatctttcagggacaccaatgagttgtatatttggtctctacataatcccatatttctcagaggtgttcattctttattttctttatttttgtctgagttattttggagagctggtctttgagctctgggattctttcctcagtttggtcaattctgttgtttattttgaaattctttttttttttttttttgagatggagtcttgctctgttgcccaggctggagtgcagtggcgcgatctcggctcactgttgcctctgcctcccgggttcaagcgattctcctgtctcagcctcccaagtagctgggatttacaggcgtgcgccaccacacccagccgatttttgtatttttggtaaagatggggtttcatcaccttggcaaggctggtcttgaactcctgaccttgtgatccacctgccttggcctcccaaagtgttgggattacaggtatgagccactgcgcccagccgaaattcttgaagtgagtttttcagctccatcagctcagtttggttgttttctttttgagacggagtctcactctgttacccaggctgaagtgcagtggcatgatctcagctcactgcaacctctacctcccaggttcaagcgattctcctgcctcagccacgcaagtagctgggattataggaacctgccaccacacctggctaattttttgtatttttagtagagatggggtttcaccatgttggccaagctggtctcgaactcctgacctcaagtgatctacccaccttggcctcccaaagtgcagagattacaggtgtgagccactgtgcccggccggttttttcttaaaatggccatttcatcttacatctcctatatcgttttattgtatcctttacagtctttggattgggtttcaactttctcctgaatgttgatgatcttcgttcctatccatattctgaattctatttctgtcattttggcttggttaagaaccactgctggggaactagtgcagtcaacttagcagcaagaagacactggcttttggagatgccagagttcctgtgctggctctttcttatcttcattggctaatgttctttcaatctttgaagctgctgtcctttggatggatttttttgggggtggtgcttttatcttctttgatgtctttgggggtttgattgggttcagtcaactggcttcatttctgacagatttttgggggactaaggctcagctcagcactcctgggctatgtcctccaacactggggggctggtattgggcactcagctttgttctctggctctctgaggttgagaacatgcagcactggaggggttgaggtgttcttgggccacagccacaacactctgaagggtagtgccagccaaagcactctgtcggatagtggcagcctatttgcttgtgacagcagcaccagcagtgcaatggggtgcatgctcattggctgaggcagggtgctaggaggcctggggctgcctgcctctatgtgggcattggcagtagcagtggtgcacggccgctggggtctgtgtgcacatttgcaccaatggcagtggtagcacagagttagagctggtgacctctgtgcatgcgttcatgcctgtggcggtggtgttgcggggcccagaatgttaatgagaacagcaaaacccatctttagcagactgggacatgttgcccagactagttttggtttgtttttgtttttttttttttttttttttgagacggagtctcgtgctgtcgcccaggctggagtgcagtagcatatctcggctcactgcaacctctgcctcctgggttcaagcaattcttctgcctcagcctcccgagtagctgggactacaggcacacaccaccatgcccggctaatttttgtacttttagtagagatagagtttcaccatattggccaggctggtcttgaactcctgacctcgtgatacacccgcctcggcctcccaaagtgctgggattacaggtatgagccaccacgcccggccgacccagactagtcttaaactcctgagttcaaacaatctgcccacctcggcctcccagagtgctagaattacaggagtgagccaccataccagccaatttattccgtttctaaaggtgcaaagtttaactggaacttagaaacaaagtgatgaaactatttacagtgaacattgctgttgggtctccaacctccatctcaccctttttgagcagcagcaatataatctggaaaactgacctcactccaggagtgagcctataaattctaagggtaacagtgactgatttggggacgggcagatgacccaattctggccaatgagacatgagaaaaggttcttgaaggtctcaacgttcttgctcactctcagaagaatgcaatggaaagctggcctacccaggcctaccttctccccaactcatccatgggctgtggccaacacatggatgtaagctcagcccacaatgctgcaggcagttgtttcccagccaggagggagacaagatgcatctgatgtgtcagtatgaataaacacttgatcctacagacactgaacatgtgtattttctcttatattcagggaaaacattatatacaattacctctgcctttccgagctgtgctttcttctacccaatacacttttggaagacctttgagaagtcgaagaaggtaaggaaccacacaatctttgtgctaaaaaataataagaagaataataaattagatttaataaaataagtgattggcagctttttagcccagattaagcccaaagcaaagcatatccacatcctaatcatctcagagattctccagggataatgtaaagtgcatgtaaattcacatggcatcactccattcctgttttcacactgcagagtccagaggctgtcctatcaacctgtaccacaggagcctaaggaagggttcgcacctgccttctggagctgagggtccagcctgctcaggcctcttctgggggctgggcctctccaggaggtacacgtgtgtacacactcaaagctgtcttcagtgagaatggtttagagccccaaaacccatccatgagccccagaataagatcctggggatggagagaagctcacaatgcgggcatctcaactgggtgatgcttttttctgttcatgtcccttgtccattttccttgtgttttttttttttaattttctacttcatgtttcctcttgttcttctcaagttgagcatcagactttatagccaactttagcccagtgaaaaattttactttcctctaatttctgaactagccaatcaacaccaatatatagcttcgtaatcttccatcattggcttttggagctatttccctatttacagatgttccagttaaggattagatgtgctccagagaagaagtgtgctctagagaagaggagtactatttgatgttttgaaatgctgacaaaccacatggtagttttaaaaacatggctgcagccaggcatagtggctcatagtggctcacacccgtaatcccagcactttgggagacccaggcaggtgaatcacttgagctcaggaatttgagacccagctggccaacatggcaaaaccctgtctctactaaaaatacaagtattagctgggtgcagtgggacgtgcctgtagtcccagctacttgggaggctggggtgggaggatcgcttgagcatgggaggtgaagactgcagtaagtcaagattgtgccactgcactccagcctgcgcaagagagtgaaatcctgtctcgaaaaaaattaaaacataaaagcatggcagaaggtggccgggtgcggtggctcacacctgtaatcccagcactttgggaggctgaggcaggcggatcacgaggtcaggagatcgagaccatcctggccaatatggtgaaaccccttctctactaaaaatacaaaaaattagccaggcatggtggtgggcacctgtagtctcagctacttgggaggctgaggcatgataatggcataagtaaacccaggaggcggagcttgcagtgagcctagatggcaccactgcactccagcctgggcgacagagagagactccatttcaaaaaaacaaaacaaaacaaaacaaaacaaaacaaaaaacaacaaaaaaacatggcagaaggcatgcagcttccacctggctctttttcaggacatttgccctggaacctagacactatgctgtgataagacccatgaatgagacttcaggtgattcctgcccccagcttttgagccaccccaaccgatgctaaatggagtcagttgagccctgtctaaattgcagattcacgaatcaaacaaaatgatgtattaagcactaagtctggggggactttgttataccataatagataactaaaaacaaagaactttatcaaaaacaaaagttttttctctaaaccataaaaaggaactggctaagacatctgtcgaggatcctagtgtacagacaggaacaaaactccataaggcctgaaccacatggcctcctgcagaggaagtggctccaggtggctctttcctatataaactgtgatgacattagcagcacagggtgagtaaaaccacctcagctcctctggccacagctgctaccatggcagcccactgctgggacctgaaggaggtcaatgcacagcccatcctggagggaagcaaggaatataagcaccaggtaaaaaccaaggtggtccctagggctttctcagggggctggcaaagcatgctaggcttctctcctagtatatgcaaggccggtgggctgccctggacatacaggcaaactctatggtccaagggacaacatcacatgccacctgggaccctgctagtccttacccagaacctgaatgacacttgtgctcatctatttgttgtcatcttaagaagtctaatacaagtacaacactttcaggacttacaggtaaatctatcaagaaacgtgtttgccaaagatattatcaagtaatccacatttgaacaacaatagtttcttataaatttttttaaaattattttttgccctttataattcattttatatttatgtaggatatggtaaacagaaaaaaaaaatggttttctttcttttcacatttataaataaacaggcaagctgggtatggtggcacatgcctgtaatcccagcactttgggaggcctaggcacgaggatcacttgagaccagggttggagatcaacctgggcaacctagcaagaccctcatttctacagaaaattaaaaaatcatgccaatgcctataatcccagctgctcaggaggctgagatgggagaatcccttgagcccaggagttcaaggctgcattaaataatgactgtgccactgcactccagcctaggcgatagagtgacactctaagaataaataaataaatagcagaagaaaggccaaaatgtagcttatgtatctaattttggttttttatgtaaccttgatcaggtaacctatttaattattaaaatactgctctataattaaaattcttatttgtttccaatgtacaaatactgttaaaatattaatgcttattagagcaaaatttccaggagatggaagcaacctgttctagataaatattcaaatatctaacatctttatttacctaacacagcataattaacttggaatttagaaatagtatctagtaatgataaaaataaataaataaataaaagattcaatatccaatgatcaatcatttgtttcaaatagctttggtaaatataaaaatacacatacacaacagtcacactatttttttgttggagctacagggctagattttaagtccctattaaaaggtacactgaggccaggcatgatggctcacacgtggttcacgcctgtaatcctaacactttgggaggcagaggcaggcggattacctgaggtcaggagtttgagaccagcctgcccaacatggagaaaccccgtctctactaaaaatacaaaaaaattagccaggagtggtggctggtgcctgtaatcccagctactcaggaggctgaggcaggagaatcacttgaaccctggaggcagaggttgcagtgagccgagattgcaccactgcactccagcctgggtgacaaagcaagactccatctcaaaaaaaaaaaaaacaagatacactgatacatactctaaaagtttatatacataatcgcaattttgaaaaagatgatattatatcaaaattacctaaaatgattttgtccttttggaaggagaaatacaatacccctgagtctgactgataagcattttacctgagcttgaaaaccaaacctaccctggaaggcacacaattacttctcaaagcattttaacttactctgtggcacataataacaaacaaacaaaaatacactttttttacaacataatatatgcacacaattctaaaaaactcaaattttctaagaaggtttacattaggaagtttcattcccaccttgtcctaccctctccactaaccactttgattaggttcaaatgtattcttctactattgctttaggtaaatataagcagatacaaacttaaacgctcactacacccccttttacaatgaagaaacttttaatttcatgaagacttacctgaagatcagattcaatcagaaaaatgcccaatgcaatcactgcatctctccgtctttcatctaactggaagatcccatggaaatccactggacacatgcaaagaagcttttggacctagaaaatgagacccccccaaaaacagctctacaaaatagaaaaccacattcaaaataaagcaagctgagtgcagtgtcatatgcctgcagtaccagctattcaggaggctgaggtgggaggataacttgagttgggagtttgagactagcctggccaacatagtgagaccctatctcttaaataaataaaaataaaaaataggccaggtgcagtggctcacacctgtaatcccaaccctttgggaggccaatacaggtggatcacctgaggtcaggagttcaagaccagcctggccaacatggtgaaaccccatctctactaaaaatacaaaaattagccaggcgtggtggcgcacacctatcgtcccagctacttgggaggctgaggcagaagtatcacttgaacccaggagacagaggttgtagtgagccaagatcgtgccactgcactccagcctgggtgacacaacaagactctgtctcaaaaacaaacaaacaaacaaaaccactaccataaaccccaaagagtccatgtaaccaataagtcatagttttttttcagttaaaagatcacaggacatctccagctgctgaaacaattgtacacgtgcccctcaaaacacataaactctgagtaatatgagctgaaggttaaaactgtgtatactcagagggggtaagacacaatggctaaagtttgcattttggtgttaggacagtctaagtgggtgtccccaccccttgaccacgaacaggttacccaaaccaacctgcattaacaatgcctcactgactcttttaaaaaatcaaatgcatggccaggagcggtggctcacgcctgtaatcccagcactttggtaggccgaggcaggcggatcacgaggtcagaagtttgagaccagcttggccaatacggtgaaaccccgtctctactagaaatacaaaatgtagccaggcatggtggcgagcggctgtaatcccagctactcaggaggctgaggcaggagaattgcttgaacccggaaggcggaggttgcagagagccgagatggcaccactgcactctccagcctgggcgacagagcaagactccgtctcaaaaaaaaaaatcaaatgtgtgaagcagttgggactgagcacagcatatagtaaatgctcaataaacattatctattgttattggatatactataatagtggctagtggaaggcaaaagcagacaatgagattcaaagaatgctgattaatgagtcaatcactgaagcacagggaagaactggccctatcaaagcctatgtactttgctctgtcctatgcaatactttatcaataccctgcactaaaacacagaagatacattccactacaaacctggcagatgaaactaatgtgctagaagacagcacgaagacttgaaaactcatcaaaattggcataacatcattatttctccaacaatagtgcctgaaagacaacttttgataatgtgatcagggagggcctctctaagatggttccttaaattgggatctgatcaagaaggaagccaggacaaatcaggaaaggctgctgctgcagcagcacagtggaaaagaagaagcaaggaggcccaggagttcaggtccagacagagaaggtccccagagggccccacaggccaggtcagaagcctgaattgtatcctaataacaaacacatagaggccttagggcatcaagtttagaactgaagtctagaagaatccctctggctgatacacagaaaatggattttggaggacaagagtgaaaacagagacaggtgaggagactcctgcagcagctgaggagactcctgcagcagctgaggcgaagatgttagcatggtagcaatcaacgagtagagacagaaacagaccagttcaggatgtgttttgaaggaagagttaagaggacttgatgatggacaggatatgggagagattactttagttgcctctttaccacactagaaagtatccaggccaggtgcaaggctcatgcctgtaatcccagcactttggaaggccgaggcaggaggatcacttgagcccaggagtttgagaccagcctgggcaacacagtaagaccctgtccctacaaaaaaataacaaaattaatcagctattgtcagaggcgtgtgaaccagagcaactccatcctgaataggggctgggtaaaatgaggctgagacctactgggctacattcccaggcagttcaggcattctaagtcacagggtgagacaggaagtcaacacaagatacaagtcataaagaccttgctgataaaacaggctgcagtaaagaagccagctaaaacccaccaaaaccaagatgtctggtctcgaactccttatctcaggtgatacgcccacctcggcctcccagagcgctgagattacaggcatgagccatcgcaccctgccaccaaggctttcttttttacataaagcataagaatggatttcctctctcaggccaggtgctctgggttgggctctaacaatatcccaggatcagaattcagcatcatcaacacagtttagccatactgccagtgcagcggtcaccccacccagtagaaagaactgaaggcagcattttttaccatcctcaattcctctggactgccagggcctcctctctttcaaatgcccagaggggctctggggtactctgacttcagaccttcctcccctatccccactcaactaaaaacatttaaatagaaataatctgtgaccattcagaaattactttaaaagccaggcatagctttaaatgtgaagtgaagataccaaaaagaacaactcagagatccatgtaatgattccatgatttatgcactacactggcatgtcaggcagaataatggcacctcaaagatgtccacaccctcaatcccctggaagctgtgaatatgttactttacatggcaaaagagaccttccagatctaattaaattaagaaccttgaaatggagggatatcctggattatttagataggcccagggcaatcacaaaggtcattaaaaggagaagagagaggcagaagagggagtcagagtgatgtgagatgggggcttggccaaccattgctccctttgaaaatgaaggaaggggccagaaatcaaggaatgtgggcagctctaggagctgtaaaaggcttggaaatgatggctgggtgcggtggctcatacctgtaattccagcactttgggaggctgaagtgggtggatcacctgaggttaggagttcaagactagcctagccaacattgtgaaaccccatctctactaaaaatacaaaaattagccgggcatggtggcaggccccgtggcaggtgcctgtagtcccagctactcgggatgctgaggcaggagaattgcttgaacccgggaggcagaggttgcagtgagctgagattgcgccactgcactccagcctgggcaacagagcaagactccatctcaatatatacatattaaaaaaaaatgaaaaaggcttggaaatgagttctcccctagagtctctaaaaagatacacagccctgccatcaccttgatttcagtccagtgaaacacaggttgtgtttctaatctacagaactgtaaaattataaacgtgttattctaacaacaagtctgtggcaatttatttacagtagtaataggaaactaatgtaattggtcactggtaattaaacaaaactcaaagcctactggactgcctatcaagaaaagtatcaaactgagtaatcagattacaggcaataggccgggcaccgtggctcacacctgtaatcccagcactttgggaggttgaggtgggcggatcacatgaggccaggagttcgagactatcctggccaacatggcaaaactccatctctactaaaaatacaaaaatcagccaggtgtggtggcctgggcctataatcccagctactcgggaggctgaggcacaagaattgcttgaacccaggagccggagatagcagtgagccgagattgtgccactgcactctccagcctgggccacagagcaagactctgtctcaaaaaaaaaaaaaaggccgggcgcagtggctcacgcctgtaatcccagcactttgggaggccgaggtgggcggatcacgagatcaggagatcgagaccacagtgaaaccccgtctctactaaaaatacaaaaaattagccaggcgtggcggcatgcgtctatagtcccagctacttgggaggctgaggcaggagaatggcgtgaacccgggaggcagagcttgtagtgagccgagactgcgccactgcactccagcctgggcgacagagcgagactccgtctcaaaaaaaaaaaaaaaaaattacagacaatatttagttccttctttattattttctgtatttcccatattttctataaaaaatattgataactttagaatcagaaaaaaatacggccaggcatgggcttacgcttgtaatcccagcaatttggaaggctgaggcaggagggctgcttgagcccaggagttcaagaccaggctgggcaacatggcaagaccctgtctctacaaaaaatttaataattagccaggcacggtggcatgcccctgtagtcctagatgctcggggatccgaggagggaagattgctagaggatcgcttgagcctagcaggttaaggctgcagtgagctgtgatcacactactacactccagcttgggtggcaaagcaagaccctatctccaaacaaaaaaagaaaaagaaaagaaatacagaatataccgaagttcatgtgctgcactgatatgcttacctgaactgcaggcctaaggatcactgacaactcccaaacatatgaagaagtgtaggtctaaggtcaggagaggttgcacagatgcaaccagcaaacgttcactttcaggcaggccatgtgttatcctattcctgttttacaggttaggcaactaggtccagataagttaagtgcacctgaggcaacaggttcctaactacatcttccttctcattttgtctcttcctactccaatatttccacttctggttcatataccttcaatggttccccattgcccaatgaacactcagtgcacactcccagccccaaaacttctctcataaacccaggccgctatgtatcaattctcatttctccctgcctggcctcttccatggttttgacccatctgaaacattttgtccaacctgccctatctcccctataaaaattcaacccatccttccaagatccatctcaactgtctcaaaactctcaaacattttccagaccccagcaacttgatgtaatatctcccatcatatctctcaatagctcacatagaactctgtatttctcaagataattaccttcctgatgtcttacagttacttgtatacttatcctctcactgcagagaggcctgtgacctcctcatcactccactgcaccctacacatttcagaactttaacaactacttaatgggactaaagcggccaaggtcacagacatttgataaggtgaggaggaaagaaaagaggtacagggctactagaaagcagggtttaactacactgtgataattgtcatatagtcagtaccaggcacagtgctggcatgcagttgacactgaacaagtatctgctgccttactgaatgaatggagggacggatggaagaactctcaaatgaagtaatatataatgtacagtcactccctcatgagcgttacaatccagcaggagttacaaaactaataaaaataatacaactagcaaataacacaagtcagaaactaaacgacagagggccctgaaagcctggagcaaaatgctcttggaaactgggactcttattagaaagacatctgaaaacttgaacctgggtcctacagaaaccatcacacccagttctggtgggtgccattctccaaataatgacagctaacacatattgaacatttatcatgtgttcatctatattatcttatttaatcctcacaacagctcattaggtagctattattaatcatcccccttttacatatgatgaaacagacacagagaggtcaaagtcctaatgcaggataaagcattaaccctctagtctttgaaaaaatgaaaagaaaaataacatcaaatggcttttcagaatcagaattttacaataaactagcaagttgtttgtttttaggggtcttagggggagtgggtcattataaaaagtcattaagcccaaaatctgaccacgatggccagggttattcccatttacaaaaaggatccagagggcttctacccaccactttcaaaaggttgttaagtcaatggaccacagggaggcaacaaatatgactgacttagactttgataagaactcttggcaatactttaacccaaggatattaaaagacaggtatctcaaagatgtgaattttgactgccaaggtaaggaaatgctaaaccaaggagaaaataagattcaaggagaaagtaagtctggatgactgggcagaaaattgcagatgagaatcaaccataacagagggtatttgtaaggtatttaggtcaaaataaagctacaataatagcattataaaagttggataattaaatgatttttttaaaagagtactacttgttatttaaaacctctgggaattgtcttcctggagaaacaaaattctctgagaacaaaagactaagatttaagtattaatggtatatttttctgttaaaaccatttgtaattgtctttctcaaatgtaccatcccctcagacaaaaaatattgaatataagctgatattttcgaagtgactcagagctatcatgataaacaaaggtgactgtgacatgatacacatggacctacaaatgtaaatggaacagcacctgatcctacaagcaccctggatcagagtttcattagagatgcgcttttgagctgagcgcggtgggaagtgcctgtaatcccagctgcttgggaagctgaggtgggagtactgcttgagcctaggagttagaggctgcagtaagctatgatcgtgccactgcactccagcctgggcaacagagcagaatcctgtctccaaaaatacaaaataaaaaagatgctctttggtcatctgtagacagattcatgaccttctaacaaacaaattcagcaaggttacaggacacaagattaagatacgaaaatcagccgggcgctgtggctcacgcctgtaatcccaacactttgggaggccgaggcgggcggatcaggaggtcaggagattgagacaccatcctggccaacacagtgaaaccctgcctctactaaaaaaaaatacaaaaaaattaggcaggcttggtggcgggtgcctgtagtcccagctacttgggaggctgaggcaggagaatggcatgaacccgggaggcagagcttgcagtgagccaagatcgcgccactgcactccagcctgggcaacagaacaagactctatctcaaaaaaaaaaaaaaaaaaaagaaaagaagaaaagaaaataaattgtatttctacaacgcagcaatgagcaaattaagaaaactattccatggttaattttatgttatatgaactttatctcaattattaaaaaaaaataataaagaaaaacactaacgcaggaacagaaaaccaaatactgcacgttctcaattataagtgggagctgaatgatgagaacacaggaacacacagtggggggaacaacgcacgctggggcctgtgaggtgggggagggagaatatcaggaaaaatagctgtcaggcacagtggcccatgcctgtaatcccagcactttgggaggccaaggcgggtggatcactttaggtcaggagttcaagatcagcctggtcaatatggtgaaaccccatctctactaaaaatacaaaaattagccaggcgtgggggcaagcgtctgtagtcccagctaatcaggaggctgaggcaagagaatcactagaacctgggaagcagagattgcagtgaactgagatcaccacagtgcattccagcatgggcaatagtgcaggctcaaaaaaaaaaaaaaaaaaaaaagggtggggggccaggtgcggtggctcatgcctgtaatcccagcactttgggaagccgaagtgggtggatcatgagatcaggagttcgagaccagcctgaccaacatgatgaaaccccgtctctactaaaaatacaaaaaaattagctgggtgtggtgcaacgcgcctgtaatcccagccactcagaaggctgaggcaggagaatcacttgaaccgaggaggtggaggttgcagtgagccgagatcacgccactgcactccagactgggcaacagagcaagactccatctcaaaaaaaaaaaaaaaaagtaatagctaatggatgctgggcttaatacacaggtgatgagaagatctgtgcagcaaaccaccatggcacacatttaacaaacctgcacatcctgcacatgaacctaaaataaaagttgaagaaaaatgaataaataaaaatgtaaaaagaaaaacaactgtaataatcccagcactttgggaggccaaggcaggaggattgcttgaacccaggagtttgagaccagtctgggcaacatagtgagtctctaaaaaaaattttagaaattaaccaggaggctgggtgcagtggctcacgcctgtaatctcaacactttgggaggctgaggcgggtggatctcttgagcccaggaattcaagaccagcctggggtacatggtgaaacccaagaccaacctggagtacatggtgaaacccagtttctacaaaaactagccaggccatggtggcttgtgcctgtagtcccagctacttcagagactgaggtgggaggactgcttaagcctgggaggtccaggctatagtaagctgtgataataccactgcataccactgctctccagcctgagtgatagtgagaccctgtttcaaaaaaaaaaacaaaaaaaaccagtagaacaatttcatttaaaatagcatcaaaaagaaaaagtacttatgaataaaaacaaaagaagtgcaaaactaagaaacattacaacattgctaaaagtaaagaaaacctaaataaatggaaagacatcccatgttcatagatcaaaacagttactattgtttagatggcaatacaggccgagcacagtggctcacgcctataatcccagaactttgaggggccagggtgggtggatcacctgaggtcaagagttcgagaccagcctggccaacatggcaaaaccctgtctctgctaaaaatacaaaaattagccgggcatggttgtgcacacctgtagtcccagctacctgggaggcagaggcaggagaattgcttgaacccaggaggcggaggttgcagtgagctgagattgtgccactgcactccagcctgggtgacagagcgagactccatctcaaaaaaaaaaaaaaaaaaaaaaagggacaatatagcaatacagtccaaactaacctacaaattcaacaccatccctgtcaaaaccctaggtgagttctttgcagaaactaacatgctaaccctaaaatttccatggtaattcaagggacccagaataacaaaaacaatcttgaaaaggaaggacaaaattggaggactcattcttcccaatttcaaaacttactacaaagctaaagtaatcaagacagtatactagccaacatcaggaaagacatacagaccaaataaaccctcacacttacagtcaactgatttttgacaagggttccaggacccctcaatggaaaaaagaatagtctttccaagaaatcgtgctgagacaactggatattcacatgcaaaagaatgaaactggacccccatctcatatcacataaaatcttaactcaaaatggatcaaaaactcaaatgtaagagctaaactataaaactgctaacaaaaaacacaggtgtaagtctttgtgaccttgaaattagacagtggtttcttagatacaacacaaaaagcacaagggacaaaagaaaaaaaaaatgacaaaatggacatcatcaaaatttaaaacttttgtacttcaaagaacaccatgaagaaagtgaaaaagcccacagaatgggagaaaatatttgcaaatcatatatcttattaagaaacttttatctaaaataaagaactattacaacttaattaaaaaaatactacaatttaaaattgggcaaagaatctgaatagatatatctccaaagaagatctacaaataccccaaaagagtggctgttctaggatagaataggctggctcaacatcattaaccatcaggcaaatgcatatcaacaacagaataataagatcccacttcacatccactaggatggctataactggaaagacagacaatacagagtgttggtgacaatgtaaagaaaacaagccctctgtacaccgttggtgggaatgtaaatggtgtagtaactttggaaaacagtctggagttcctctaaaggttaaacctagagttattgtatggcccagcaattccacatctagttaaagacccaagagaaatgaaaatatgtctacagaaacacttgtacgtgaatttccatagcagcgttatttataatagtcaaaatgtagaaacaatccaaacatccacctactaatgaatggataaaatatggtatatgcatacaaatattatttagtaataaaaatgaagtaatgagatgctacaacatggatgaaccttgaaaatacgccaagtaaaaaccatcatggcaggtgcagtggctcacacctgtaatcccagcactttgggaggccgaggcaggtggatcacaacaaggtcaggagatcaagaccatccggctaacacgatgaaaccctgcctctactaaaaatacaaaaaattagccgggcgcagtggcgggcgcctgtagtcccagctactcgggagtctgaggcagaagaatggtgtgaacctgggaggcagagcttgcagtgagccgagatcgcgccactgcactctagcctgggctccagagcgaaactctgtctcaaaaaaaaataaaaataaaaataagccaccacaaaaaaccacatcttatagaattctatttctacaaaatgttcagaataaatctacagagacagaaagtaaactagtggttgtctagggatggggctggtagggctgcagggtaacagcaaggtttcttttgagggcaatgaaaatgacctaaaattgatcatggtgatggatggacaactctgtgaatacactaaatatgatgaactgtacattttaaatgggtaaattttgtggtatgtgaattatatctcaagaaagcactattgaaaaacctagcctatgaaggatcaaatcaaaccacaagcaactgccgaccagaacaaagcccaacattccctaaagtaacacaacaaaaatctaaacactcaagccaggcacggtggctcgcctgttaacaccagcactttgggaggccaaggcaggtggatcacttgaggccaggagttcaagactagcctggaaccccgtctctactaaaatacaaaaaattagctgactgtggtggcgcatgctaaaggagtccccataggtctctgggactataaatactcatttaaaaaaaaatttttttttttgagacggtgtcttgctctgtcacccaggctggagtgcagtggcgtgatctcagctcactgcaagctccgcctcccaggttcatgccattctcctgcctcagcctccccagtagctgggactacaggccaccacgcccagctaattttttgtatttttagtagagacggggtttcaccgtgttagccaggatggtctggatttcctgacctcgtgatccgcccgcctcggcctcccaaagtgctgggattacaggtgtgagccaccgcgcccggcctactaaaattttttaaaattttcgctgggtacagtgactcaagcctataatctcagcactttgagaggctgaggtgagtggatcacttgagcccacggtttgagctaagcctgggcaagatagtaagaccccatctctaaaaaaatttttctttttttacttagccaggtacaatgtgcgtgcctgtagtcccaactacttgggaggctgaggcaggaggatccctcaaaccaaggaattcaaggtggtagtaagttatgatcatgccactgcactccagcctgagtgaaaaagcaaaactgtctccaaaaaaatgtaatttctatttttaaaaatgtctaggccaggcacagtggctcatgcctataatcccagcactttgcgaggccgaagtgggcagacggcttgagccctggaatttgagaccagcttgggcaacacagtgagaccctatctattttttttttaatgtctatttatccacccctctaataccagggcctagcacagtgcctgcaacacagcaaacccccaaagatttatcatatgaacggatggtgccatcttttgctttcataatagtatagccttgggttttttttgttgttgttgttgttttttgtgtgacggagtcttgctctgtcgcccaggctggagtgccgtggtgcaatctcagctcaccacaccacctcccgggttcaagcaattctcctgtcttagcctcccaagtagctgggcttacaggcgcacaccaccacgccctgctaatttttgtatttttagtagagacagggttgcaccatgttggccaggctggtctcgaactcctgacctcaggtgatgtgcctgcctcagcctcccaaagtgctgggattacaggcgtgagccactgtgcccggctgcgttggttatcctgaatccaggcttccagataagctttaaacacagaaaaacattcaggaaaagagaatggcttctgcagcagagacagagcctctcaggactcaataaacaaatgcaagtgagacctgaggatttctgcctcaactctgtatttatttgtcagtttaccacacaaatgaaagtagcgttctggccaacttggcaatgttcatgaaaggccaagcttttctccagcatgccaacatatacaacaaaagcaaatacaaaaataaaaatataaataagccatcctggctaacacagtgaaaccctgtctctactaaaaatacaaaaaattagccgggcgtggtggcgggcgcctgtagtcccagctactcgggaggctgaagcaggagaatggcatgaacccaggaggcagagcttgcagtgagcagagatcacgccactgcactccagcctgggtgacagagcaagactccatctcaaaaagtaaataaataaataaacaaataagcaatcaggaagataaaatgcataaatttcagcaactgacgtcaatgatggaaatagctgctggtgggaaagattagaggcaaccacacctccaatgagtgcaaactgcaaacacagacagcagaaaagagaatctgcagtaaggagtgagaaatagaacatttctgccccctggggagacaaacagctggtgacacaggagggcactgagggaaggctacgtgaaggcagagggagaaagtggcctcggaagaaatcaacattgctgacaccttcatcttgaacttctaacttccagaatgaggaggaaatatatctgtgttgtttaagccagtctgtggtactttgttatggcagcctagcaaactaatagttaatatggcatggttacaggtaaagattttttcttcttccaatttcttcttaaaatattttctagttgatttaataacaatgattctggcaccgcgtataccctccgctgaccctcattatctctctcctctcgctctacggatggctcttcttaacatagcctcacaaagcaaagggaaagaggataggaaattcttggcttcatgatactggaaaaacgccaacactatgatttttactccatggcagaccactctaaagtacagactgaataaccatgaactccagaaagcccactaccctaagcaccaagccacatattctcccaactacagattagaattaactcatcttatggagcacatatgtccaccaaggagggttcagcctgtccctaatgccgcagtgccatttaaacatcagatcgggctgggtgcagcagctcacacctgtaatcccagcactttgggcggccaagaaaagagaatcacttgagcccagaaatctgagaccagcctgggcaaaatggtgagactccgtctctattttctttcaaaaaccagatcaatagttagctacgacacctcaggattctggcattctaactgaagaaaacaaagagaacattttaggacatggaaaaagggctctgatcaaagcctcctgagggtggggagaggaatagaaggacaaggaatgctatctactttgcagctctgcccatgactctcggtatcccaggatcgagggcccactggtttaatacaggcctatagaggagagacacaaacaggccactgaacttccctgacaaaggaagattaaccaggcagggccaggaggaagcttagtaggggtggctcagcaacattctgaagacaggtgagaaccaggaaagcagaacaagactagcgggcagatagaaatcaggaaggaggagtctggaagccaactgtatatggagatcccaatgttgaaaagcctcactttctttcttgcctatttttttcttcttatctttctcccagagggagagggctgaggactgggtaggatttggttcaaagggcttcacagacagagtgtcctctgaggtgggttccaatcctgggggtgggaccccagtctaaagcacagcctagcaggaaaagctcaaagctcagccatggatcagaacagatgctcaagggtcttggctttggctatgggaacatggcaggagtctagtcaccagacctgaaatatgagagtagaatgggatcttggtcaggttggggtagctcacacctgtaatcccagcactttgggaggcgaaggcaggaggatcccttaagccctggaatttgagaccagcttgggcaagatggtgagacccccatctctaattaaataaaaaaaaaaaagtagatgggatttatggtatttcattggttcattaaaggaaagagaaaaaaaaaaaagagtagacgggaaacttgtagcaaggctgacttgctgctgttcacctgagcaatcaaattaacactgcttctgatttacctggggcctagcacataccaaggagcagcaggagctcaataaatgttttctgaaagtaattttgttttttttgagacagagtctccgtttgtcgcccaagccagaatgcagtggtgagatctcggcttactgcaacctcagcctcctgggttccagtgattctctggcctcagcctcccaagtagctgggattacaggcgtccgccaccacgcctggctaatttttgtatttttagtagagacggggtttcaccatgttggccaggctggtctcaaactcctgacctcaagcgatcagcctgcctcagcctcccaaagtgctgggattacaggcgtgagtcactgtgcccagcctaaggtaatttttttttttaagtaaagtccacagagcagtaataggcttggtttcatggactgggattagagtgagtgactagagtaagtaaacacaactgtggcatgtagagagacaaaggtagggaaggttatgtcattaatgtacctcaagtgtcactaaaaccatgtcagggctgcctgagttaccaatgtctgagctgagatgtgaggtctggttctgcaaacttagccttcgccaggtcaaccctatctagatcaagccccacgcagtcctccaatctctcaggaagaaagaagagaaaaaaatagaagcaaagagaaggggaagagggaagagagaaggggagggattgggttttaaatactcatctccccctataagtctccatctttattatctcaggtgcgtactctaaaattcctttactcttaagaacaagaaacttggccgggcgtggtggctcacgcctgcaatcctggcactttgggaggccgaggtgggcggatcacctgaggtcaggagtttgagaccagcctggccaacacggcgaaaccccatctctactaaaaatacaaaaattagctgggtgtggtggcaggtgcctgtagtcccagctactcaggagactgaggcaggagaatcgcttgaacccgggaggtggaggttgcagtgaaccgagatcatgccactgcactccagcctgggcaacaagagtgaaactgtctcaaaaaaaaaaaaaaaagaacaagaaacttttccttgggaatgctaagggctttttgtcaattgcttcaaaaggaggaatgtagtaaaacacatattataggactacatattttatatatatatatttttattatactttaagttcaagggtacatgtgcacaacatgcaggtttgttacatatgtatacatgtgccagggactacatattaacaatgatccctagcataatcaagtcgcaagatcttagataaggatgagaggaattcacatatatttaatggggtcagccacttacagaagcctcctctatgaaataaggtgcttcaggggtccccagactgcccacatgtatatagttgtactcatggctaaattttttacagtgaatggatatcagcaataggaaaggacctcaagtgtcactaaaagcatgtcagggctgcctgtagaaacccatgcacaggcttccttatgttctctccctcctgtgaggatatacatcaagcttgctccttgctacagcagcaaaatattcaatacatgtgtgcagtttgtgcccaggaaagtccattagagaatcagcaccctaagtttttaatttatgcaccaccagcctagccatcagattcccagaaggaaagcaggtattcaacataaatcatagtttgtaaaaaggatctaggcatagtgaaccatctttattactaatagttacaggattgaggaaagcattcaagtgcttatttcccagatgccagccaaaggccaactttgtaagcaggctcttgtaaaaacagcagccccagtgctgctctattcactcttcttcacagaagtgattagtaatagctaggcacagtggctcatgcctgtaatcccggcactttgggagaccaaggcgggtggattacttgaagtcaggagttcaagaccagcctggccaatagggtgaaaccccgtctccactaaatactaaatactaaaccccgtctctactaaatactaaaaaatttgcccggggtggtggcacacgcctgtagtcccagctactcaggaggctacagtggaaaaatagcttgaaactgagaggcagaggttgcagtgagccgagatctcaccactgcactccagcctgggcaacagagcgagactccctctcaaaaaaaccaaaaaagtgattggtaaatgttgccaatgagactgaagtacttcctaaagtaagtggcattagggagctgccaacctgtggctatggctgtgttccttgtaaaatataatctttttcttttttttttttttttgagacagttttgctcttgtcacccaggctgaagtgcaatggcgcaatcttggctcactgcaacctctgcctctcaggttcaagcgattctcctgcctcagcctcccaagtagctgggattagaggcacgtgccaccacacctggctaatgttgggtttttagcagagacagggtttcaccatgttggccaggctggtctcaaactccgacctcaagtgatctgcctgtctcagcctcccaaagtgctgggattacaggcatgagccaccgtgccccatcataaaatataatcttgacaactgaagcagttattactacaaagctaagaatgttgcaattacagaatgttctcgtgactagtgaacatggctgaagaagcaaattgagctcaaggtgcccttttctgagttactgagtggaaagggtgctaccactgctggagctgcaggaccagcttcttaaagatcatccaattcactgcattctcttctctctcctcccagaatccagcaatcagtcataagatatatttgttggctctcctgctaagaagcgaatgtgctgactagctagcatgagtttgattcaataaaacagcactacactccattagtcagactatctaatgataacagtgctcatacattaggtacccacgtgcctttttgttgctcttcacaatactcctatgaagtactaccttgtatttgacagaagatagcaaagtatcagagaagggaactgacctgtctagagtcacactagtgaaagcaagtgatacaggatttaaattcagaggttccattttccaaactcatgtcctttccattgcattgtactccctctttagctagaagtcaggttagcaccaatctgccgggaccttctcaccccgaaggtgcatgataaaatcaaatatgagaaccgacaaggccaaggaccaggtcactctgccaaaagtgcctaaaacagcctttcagcttcatccatcagcagacagccacaaaaccactcccaactgcagcaggctggtctccggtcaccactgtcttatcttgtcggaaaacatcctctctccatgtgccaaaaagttgagtgggaaaataattccatcctttcagagctaaacactgtgctgagtctcatcgcacacgggtgggcaaagaaagttgacatttactgctcacccactctgtgccttgacctgtgcaagatgctttatgctagaactcatttaattctcaagaacaacctcattttacagataaggatacagaggctctaagagttaaatttacccaagaggacatggtaagtaagtgccagtgcagggaacaaattcaggtcccactctaaaatctgtctctttccagatctcaaggcacaccactgagttgcctttcacctttctcccaagatgaggattgctctggcatgacttcacctttctcttctgaagcaattccaagttcacttctctgcccactgacagttcactctcctttccctgccactgtcccttctgcaaacgcacaatcttttacccaacctaacgcccccagcctcgtagaataacactgcgcagttggtttacagtcacaaagcactttcaagacagtgtttcgtctcctggtcaccacagtccggtgaagccggcaaagcagataaaagcatccccattttacaagaaagccatcttcccaaggtcgcggaataaaaagcaggtgaaatcggaagcagaaccccaggtcttgacccctggtcctcggctcatcccactgctccgcacagccgcccacgatccagcctccacctccgcgatgtcacaagatgctccctgggccagcagctcacatcccccacccccatcccacaaccacccacctgcagcggccctgcaggccccgccgacccttcccccacggtccctctctcttcaccagcccctcccactagggcctccttcccccgctagatccctccgctcaggcgccccctcccgcacaggctgccggcgagcccagcctcggcctcccacagaccctcgtcccgcctccacgcttcgtcaccccagcccctcctcctgtcagcccgcggcccagcccgccgacgttaccttctccaaggatgctggtctctgcaccgccagggagcgggccagtgacaggaccgtgttgaaatagaagccccgcgaggcgctggagccggagccggagcagccgccgccgcctccgcctccgcctccgcctccccgggccggggccgccgccatcacctcacgagccgcggcgctgcccgccggctccccgctcctggcccgcgagcgcccgacctcagggcgcaggcgtaggtgcatccggctttcccgccacgtgacctctcagttgctgacactagatagggcgtggctgcggggcgggcccaccgctgcaggggagagaggggatggacagtaggctgcggttgcgcgcgccggatgtgggccccccccagccgacctgcgcgatggtcggctccgagggcggggccacctgcgcgcgacgcgcggaaggagttcgcgcgacgaccgcggggtcggcgggcggggcgaggccctggacggcggcggcagtggggctcctccttctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggtgagcctggggcagggctggtgtggactcgccggtctctgtgctgtcaaacggagacgagaaatgttttgctcacaatcttttgagaattctcaagttgcctagcatagattcttgcaccttagtgactcgatggtggtaacaatctgttaactatgtaaaggtatgtgcatctggagtacttgaagagggcagtttaccccagaaatcttccttagctattagtctgcttcgttgattttttttttcttacgcctagctcacggggaaacgccagattattttctgtccaggtgagtaaaaattctgaacagcaggtcctaggtttgggaaatggagagtccgtttcttcgacattatttcctgtgcaaaatctggcacagggttttggccattccttccggagtgagccagaaagagaggactatgtgcctgcgagtgtcaggtgataccctgaagcatcagggcaggtggtccacgagttcttcccgcatcattgacatctccacctaaccaaccaatagaggtattgaagtcccttcagcccagacagctgcctagttgaccaaagcctgggtttgattgagtccagggtcttacctttacttcccaaatcctagacaaatagtgtgcgggttaagagtttgttgctccaactcatcttcatcagttcttcccatccttagatttcagagagtagtaccttcaataacaattattctggccgagcgcagtgactcacgcctgtaatcccagcactttgggaggcctaggcgtcggatcgcctgagctcaggagttcgagacccgcctgggcaacatggtgaaaccctgtctccactaaaattaaaaaaaaaaaaaaactagccgggtgtggcggtgcgcctgtagtcgcagctactcaggaggctgaggtaggagaatcgcttgtacccgggaggcagaggttgcagttagctgagatcgtgctgctgcactccagcatgggcaacagaccgagatcctggagggtctttttctttttcttttttttttttttttgagatggaatctcgctctgtcgcccttgcttgggtacagtggcatgatctgggctcactgcaacttccgcctccgggattcagacgattctcctgcctcagcctcccgagtagctgggactacaggtgcgccgccacacccggctaattttttttgtatttgtagtggagacagggttttgccccgttggccaggctggtctggaactcctgacctcaggcagtccgcccgctttggcctcccaaagggctgggattacaggcgtgagccaccataccggtcgagaatgattctttattgtacaccacagtctctcttcagcctgctaatgaaacagttttgtttggacagagaaaaaaaaaggtttaaaaaaatgtataagccaggcgcggttgtacttctgtaatcccaacaatttgtaaggctgaggtaggcagatcattttagcccaggagtttgagaccagcaggggtaactgcgtctctacaaaatttgaaaaattagccaggcatggtggcacacacatgtgagtgcagctactgaggaggctgaggcaggaggaccgcttgagcccaggatgtcaaggttgcagtgagccatgttcataccactgcactccagcttgggcgacagagcaacacgctatcatttccccttgctgttttcttgggttaattcccttccccacctctctctgttcatgtatccctcattgatccacctccctgtggttttttttttttttttttgagacagattctcgctctgtcaccagactggagtgcagtggcaccaacttggctcactacagcctccgcctcctgggttcaagtgattctcctgcctcagcctcctgagtagctgggactaaggcgtgcactaccacacccagctaattttggtattaatagagttggggttttgccatgttggccaggatggtctcgatctcttgacctcgtgatccaccacctcggcctcccaaagtcctgggattataggcgtgagccactgcacctagcccacctccctgtgtttaactgttggttttttatttttgttttgtttgagacaaagtcttactctgtcacccaggctggagtgcgatggtgtgatctcggctcactgcaacctccacctccccagttcaaatgattctcctgcctcaacctcccaagtagctgggattagaggcacctgctacaacacctggctaatttttttgtttttgtttttgtttttgtttttttggtgttttttgtttttgagacggagtcttgctctgtctcccaggctagagttcagtggcgcgatctcagctcactgctacctctgcctcccaggtcaagcgattctcctgcctcaacctcctgagtagctgggcttacaggcacccgccgccatgcccagctaatttttgtatttttagtagagacggggtttcactgtgttggtccggctggtcttgaactcctgacctcatgatccacctgccttggcctcccaaagtgttgggattacaggcgtgagcgaccacacctggcctctgatttttgtatttttagtagagacaggtttcgccatgttgggcaggctggtctcaaacgcctgaccttaggtgatctgcccacctcagcctcccaaagtgctgggattacagatgtgagccactgcgcccggtcctaaccttgttagggaggttttgcctgtagttcttacatctcatacctactggattcctatgttccattctaaatgggaagtcttggcttagatttgagaggattgcctgaggttttagggccctggtgaatgggtcacatgattgaggatctcaagcccaaggaattcaactaacaactatttaaggagacatctttgtaaactgagaacaaatgaagtagggaatcaatgattcaaagtagggcattgtggcagaggataaacttgaatctagcttttaaggctgaggtttacacaagaggagtgagaatgagggatgttcttagggaagacaggaaaatatgcaaatgcactggcccagcaacagagctcctgggtccagaggagggacatgatagactgggtgtgttagaggacaggggatggaggaggtagcttaggagcccttggaggtcatagggaaagttctggtctcatagcgcaggagaggcaaaaatgtaatagtggtgagtttgatatagattgtgatgacatgccccgtgctgcccccaaaggtctttctatgcagtggggacagtgagagctgaggcagagtggcacttcaggcatatcaggcttggccaggccaggcattgctgtgagaagtacagtgtggtcatgactgggcaggtgacaggtgctcttgtcagtgagacaacatgttggaattttccaggattgggtcagttctcaattatgagaagccctgggagtcagggatgacctacatctccaccacacccagtgttctccaagctgtctttgtttttgtgttttgttttgggggaggttttttgagatgggggtctcactctgtcaaccaggctagagtgccgtggtgcaatcttggctcactgcagcctctgcctccaggtgcaagtgatcctcctgccacagcctcccaagtagccaagactacaggtgcacgccaccacactcgactaatttttggtatttttggtggagatgggctttcgccatgttacccaggctagtctcgaattcctgagctcagatgatctgcacaccttggcctcccagtgctggattacaggctccaagctgtctttgaatcactctaatcactctttcattccctttggtgttgggatgggaacagaggagtatgagctcttccaaccctcagtgcacagtgtggcttccagcaaattccagcataccctgctaatcacccaacttaggtgcctggttaccccagcactgtgaaacatgccaacacatgacagatttatgtcaaagatgaggactttacaaattatattaggttgggaagattataattcagtcccagcttggcaggaaaatggcttagttaagtcacctctagcaaagagagctgcccttctcctactgtgaaacctggcaaggattgtttctcacaaaggctcaggccacaggctatgaccacaaaagaacagaggagaagtagtgggagcagggcggtttccccaggccgacctggtaggcgctttgtagaactacagggagacttgtaagccactcgtctctttccctgtttagtaagcatgatttcttcttttttttttcctaaggtttaatttttatgaagagagattccaatcacatggttcaaaatttcaaaacatacaaaagggtgtagtcttctcccacttccctccctatcatccctctgcccctaaggcagccaggcactttccctccttcagtgttttggggagataatgccgtggataaaaatgggtttttttttttaagtgaagtattgtatacattctggtctgcatgtgcttaatagaatggagtttgttccacactagtatgtaatgagctgggctttctttttggctgtgttgtattccattgaacaaatgacttctatttatgcagcctgtcccctaatgatgagcattgaggttgtttacaccttttggtgagtctatttgcatcctacttggacatggtttttgtacaccttttcatcactccagtggaggagactcacctgcccaggacactctgcttcccctcttgtagctgaacttaactccactgaggttttctggggcccgagatctcggttcaggggagtccagcaacaaacattagaccagggttggaacggctggcacagtaacatcaatggaaagggacagagtttgagagttcaaacgtgatgcactcagcagccaccgccagcacatcctccacaccgtctcgtgcaggggcccacccatctctgtgtctttccagcacacaacagtcacccacactgggcattccattcagaggtgggagagaggaggacacccctcctggcccaggagcagaggccatcaaggtgtccccggaacttagagtagatacattgccaaaaggtgatatcctcattctcagggattctggtcttggagcagcccactccaaatgaggggccgtacagaccaaagtcacccctctgaggcagcgtgtggtgatactgatgcagccagagttcttagcaaaagttgatggatggggacaagcagctgctagattaagtaattcctcaaatttgtaaatgtcagcagtggaagaggagcagtctcttacccatctcttgctcaactttctacccccacgcttctcagcacaatgtccttaagcgttattggcgctcccaaaatagttgccaaatgaataagtgacctggggaaggaaaggaaggagggagggaacagaagattgcctgaaaaaggaggagagagttgggtggaaagaatgcattgagctgtgtgccttggttgcaatgcctgtcctgtgaccagaaaatgcatcccaacacatgtcaggctgtgtctagcaggtgggagggagtctggtggagaaatggcattggaccacatactcaccgctaggtctgttcgggatttatttttaattaatttttggtaaactatcaatgattgaatttgaccattgatggccaggtgtggtggctcacacctgtaatcctagcacttggggaggctgaggcaggtggatcccttgaacccaggagttcaagatcagcctggggaatgtggtaaaaccctggctctacaaaaaatacaaaaattacctgggcatggcggtgcatgcctgtagttccagctactcagaaggctgaggtaggaggatctcttgaaccagggaggtcaaggctgcagtgagctgaggtcatgccactgtattccagcctgggtgacaaagtgagaccctgtctcaaaaaaaaaaaagaattagaccattgatcccaggccaatttgctggcttgttggctgtaacaggatgccttctgaggatgggctggttgttcgagcttctggcttctccttcctgggcacatccactcacagctgccacattgtcccaaggaaccttgctttgctgaccaggaaacatgctgtgacaagctgagcggccatctgctatacagctttctgcctctgaggtgttcttagagtgggaagtgttgtagggaggtgtttgggggttcccaagactaccctcaacttcactgattcactggaaggatgcacagaactgttacacgtatggtgatggtttcttacaatgaaaagatgctgattaaaaccatcaaatgaaaaaagtgcatagggcagcgtccaggggaaaccaggcacaagcttccagttgtcctctccccatggagtcatgtggacaacacttctccaagcagtgcgtgacaacacacacagagtattgtcaaccaaggaccctcacttaagcctgggtgtccagagttttttggggagtctgtcacataggcatggctgagtatagtctccaaccccaccagaggtcaagctgataacgtgtagcccaaggccaccatcatatatcacattgttagcatagtctgtctgacctggtctaagcttaggctcacttgagcaaggacactcttatcaggcaggatattccaaaaacaaggaaccaggctagggccacacctctctttggaatgtggagtgtatggacaacccagagctgctgagctagccttttgctcagccccaggttggcctgcacacagacggcgaggggcaccagcactaccgcctttgcccttggtggtttttcctgcaccctaagacccgatttgtctctgaatccaccccatactccagctgccacagtcagagccccgggtttgagcatctgccatgggtgctcacgtatccctgccaaggcttgtgcctgtgcacactcccttgggaagggagagatggaacaaagataaatttcagatttctagattcagctcactgactccagattggcctccgtctacttatgatgaacctcatttatcagaacctgagtttacgagctcagtatgagaaacacagtattgatgcccttccgtcaggaacctggggaggtctcggtcacggaagcccacctgatgttataagatgtgttggctgcgagttgcagttgagatctgttggtcactgctgccctttgaaggccttagtgacatcctgtgggtgttccctgccgagtcctgtgggtagccccgctcactccccacacggttcctctgcccctgcacaagctgcaccctctgcctggtgcccttgccccaccccaactcttcgttgtgatttgtttttaggaaaactaagtccaaatggacaggacccccaactttctgactgcctaacttctcagtctctcctccagcctcaacagggagcctctctgacccccaccttaagctaaacaaagagtctgcagggagaggtgactctgtgtgtgtatgtgtttgtgtgcacgcgtgcagtagctttagtttctgcctcccccacaggactgtaagctcagtgaagcaaggactcatctgcctttcttggattccgagcattgcaatgttgtcaacaaatgaaaagctgagattgaacctcactcatcttgctctctgttagactgtaaacaccatcaggacagagacttgggattgtttcgtggacaaagagagaactcttgttggggttcaagggagtaagaagggcatcacctgtaatgcttagtaatcactgaaacaaggaagcactttgcatgtgcgtcctttacactgagggcacctgcggagctcactcccctagcagccacccaagtccgttcagggacctcattctcccacgggaagttggagaagatgggccgtggctctgcggaggggggtgtggacctgcctcggtacctggagcggttgaggcctgtcttggtggtggctggggcacaggtgtctgcctggcctgtccttacagactgtcagtgttctctttcctggtattttggtgtttgctctgtcaaacccttcttcctcattggttggaactaggtcacaagcacattaagtccggtcatttcctctgccttctgggggtggattttagcagaagaaacaactcctcccttgctggcctcatgacctctggtgaacactagctttcagcaaacagaaacttccagaggccagagcagcactcagtcgcctggccttccagcctcacaggcaagataagccaccctcacagacttctctgtgctcccatctaaacatctaaatcagccatctggtttccttaacagtagcacagactctgggagtttgagagaatgtgtctcttgtgaataagagaaaataagtccatactggggaaggtagctctccaaattgagatgaggaggtcagggtgggagggtgagtggtcgtgggttggccctgatgggaggagctcaccatcagggaagctgaggacctccctcctaatgtgacagcagagtcttggccacctcttcattccccagtccccaacctggctgctctgagtgtctttccagctactggaaagcttcttctgcagcctgcaaagctagctggaactggactgtcagaaaaacatgtagatgctggagaaaatctgttaatcctaacgtatagctctgccttattccagagaagaccgcagtgtggacatgaagatgataaacttgaggtgatggaaggagcagaaatgccagatacattagcagctcttttttcttttgaaaactagcccttgcaagatttgcttgacatactgagtgacactatccagaaaacatcttttttttacttaaaaaaggctgatggtttgttcagacatctcttgtgaactagtgaaaaacataaacgttgaaagctgtaaaattcagcagttctaagtttatttccagcaagagttaaacaaagtttaatagtaaattcaaccaaccagtgttttagctttttgcctatacattatgtttttaaatttcacccattaaacaaggactcaggttacacattgattccttaaggactttaaggaagccacaaccatttatttatagttgcattttgctcttcaggtttccaggatgtttaaaattttttttgactttgtttttaggcatcaagagagaatatatctaaaaaacatttgcatagttagtgtaattgctaagccacagggtgatgggtggatagattcagaggaaggcagctgagggcagaggctgcctgacagagcaggaaaaatgaagctcgagagccttctggctggaaaggcagctcacagatgggccgcagctgtagatcagttctgaactagggactgaagcaagtttgtcgtaaataaaggaaagtggtagtgttgatgttgtgaatgtatatccacaaccagaaccatcagctctggagggaccatcaggctgccactgtggccacagagcatcactcacgtctccattgggcagatttgcagagactcagcagtgaacagagcaagtccctgcctcgtggagctcatatgctgtgagcggtggctcatgcctgtaatcccagcactttgggaggccgaggcgggtggttcgagaccagccgggccaacatggtgaaaccccgtctctaccaaaaatacaaaaaactagccaggcatggtggcaggcgcctggaatcccagctactcaggagactgaggcaggagaatcgcttgaacacaggaggcagaagttgcagtgagctaatatcacgccactgcactccagcctgggtgacagagcaagactccatctcaaaacagaaaaggaggtggagaagaggggtagtggttggaagaaggaattctcctttagggaagatgtctgggaaggcctctctgagagagtggcctttgaaaggagaccctaattggatgagggatgagaggctgagccatgtaagtatctggatggaaaacattacaggcggagacagtggtgtgtgcaaaggccctgggacagggtcacccgtgttaacaggttttaaagctggaattgtggatgggctagagtcagacactaatagggcccagaggggacactggtccttgaaatagaatttgaggatttgaccatggccaggaggctcaggtggcccagtgggaactccttaaatgggaacttcctaaaggaagaatataagaaccaaagtccagggggcagtgccaggcccaacctgtgagggttcccagagttggagggctagagagaatctgcttccagttcaggccatagactctgaacctcacaggcacattgccatccatctcccctcacccccaaccgagacggagtcttgctctgtcgcccaggctggagtacattggcaccatcttggctcactgcaacctctgccttcagggttgaagcaattctcctgcctcagccccccgagtagctgggattacaggtgcccgccacaacacctggctactttttgtatttttagtagagagggggtttcaccatgttggccaggctggtcttgaactcctgacctcatgatctgcccgcctcagcctcccaaaatgctgggattacgggtgtgaatcactgcgccaccctctgccatccatcttaacatggcgccatgagccagcctctcaggaaaagggtctcatgaacaaatgaggaaagcaagtagaggtagggcagggagggagaggcaaaggaatgtgttgttggaaagggtagtgtgcccctcacagatgacagtacccgtctccagatgtgcccactgagagtttatgaaggggctgctccatgtggtccttgactgccctgggggagagtcacagaaagctataatgccactgcctctcggtttccccaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacaggtgagtgcatcttctaccatctgggtataaaggagcagaagtggggattagtgcaaatgaccaagactttcagtccacgtcagtgccatgaagggatccaacaaccctttaagttactcatcaggggatatttgtcctcaaacattgtgaaaccaggaactgttcttccctgatcccatgttcacttgattgacatctagtctgtcaatagcttctccaataattgtgaccccactactttgaaagagagggtgttcacctcagcgtaatctgtacaaatgtgactcacttcacataatttttgctttaaaaaatctttagggctgggtgcagtggctcacacctgtaatcccgacacttcaggatgccaaggtgggtagattgcttaagcccaggagctcgagaccagcctgggcaacatagtgggaacccagtctttacaaaaattacccaggcattgtggtgcacacctgtagtcccagctcctcaggaggctgaggtaagaggatctcatgaggcctggagatcaaggctgcagtgagctgtaatggtgcactccaacctgggctacagagggaggccctgtctcaagaaaaaaaaaaaaaaaagtctttatgtctaaatttgtcatatctaatccaattcgcccattgatttttatttgaaaattataaggctgggctcagtggcttatctgtaaaatcccatgctttcagaggctaaggtaggaggattgtttgagaccagcctagacaacatagcaaagacccgtctctataaaaactaaaaaaaaaaaaaaattagccagacatgatggcacgtgcctatattcctagctacaggggagactgaggtggaaggattgctttagcccaggtgttagagactagagttaagctatgatggtgccactgcactacagcatcagtgacagagtctccctgtctctaaaaaaaaaaaaaaaaaaaaaaagatttaaagctaaataattaaaatcaaaaaaataaagttagaagttgctttcctcaggttttggctcgaaatataaaatcatacatgagactgggggccaggcacggtggctcacgcctataatcctagcacttggggaggccgaggcgggtggatcaccaagtcaggaaatcaagaccatcctggctaacatggtgaaaccctgtctctattaaaaatacaaaaaattagctgggcgtgatggcgggcgcccgtagtcccagctactcgggaggctgaggcaggagaatggtgtgaacccgggaggtggagcttgcagtgagctgagatcatgccactgcactgcagcctgggcgacagagcaagactccgtctcaaaaaaaaaaaaattcatgagattttggtagacttcagtgttacatgttcaaggataaaggaatggagtttctgctgaagtagattactattgtttgtatttcagatcactgtgtctgtttttattacaaaaacaacatggccacattacagacaatctatactttacctaccgcaacacaaaaacagaaaatttcattttccccttattcagtattttcatagttgtaaccatagtattcttttggtttgatagcctttttcttccatttaacccagaaaaactgcttgatattatgtgataactcaggttccataaccatctctctctctctcttttatttatttattttttattttatttatttattttttttgagatggagtttcacccttgttgcccaggctggagtgcaaagacgtgatctcagctcactgcaacctctgccttccaggttaaagcgattctcctgcctcagcctcccaagtagctgggatcacaggtgcccacaccatgcctggctaattctttttttttgagacggagtctcactctgtcacccaggctggagtgcagtggtgcgatctcggctcactgcaagctccgcctcccgggttcatgccgttctcctgcctcagcctcccgagtagctgggactacaggcgcctgccaccatgcctggctaattttttgtatttttagtagagacggggtttcaccgtgttagccaggatggtctcgacctcctgacttcgtgatccatccgcctccgccttccaaagtgctgggattacaggcgtgagccaccacatccggcctaatttttgtatttttagtagagatggggtttcaccatgttggccagtctggtctcaaactcctgacctcaggtgatccacctgcctcagcctcctagagtgccgagccaccacgccaggctttttttttttttttttttttttttttgagacagagtctcactctgttgcccaggctggagtgcagtggcaccatctcagctcactgaaacctctgtctcccaggttcaagcaattctcttgcctcagcctcctgagtagctgggattacaggcatgtgtcaccatgcctggttaatttttgtatttttaggagagatggggtttctccatgttggccaggatagtctcgaactcttgatctcagatgatccgcccgcctcagccttccaaagtgctaggattatgggcgtgagccaccacacctggcctctctctttgttttaattctgtaatgtggagcttttctttttcattttatttatttattttttaagagatgaggtcttgctgtgttggccaggttggtcttgaactcctggcctcaagcagtcctcccacctcggcctcccaaagtgctaggattacaggcatgagccaccacacctaactgcagagccgttttttttaatgcatcactaaggtacagtaaaatatgtgcatcttaagtggagagccagtgactgtgaacctgtgtacactagtgtggccaccacccagatcaagatgtagggtgtggcagggaggaaattagataactacttcaaactcagagtggggctggggagaaaccagtgtaggtaacaaagctggtggtgatggcagaaagaacaggcaggcgaagccatcaagagttatggagaggttcaggcatggtggctcatgcctgtaatcccagcaatttgggagactgaggcaggaggatcacttgatcccagcctgagcaacatgacaaaaccccgtctctacagaaaaacacaaaaatgaagttgggcatggtggttcaggcctgtaatcccagcactttgggaggccgaggcgggtgcatcgtttgaggtcaggagtgtgagaccaggccagccaacatggtgaaacccagtgtctcctaaaaatacaaaaatcagccaggcatggtggtgcctgcctgtagccccagctacttgggaggctgaggaggagaatcccttaagcctgggaggcagaggttgtagtgagcggagattgcaccactgcacctcagcctgggtaacagtgagactctgtctcaaaaaaaaaaaaaaaaaaaaaaaaaaaaaggccgggcatggtgagtcacgcctgtaatcccagcactttgggaggccaaggccaacggagcacgaggtcaggagattgagaccatcctggctaacacggtgaaaccccgtctctactaaaaatacaaaatattatccgggtgtggtggcgggcgcctgtggtcccagctactcgggagggtgagaaatgtgtatggcgtgaacccaggaggcggagcttacagtgagctgagatcacgccactgcaacagtgagctgagatcacgccactgcactccagcctgggcgacagagcaagactctgacacacacagacacacacagacacacacacacacacacacacgaaaattagccacacacacacacacacacacacacacacacacacacacacacacacgaaaattagccggacatggtggtacgtgcttgtggtcccagctactgaggtggctgaggtggacccgaccttttggcttaggtgggaggatcacctgaacccagggaggttgagcctacaatgagctatgattgtaccagtctactccagcctgggtgacagagtgagaccctatctcaaaaaaaaaaaaaaaaaaagtactgcaggagggacctgcagagttggccctgggaacctgccggcctcagtgagtgccctggggaggcactagctaaggttatgagggttggttggtttttttggctcagccataatcaccattctgggttctccagctcaaccctaattttaaacatccgccatttccctccagttctagtcgttgcttgttttttgttgtttttttttcaatatacatatcagaaagatgttttatatcctaatctttggccacatttaattgccataggagaaggtaggatgttcatttgttttggtctaagacatcctccatgtacaaactcaggagcagagtgagcccttggaggagtgggaagctggcaagtttgtgactagcaccctttcacacccttccacatcctacatacctcttcacaaaggctgcttctggggctcttggaggcccctgcatccctgaacatagctatgaaagccatggaagtcctgtggctccaggggcagttttctttttttggagcatcatgaaaactcaggggcttcccagcaaaggcttccatcagtgaggcagccatagttatttcagtgaggtgggctttgtctcttgggaagtcctgtttgtccttgctgacagctttccaagctgcttgttctcatttccacttaaagctgatgcgttcccgtcaaggtccccaaagtcatgtaccctgcctggcctgcccctagattagccccaatcagttgtagcattcttgccatctcttagtaaattcaagaaagcaaaactttcacccacactctgcagttctgtgggagcagaagctgcaggaatgcagtctgtctgttggaagatatgggggaggcagacagtccacagggatgcagtggggacccagaggagagggaggttggccctgggaacagaggaaggctgcacaaaggacctgactttttgcagaaggtgaaggttttgagggaacccaccaattgaaggaggggttggtgcaggcacatggcagtaaaagcacaggggaagccgggatgaaggaagttgttggccatttcaagggcccagcagggccagacacagtggctcatgcctgttatcccaacattttataaggccaaggcaggacaatcacttggggccaggagttgaagatcagcctgggcaacatagcaagattctgtctctacaaacataaaaaatttttaaagctgggcatggtgatacaggcctgtagtcatatttacatggacgaccaaaaaaaaaaatgggggggcggctgggtgcagtggctcacgcctgtaatcccagcacttttgggaggctaaggtgggcggatcacgaggtcaggagatcgagaccatcctagctaacacggtgaaaccccgtctctactaaaaatacaaaaaattagccaggggtgatggtgggcacctgtagtcccagctgcttgggaggctgaggcaggagaatggcatgaacccgggaggtggaggttgcagtgagccaagatcaagccactgcagtccagcctgggcgacagagactccatctcaaaaaaaaaaaatgcaataaattgtgagtaaaatttttgtgatcctgtcaaaacctttaatccataaatgcaggaatactgtcacttaaaaactttgccttttttttttttttttttttaagacaatgtctcgctctgtcgcccaggctggagtgcagtggtgcagtctctgctcactgtatcctccacctcccaggatccagcaaccctcccacctctgcctcccaagtagctgggactacatgcatgggccaccatgcactgctaattttcgtattttttgtagaaacaaggtctcactttgtctcccaggctgatctcaaccacctgggctcaactgatcttcccgcctcagcctcccaaagtgctaggattgcaggcatgagccactgtgcctggcccacttaaaagctttttttttttttttttgagatggaatctcgctctgtcacccaggctggagtgcagtggcgtgatctcggctcactgcaagctccgtctcccacgttcacgccattctcctgcctcagcttcccaagcagctgggactacaggcacccgccaccacgcccggctaaattttttttgtatttttagtagagatggggtttcaccatgttagccaggatggtctcgatctcctgacctagtgatctgcccgcctcggcctcaaaagcttttaaaataagtttctcctatcaaacttctgttcagtcatgcatttcctgtgtacatcattatcacacaaacccttcggccttctctgaagttttgtctcttgggaagccctgtttgtccttgctgacagctttccaagctgcttgttctcatttccacttacagctcatgcgttcctgtcacatatgcacccttaatttgaaattctctaacttatttaagacttggtttctgaccaggaaccaccctctcttaaacctctactgtcttatcacttttctcagtctccctagaaattggctttcttggctgagcgtggtggctcacgcctataatcccagcactttggaggttgaggtgggcggatcacaaagtcaggtgttcaagaccagcctagccaacatgatgaaaccctgtctctactaaaaatacaaaaatcaggcctggcacggtggctcacgcctgtaatcccagcactttgggaggccaaggagggtggatcacctgaggtcaggagttcgagaccagcctcaccaacatggagaaaccctgtctctactaaaaatacaaaatgagccaagcaaggtggcacacacctgtaatctcagctacttgggaggctgaggcaggagaatcgcttgaaccagggaggcagaggttgcagtaagccaagatcgcaccattgtaccccagcctgggcaacaagagcagaactccctctaaaaaaaaaaattagccgggcgtagtggcgctcacctataatcccagctactcaggaggctgaagcaggagaatctcttgaaccagggaggtggaggttgcagtgagccgaggtcatgcccctgcactccagcctgggagacagagctagactccgtctcaaaaaaagaaaaagaaaaaaattggctttctttgtgggggagccatttttcacaaagaaaccattgttttcctcatttatgtattaccagtatatatgtgatggcacatagaaagaataaagccagcgttgagatgtgcaggctgaaaggtggccaggcagactcagaagccaagtgtctcttcctactcccagcatggcaatgcactgcccacagtggtgcttagaggagccagttctgtgttctagactttcagtcacagcttccgtggggtgaaatcctggagtgttaaatccttccattcaccaggctctgctgcattctacccatagctggagccctgggcctgcaaaacccttagcttgcgggagtctggacttgctcttgcaagttgggagtcattaaagactttaactgaagaggtgcttgccagtattgctttagaaagatgcgcagcacccatggggagtaaggattggaagggagggaattgaattgagaggcattgccataatccttgttaaaggtaaagaaaagcaaggcaggccgggcacggtggctcaagcctgtaatcccagcactttgggaggccgaggcgggcagatcatgaggtcaggagatcgagaccatcctggctaacacagtgaaaccctgtctctaaaatacaaaatacaaaataaaatacaaaaaccctgtactaaaaatacaaaaaattagccgggcgtggtggcgggcgcctgtagtcccagctacttgggaggctgaggcaggagaatggcgtgaacccaggaggcggagcttgcagtgcgtggagatcacgccactgcactccagcctgggtgacagagcgagactatgtctcaaaaaaaaaaggcaaggcagaaggagaggctgggtttctgggctacttagggggtgggagatcaagagggcgtttgttttgcctggattactgggagtagcgctgtgcagggggagggcaaaaattgcgagtaaccctgattcccagattggctggcgaagtggtcaggctgctgttgagatagaggagagcaggctgttggggaggcacagctcccagctggaggcacctgccataccttagggggctcagcaggatgtcggggatcagcagggcatcaggcatagtctaaatgactttgagttgcaagagctatccctgtctacagccagagtcagcaaactaggccacggagcaaaatcaaagatattttatagggacttacgtgatgagaaaaaaacatactttcacaactttttagtgacaaaatttaaaatataaaaacagtggccgggtgcagtggctcacgcctgtaatcccagcactttgggaggccaaggtgggcggatcacgaggtcaggagatcgagaccattccggctaacacggtgaaaccccgtctccactaaaaatacaaaaaattagccgggcgtggtagtgggcgcctgtagtcccagctactcaggaggctgagacaggagaatggtgtaaacctggtcagcagaggttgcagtgagccgagatcgtgccactgcactccagcctgggcaacagagtgagactccatctcaaaaaaaaaaaaaaaaagtaataggctggacacagtggctcatgcctgcatggctgtaatcctggcacttttggaggctgaggcagggggatcacttgagtaggcacctgtaatcccagctactcaggaggctgaggcagaagaatagcttgaacccgggagatggaggttgcagtaaatcgagatcacgccactgcactccagcctgggcaacagagcaagactctgtctcaaaaagaaaaaacaatttaagaattggccaagcatggtggcttatgcctgtaatcccagaactttgggaggctaaggcgggcggatcacctgaggtcaggagttcgtgaccagcctgcccaacatggtgaaactctgtctctactaaaaatacaaaaaatagccaggtgtggtgggggcctgtaatcccagctactcaggagcctgaggcaggagaatcacttgaacccgggaggcagaggctgcagtgagccaagattgcgccactgcactccagcctaggtgacagagcgagactctgtctgaaaaaatttaaaaaaaaaaaaaaaaaaaaaaaagccaggcagggtggtgagtgcctgtggtctcagttacccaggaggctgaggtgggaggatcacgagcctaggagttagagacttcagtgtttgcaccactatactccaaacttggtgacagagagagaccctatctcaaacaacaacaacaaaaacagtaatagttgagtacagtattctggtaatataagtgcactaatgagaggaatgaaactcttgaggttctaagtttgtcatctgaggtgcacatggtcatctctaaggccattctttgctcatggtcatataaaaacaggtgaaattttgttttgtgtattttaccataataaaaataacttggggccaggcgcagtggctcatgtctgtaatcccaacactttgggaggccgaggtgggtggatcacttgagatcaggagttagagaccagcctggccaacatggtgaaaccccatctctactgaaaatacagaaattagctggggatggtggcacctgcctataactgtaatatcccagctactcgggagactaaggcgggagaatcacttgaacccgagaggcagaggttgcagtgagccaagatcacgccactgcactccagcctgggtgacaaagcaagactccatctcaaaaaaaaaaaaaaagaacggggaaacagtacaaaaacaggaggtgagccagatgtgatcagcaggtcattgtttgctgactgtagtctaaagtaccggtttggttgttccatgtgcttttcatctgcctggtcctaggaatccaggtttccctgagagagggccacctaactcgatgctacactgctttttttttcttttttttcagtaaagacaaggtctcattatgtttcccagatctcacactcgtgggctcaggcaattctcccacctcagtttcccaaaatgctgggattacaggcatgagtcaccacacctggcttagctgccacacttctgaggcaggggtcttcataagcttactgcttggcccactgtgctcctgggagaagctgttgaaatccctactttggtcagaaggagtttggcacagaggaggcatttgatttttagcacacaggcattatgtgaaaagactgataacattgtcataggggtttttcctttttaaacgttttcttttttgtgaacttttatccaaagattgaaagaagctataagtacaagtaaagaacaggaagcaaagtaccaggccagccacccaaaccttagaaagctggatgatacaggtaagtggatacctgtgtgcacagccacatttgaattctggggggagacctctaggtttggcgttggtccttggggggcagtggcaacctctctggggaggtgggcaggggccccagctgctggcatcacccatgctagccaaagggccttagggaccccgcatgctcttgcggagctgggggtgtgcattatggtggggctcctccttctctccctccctccctccatggagaggagaacaaggaagtgagggcctgcattccattgaaaatgagcctgcccggccagcctggtgcagtaacacacgcctgtaatcccagcactttgggaggccaagctgggtgaatcacctgaggtcaggagtttgtgaccagccttactaataacgtggtgaaaccctgtctctactaaatacaaaaaaattagccaaatgtggtggcacatgcctctaatccaagctacttgggaggcttggacaggagaatcacttgtatctgggaggcggaggttgcagtgagctgagatcacgccactgcactatagcctgggcaacaagagtgaaactctgtctcaaaaaagaaaatgagcgtgcccatcattggttcctgcctgtgtcattctcaattgttccagcagtaaaaagccaactgcagaaaaaccccttggtaaatagaatactggcccctcaaagctgtccacgtcctaatccccagaccccgtgagtgtgttaggttatatggcaaaggtggaattacagttgcagatggagttacaattgctaatcagcaagatggggagattatcctgggttgtccagttgggtccagtgtcatcacaaaggtcccttttaagtggaaagagaagcaggagagagagcagcagagtcagagatctgaagatgctgctggccttgaagatagagaaaggggcccacctgccaaggtacacgggtgaactgtagaaactgcaaaaggcgaggaattagattcttcccaagagctccagaaggagtgcaaccctgaggacaccccgactcagcccagtgagacccatgttggacttctgacctccagaaccgtaagacaagtttgtggtcatttgtcacagcatcagtgagggactaatacagcctccagcccaagcagaaggagcagcagccacatggacaaggtgtgcaagacagtgttgatcgaatcattccacttctatcaagtgataggcccagaaacatcccttatctggaaaggaatttagggctcctggggcctcctccataggcccccacaatagccaggtacattgaaattggtgctagaaaccaaaggcttactgtgctgccttcaagaaaacgatacaccatggaagctctggaacccaccatggttgtggttgatgcagctgaggagagcccagatggaggaagagcggggagcaggagagactaacatcatcagcacagttcattctggaaaggcaagtggaggaagtgagtgtaaattgaaaggcaagggctgggaaaaccggcctcatcacaccctggagaaggggcacaggacactgcacccaagacacaattttaaggaattaaagagagtttttatttgtgcagtatatattaacttaaaagactgaagaaaaaatcgacacagtttgcagaatggtttcagttggttggtgctggaggaaatgtgctaagtctagaaagtgaagtttccctgaaagagataaaccgggatgacagggcttttccgtgtgcgtttagaaactgaagttcattcaagccaagaaagataattttaaaaaagaagaaactaaaagttcaaggaagatttcttgtggcaaatgtgcattatttaacatttcttttttttttttttgcgtatttgtttcaagtgcaaagatagtgtagaaataaatttcagaaagaaacgaaattacccataattccatttatgtaacgtaacaatttgtatttttatactttgtccacagactgtgtagttttgcattattgcagttccacttctgtattgtcacttgtgtgactctgtctttcctgagcttgtgcaccaggagttaggtgacccttaatttgagggtgtttgatctcccaagtactgagggaaagtgagaaccctctcctaccccgtggaagcgtctcttcttctggcccatgagcctgcgctgtgctcctccctcatccctctggatagcctcagaaccaaccccttcgttccttccacccattttccagatgaaattgttttgggtgtgtgaagcagcatttgaaggaatgtcaattaaccgctctcctggtgtttccttctaaacttagaccctgtccccagaggggctggttctgccatgagtactgatgcttacccaaagaacccacaccttcgagcctatcaccagaagatcgacagcaacctaggtaagactgagcaccacaccagcttctgtaagccactgtccttcaggcagcttacgccaagcatagcccctgcatgagcatcctccagcttcagttccctcaccacacatcacatcccacgccaagctgggtccatcttgccacctcactgtctctggaatctctccacttctcaccatttcctacttctagcccagccgagccctccccacctctcactttcatgaacagcaccagggacccaggagtccctgagaggccataaagtatagcctggacgtgaccgctcacttcatccttcccacctggccactcagagccctgttttcctccttgtgaaatgggctacctctgagaacagtggaaaggttacctgagccagaaagtgcctgggatggtaagagttagtgctcgtgttgcaattggcactttggccacacagcctccagcatgatgtttcaaaacggaagggtgtgcagggggccgggcgcagtggctcacgcctgcaatcccagcactttgggaggccaaggcgggtggatcacccgaggtcaggagttcaagaccagcctgaccaacatggtgaaaccctgtctctactaaaaatacaaaaattagccgggcgtggtggcaggcgcctgtaatcccagctatcgggtggctgaggcaggagaatcacttgaacccgggaggcagaggttgcagtgagccaagatcgcaccattgcactccaacctgggcaacaagagcgaaactccacctaaaaaaaaaaaaaaagaagaagtgaagggtatattcttccagaactctctcatggaaccccacacactcacagtgcagtccaggctctctttggctgccctagtcccttctgccctcatcacctgcaggctcgtgtgggatttctgatgtgagttctttctgcctcgtggcccctatctgcctggatgggctcccccgactctctgtaggctggctccttctctttctgtcagtcttgcattagtatggcctcctctccctgtctctcaggacccttgtgtttccagggggctgccctggccgtttgtgattgtgtatctgctggtttgcctgctgtcttcccaatcagactgtagattccaggacagcatgggagtgtttccattttgtcactactttgtatctggggcccagcaggcaagcacttagtgattatgttttgttttgttttgttttgttttgagacagagttttgcttttgttgcccaggctgcagtgcaatggtgcaatctcagctcactgcaaccgctgcctcctgggttcaagcgattctcctgcctcggcctcccgagtagctggaattacagacatgcaccaccatgctcagctaattttgtatttttagtagagatgaggtttctccttgttggtcaggctggtctcgaactcccgacctcaggtgacccgcctgtctcggcctcccaaagtgctgggattataggtgtgagccactgcgccctagccagtgattattttttgaatggaaaagtcagttacttgaaattcaagtaggtgttggcctgtgggcagttctgtgagtttattctaagtagtgtctcagacttgctgcctcctcctaccgctactccctgagcagaaatctcccccgtggtgacctgggtcaccctgtcagtctcccaccccctgttaggagttggcaaagtgtaggggacaaataataaaatcctcccctgctgtaaaggtatctagtggaaggcaaaactgaaacccatgaagatgcacatggagtgtctgtgcacgggttttctcctgcttgctgtctgggaagccccagacagctgccacctccttctatgccctggactctgtcctccagagccaaagacttatctgaggcagaaggtgtgtctgcccagatctaaccactccagagaagcccagagaggcgtgaaagccctttgtccttcactgcgagaaagggagaggttagggctagtggtatggttggtgcctgctggcagaagtgggagaagggactttgaggaaggatactgcattcagaggcaggaagaagtgctgagtactgcccgccactaggaggtgctgagggtgcacagttggcactgtggacgagcagctgggcagttaccggcaggacgcagtctagagtaggaggtgggcctgggcagaagggcgagtggctagttcagagctcagccctctggccctgctgacacaggccaggccggtccactctggtggggcagggagtgttgcctttgttcacactcttcccgtcttaacactatctccctgctatttcaggatctcaggcaagctctctggactccagcgccctggcctggtggttttacattatcacacattttatctcagcctctctgtttgcttatcctttgctgccctggctgccagtgagcttcctcctgaggcctgaggcaaccacaggctctgctctccatggagcacgaggccatgaattttagtaagcttaagaagcaaagagctgaagacttatcttttttttttttttaattttaattatactgtttttctctttcttttcttttcttttttagaaatggagtctcgctttgttgcccaggctagtctccaacttctgggctcaagtgatcctcccacctcagcctcccagagtgctgggattacaagcatgagccactgtgcctgacttgaagacaatctttttatttttatattttttaatttctttctgagagttttactctgtcgcccaggctagagtgcagtggcacaatctcagctcactgcagcctctgcctgctgggttcaagtgattctcatgcctcagcctcccgagtagctgggattacaaggtgtgcaccaccatgcccagctaatttttgtatttttagtagagacggggtttcaccatgttagccaggatggtctcgatctcctgacctcaagtgatccacccacctcggcctcccaaagtgctgggattacaggcatgagccaccacactcagcctatctttttatttcattttttgagacggagtcttgctctgtcgcccaggttggagtgcagtgcattgatctcagcttactgcaacctcctcctctcaggttcaagtgattctcttgcctcagcctcccgagtagcagggaatacaggcatgcaccaccacatctggctaatttttatattttttagtagagatggggtttcaccatgttggccaagctggcctcaaaatcccgacctcatacgatccacccacctcagcctctcaaagtgctgggattacaggcatgagccattgtacccggccaaaactacctttttaaaaaaactgattttggccgggcgcggtggctcacgcctgtaatcctagcactttgggaggccaagacgggcggatcacaaggtaaggagttcgagaccagcctggccaatatggtgaaaccctatctctactaaaaatacaaaaaaaattagtcgggtgtggtggcgtgtgcctgtagtcccagctactcaggaggctgaggcagaagaattgcttgaacccaggagacggaggttgcagtgagccgagatcatggcactgcactccagcctggacaaaagagcaaaatgctgtctcaaaaaaaaaaaaaacaaaaaactgattttgcttagatttgtggtaccagtgctaagcctttgtgtatcctgatcctttttctcttagtgttttatatttaatcttgcaagtaagaaggcttacaaagcaccacctcttctctctcctctctggctctttcctggctgctgttcctagtaaaaaggcagaaagcagccctgggcatatctccctacccccagcgtgcacaaacacacacacacatacacacacacacacacagtcacaaacctgggaaaaggctttactcttcaccctgacagaatcaattaagtcaagactcatctctgcagtgggtgcagtccccccaggcaacacagatccctgtctctcccacttacccacaccatcaagaagcatttgcaggtgccgtgactgtttgctcatgcctgcgtgtcatttcctcctcctgcagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccgtaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgattgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcaggaggctgaggcaggagaatggcatgaacctgggaggcagagcttgcagtgagccgagacagcgccattgcactccagcctgggcaacagagcaagactccgtctcaaaaaaaaaaaaaaaaaaaaaatagtgcactctctggctggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaaatttctctttaacctctttttgtgaatatgtaattttaagtgtacactataccaatttagtaataatcttatactttgcccatatgggccttttctgcagattttttttttttttttttttttttgagatagagtctcactcagtcacccagcctggagtgcagtggcacaatctcggctcactgcaacctccgcctcccaggttcaagcaattctgcctcagcctgtcgagtagctggggttacaggtgtgcaccaccatgcccggctaatttttttatttttttaatacagacagggtttcactgtgctggccaggctggtctccaactcctgaccttgtgatctgcccgcctcagcctcccaaagtgctgggattacacgtgacctgtagaattttaaagttacaaatgttgttcagcatcttcagctctgatgaatgcggtgtcagtacaaaatgatgagctagagccagggcatggtggctcatgccaataatcccagtgctttgggaggctgaggcaggagaatctcctgaggccaggagtttgagaccagtctggacaacatagtgagaccccacctctagaaaaaatttttaaaaatagcttggcctctagtcccagctactttggaggctaaggtgggagaattgcttgagctcaggaatttgaggctgcagtgagttatgatcatgccactgcactctggcctgggcaacagagggagaccctgtctctaaaaaataataaaatgatgagctaagttcgagaccagcctggccaacacagtgaaacgctgtctctattaaaaatacaaaaattagccaggcatggtggcatgtgcctatagtcccagctactcaggagactgaggcacgagaatcacctgaacccggaaggcagaggttgcagtgagccgagaccacaccactgcactccagcctgggtgacagagcgaaattccatattaaaaaaaattgatgagctagtcattaaaagtgctcattatggctgggcatggtgactcgcctgtaatcccagcactttgggaggccgaggcaggcagatcatgaggtcagaagatcaagaccatcctggctaacacggtgaaaccccgtttctactaaaaatacaaaaaattagctgggcgcagtggcgggcagctgtagtcccagctactcgggaggctgaggaaggagaatggcgtgaacccgggaggcggagcttgcagtgagccgagattgtgccattgcactctagcctgggtgacagagtgagactccgtctcaaaaaaaaaaaaaaaaaaggaaaaaaaaaagtgctcattatgtggggatgggatgggctctttagttcgaactgtttcagaacagcacttttcctccatgccttcaactcaacaagtgaccatattccatcaaaatgtgaagttgtttttttaaacaaattttgtctcctgtgtagttatttcttagtgagttggtggaggggatcttcctcgttgagtcttcatgcatttggtctttgatgccacgtttagccctatgaactaccttctgtcctgaaaccctctcatcagttttccggtgtgtctcctagctccctacccgctctgcagcactatctagaccagggctcagcaaatttctgtaaagggccggagagtcagtgtttcaggcttacaggccaaaccatctctatctctattgcagctgctcagctctgccattgttgcataaaagcagccaaagatccgggcgcagtggctcacgcctgtaatcccagcactttggaaggccgaggcgggtggatcacttggggtcaggagtttgagaacagcctggccaacctggtgaaaccctgtctctactaaaaatgcagaaattagccaatcatggtggggtgcacctgtagtaccagctacttgggaggctgaggcaagagaatcacttgaacccaggaggcagaggttgcagtgagccgagattgtatcactgcactccagcctgggcgacagagtgagtttcaaaaaataaagaataaaagcagccaaagacaatacgtaaataagtgagagtgcgcgagagtggctgtgttccaaagctttatttatggagactgaaatttcacataattcacatgtgataaaatgctatgaattttttttgtttttgagacagcatcttattgtagaatcaaaaggtctgagaaagcatctgtaggttaggctaggccattttggaattttttttttaattaattttttttttttttgagatggagtctcactctgtcttccaggctggagtgcactggtgcaatctcagctcactgcaacctctgcctcccacattcaagcgattctcctgcctcagcctcccaagtagctgagattacaggcgcccaccaccacgcccagataattttttgtaactttagtagagacagggtttcaccatgttggccagggtggtctcaaactcctggcctcgtgatctgcccacctcagcctcccaaagtgctgggattacaggtgtgagccacggagtctggcccatcttggaaatttttatctgtcagtgggctagctccccgtgtcccaaaagccactgtggttttagtggaatatcatctttatttatttatttatttatttatttatttatttatttattttttatttttttgagacagagtcttgctctgtcgcccaggctggagtgcaatggcgcgatctcggctcactgcaacctccaccttacgggttcaagtgattctcctgcctcagcctcctgagtagctgggattacaggtgcatgccaccaagcctgactaattttttgtatttttagtagagacggggtttcaccctgttagctaggatgatctcgatcacctgacctggtgatctgcccgcctcggcctcccaaagtgcagggattacagacgtgagccactgtgcccggccaaatatcatctttaaatatcatcattataaataaggaatgatgaggatttgaacccaggcagtggacttttctggggagacaaagaagtggacattacaagctggatgcggtggctcacgcctataatcccagcactttgggaggctgaggtgggtggatcacctgaggtcaggagttcgagaccagcctggccaacattgtgaaacctcgtctctactaaaaatacaaaaattagctgggcgtggtggtaggcatctgtaatcccagctactcaagaggctgaagcaggagaatctcttgaacccaggaggcggaggttgcagtgaaccgagatcgcaccactgcactccagcctgggtgacagagcgagactccatctcaaaaaaaaaaaaaaaaaagaagaggacattacagaggaagaagcataagtgaaaaaaatcaaggcggctcacatttggcatctgcaagtagggaactggcgttatgggttgtgggtgggagatgacatgaaaggtaggcaggatctaatctaagaggccttatgagccatactgaggagtcagaatattgcacttcaatgacagggaggtactgatggagtctaagcaagcgagtgacgtgacaagattcagattttgaaagatcataaagatgcatcaccgcattatttataaaagcaaataatggctggacgcggcggctcttgactgtaatcccagcactttgggaagccaaggcaggcagatctcctcaggtcaggagtttgagaccagcctggccaacatggcaaaaccctgtctccactaagaatacaaaaattggccaggcgtggtggcagacacctgtaatcccagctactcgggaagccaaggcaggagaatcgcttgaacccgggaagcaaaggttgcagtgagccaagatcacaccactgtgctccagcctgggtgacagagcaagactctggctcaaaataaataaatataaatataaataaataaaagcaaataataagcctagaaacaacctgattaggaagatgatggagtcaactatgttcacccatagctgcaacagacaattgcatctatgaaaagtcttcaaagataatgcttgcaagattaacataaaacattatatggtatggtcccaactttgtggaaaagcaaaccaatatatgaatttcaaacaaaaaaaaatcactcttgcatcagtgaggaggacaagctgggaacagagtaaggaaaagactttggtcatggtccaagcaagaattgaagaggggcccaaactagagtggtggcaggacagaaagggagagatggggcagactgcagagcactgggtaggacaggctttagtgaccaactcaccaatgtaggatgacgtagaaggaggaagcgaagatagcactcaggcttctgggcaaaggaattagtagacagtgtttttcacaaaaggaatacaaaaacaggccaggcgtggtggctcacacctgtaatcccagcactttgggaggccaagatcaatgggtgggtgaatcacatgaggccaggagcttgagaccaccctgggcaatatggtgaaaccctgtctctattaaaaatacaaaaaattacccacgttggtggcgagcacctgtagtcccagcttctcgggaggctgaggcatgagaattgcttgaacccaggagatggaggttgcagtgagccaagattgaccacgcaccccagcctgggcaacagaacaagactctgtctcaaaaaaacaaacaaacaaataaacaacaacaaaaaaaacatggctgggcatggcagctcacacctgtaatcccagcactttgggaggcagaggcaggaggattgcttgagtccacgtgtttgagaccagcctgggcaacatagtgagaccctgtctttacaaataataaaaaattagccaggcattgtggtgcatgcctgtgttcccagctactagagaggctgagacaggagaactgcttgagcccaggaagtcaaggctgcagtgagccatgaccatgccacttgggcaagagagtgtgaccctgtctcaaaaaaaaaaaaaaaaaaaaagcacaagcaagtttggggttagggacattgatgaactaggtactggacaggttaagtttgaagacctttgggacatccagatggatcccaggtgctgcaccaaaagttatgcacaaaacagatcagaatccctgccctcatggaatggacagagaagacaatgaataagacaagtagaaaattaataggctgggcgcggtggctcacgcctgtaatcccagcactttgggaggccgaggcgggcagatcacgaggtcaggagatcgagaccatcctggctaacacggagaaaccccgcctctactaaaaatacaaaaaattagccgggcgtggtggtgggcacctgtggtcccagctactcgggaggctgaggtgggagaatcgcatgaacccaggaggcagagcttgcagtgagccgagatcgcgccactgcactctagtctgggcaacagcgagactccatctcaaaaaaaaaaaaaaaagaaagaaaattaataggccaggccaggtgtggtggttcaggcctgtaatcccagcactttgggaggccgaggcaggtggatcacctgaggtcaggcgttcaagaccagcctgaccaacatggtgaaactctctctctactaaatataaaaaaattaactgggcatggtggtgcatgcctgtaatcccagctactcaagaggctgaggcaggagaatcgcttgaacccgggaggcagaggttgtactgagctgggatcatgccgttgcactccgacctgggcaacaagagcgaaactccatctcaaaaaaaaaggaaagaaaacaggccaggcgcagtggttcacgcctgtcatcccagcagttcgggaggccgaggcaggcagattacctgaggtcaggagttcgagactaacctggccaacatggtgaaaccccctctctactaaaaaatacaaaaattacaaaacaatttaaaaaactacaaaaattaggctgggtgtggtggctcacgcctgtaatgccagcactttgggaggccgaggtgggtagatcacctaaggtcacgagtttgagaccaatttggccaacgtggcaaaatttgtctccactaaaagtacaaaaattaaccaggcgtgctggtgggtgcctgtaatcccagctactccaggggctgaggcaggagaatcgcttgaacccgggtggcagagattgcagtgagccaagattgccccacttcactctagcctgggcaaaagagcaaaactccatctcaaaaaaaaaataaataaataaaaatacaaaatacaaaaattagccaggcatggtagtgggtgcctattaattccagctacttgggaggctgaagcaggagaatcgcttgaacccaggaggcagaggttgaagtgagccgggactgtgacattgcactccagcgtgggtgacaagggcaaaactccctctcaaaaaaaaaaaaaaagagaaaagaaaattaatagaatattaaatgtgaccatggtgaagtatttgcatatgacctatgtacattctcctgtatactttttgttgttgtttgttttgttttgtttttgagacagtctcactctgtcacccaggctggaatgcagtggctcgatctcggctcactgccacctcggcctcccaggttcaagcaattcttgtgtcttagcctcctgagtagctgggattacaggcatgccacgcctggttttttttttttttttttttttttttttgcgacagagtcttgctctgtcacccaggctggggtgcaatagcacaatctcagctcactgcaacctccacctcgcaggtttaagcgattcccctgcctcagcatcccaaatagctggggttacaggcacctgccaccacgcccagctaattttttgtatttttagtagagacagggtttcaccatgttggccaggctggtcttgaactcccgacctcaggtgatctgcccgcctcagcctcccaaagtactgggattatagacatgagccactgcacccagccatatacatattttgagacagtgtctcactctgctacccaggctggagttctgtggtgggatcacggctcactgcagcctcaacctctcaggcataagtgatcctcccaccacagcctcctaaatagctgggattatagacatgtgccaccacacccaactgatttttttattttttgtagagatggggttggccaggctgctctgaaattcctgagctcaagtgatcagcctgccttggcttcccaaagtactgagattataggcatgaaccactgcgcccagtctagaaatttattttctcacagttctagaggaaccaaagtgttgggtcccttctgagagtggtgagagaaagatctgttctgggtctctccctggcttgtacagggcagtcttctccctgtatctttatatcatcttaaggacaccagttatactggattagggcccaccccaaagaccttactttcagtaattacctttgttaagaccctatctccaaataaggtcatattctaaggtactggggattagaacatccacatatgaatttggcaggggagtcaggggagcacagttcaacccagaacctatacaaataagtttcagctggaaggagctgacatctgacggcctttcttttctttatttattttttattttttctgagacggagtctcgctctgttgcccaggctggaatgcaggggagcggtctcagctcactgcaagctccacctcccgggttcatgccattctcctgcctcagcctcctgagtagctgggacaaccggtgcccgccaccacgcccggctaattttttgtatttttagtagagatggggtttcaccgtgttagccaggatggtctcaatctcctgatcttgtgatccacccgcctcagcctcccaaagcgctgggattacaggcatgagccactgcacctggcctggcctttattttctttgcgtggctgaaattggatggagcagagatagatgactggagagttagatcaccaaggatagggctgtcatagacccagctaagacagggcacttagaaggaccctggtctttaacacatttcatggatttaaagaaatagagtagcagtttctagccttagagtcactagttagcttcgcagctgcttagcagcaggtagtagaggacctcaccaatacggctgaagttcaagagcaggactcctgaaccaggccctctgtcttgcacctataatcccaggtactcgggaggctaaagcgagaacacttgaggccaggagtctgggaccagcatgggtaacacagcaagcactggccccctacacttcttagaaaattaaatttttttttggagacggagtttcattcttgtgacccagcctggagtgcaatggcgcaatcttggctcactgcaacctccacctcccaagttcaagcaattctcctgcctcagcctcccgagtagctggaattacaggcgcacgccaccacacccggctaatttttgtattattagtagagaaagggtttcaccatgttggccaagctgctcttgaactcctgacctcaggtgatccacccgccttggcctcccaaagtgctgggattataggagtgaactactgtgcccagctaaaaattaaattttaaaaagatcaagcctcctgtccctgggctgaccagacagccaagaaaggcaagttagaaatcagggctctggcttaaggcttagggcaaaggtctggttccctgactacggtcacaaggcagaagtctaggtgccagacccagggctcaaatcagagaaaaagtaaagctgacttgacattgatctttgcatttaagtgctttaaatattccccaaaaaatgtcccaaaatccggataggacttgacttgactgacacttgcttagttgcccatgctggattgcagtgatgtaatcatggctcactgcagcctcgacctcccaggcataagcgatcctcccacctcagcttcctgagtagctggggccacaagcacatgccaccacgtcctgctaattttcttttttttttttttttagaccaggtctcgctgtgttgtgcaagctgatcttgaactcctaggctcaaatcatcctcccacctctgcctttcaaagtgctgggattccaggtgtgagccactccacccagccaggacttgaccatagactaaaagcaaaagagtgaggcaagccatttataaataggaaagaaactgctcacccgacccccaccaatgctgaaggaagcacaacaacaccctaaagaagatacaaaccttggagacaaagagcacctctaggtcatttagaaattaaaccaagctgggcatggtggctcacgcctgtaatcccagcactttgggaggctgaggcaggcggatcacgaggtcaagagatcgagaccatcctggccaatatggtgaaactccatctctactaaaaatacaaaaattaggccgggcgcggtggctcacgcctgtagtcccagctactcgggaggctgaggcaggagaatggcgggaaccaggaggcagagcctgcagtgagccaagatcgcgccactgcactccagtctgggcgacagcgagactccgtgtcaaaaaaaaaaaaaaaaattagttgggtgtggtagcacttgcctgtagtcccagctacacaggagaatcgattgaacccgggaggtggaggttgcagtgaagtgagatcgcgccactgcactccagcctggcaacagagcgagactccatctcaaaaaaaaaaaaaaaaagaaagtaaatcaaggccaggcgcagcgactgggaggccgagatgggcagatcacctgagttcgagaccagcctgaccaacatggagaaaccctatctctactaaaaatacaaaattagccaggcgtggtggtgcatgcctgtaatcccagctactcaggagccccaggtgggagaatcatttgaacccaggaggcagagattgcagtgagccaagatcacatcactgcactccagcctggatgacagagcaagactccatctcaaaaaaaaaaattaaatgaaaacagatgggtgcagtgcctcatgtctataaatcccagcaccttgggaggccaaggcaggaggattacttgagcccaggagtttttatttatttatttatttttgagatggagtttcactcttgttgcccaggctggagtgcaatggcgcaatctcagctcaccacaacctccacctcccaggttcgagctattctcccgcctcagccttctgagtagctgggattacaggcatgcaccaccgcacccgactgattatgtatttttagtagagacagggtttctccatgttggtcaagctggtctcgaactcctgagctcaggtgatctgccctcctgtaatcccaacactcccaaagtgttgggattacagacatgagccaccgtgcccggcaagcccaggagtttgaaactagcctgagcaacacggcgagaccctgtctccacacacacacacacacacacacacacacacaaacacacacataaaaaataagaataaaaataattagctgggcgtgatggtctgcacctgtagtctcagctatctgggaggctaaggcgggaggattgcttgagcccaggagattgaggctgcagtgagctataatcctgccactgcactcctggtcgacagagtgagatctcatctcaaaaaaaaaaaaaaaaaaaaaaaagacctgtgtggtggctcatgcctgtaattcaagcactttaggagggcaaggcagaaggattgcttgagtacaggagttcaagaccagcctgggcaacattgagagaccaagttctgttgtgggttgatttggcttttttttttcttttttaaaatgtggtttgtttcaagtttcccttctccacgataggctaatactgatcatgtcattccaccacttaaaacttctgttggggccgggtgtggtggctcacgcctgtaagcccagcattttgggaggccaaggcgggtggatcacaaagtcaggagattaagaccatcctggctaacacggtgaaaccccgtctctactaaaaatacaaaaaattagccgggtgtcgtggcgggcgcctgtagtcccagctactcgggaggctgaggaaggagaatggcgtgaacccgggaggtggagcttgcagcgagccgagatcacgccactgcactccagcctgggtgacagagcgagactccgtctcaaaaaacaaaaaaacaaaaaaaacatctgttgggggccaggtgccttggctcatgcctataatcccagcactttggaaggccgaggtgggtgaatcacttgaggtcaggagtttgagaccagcctggccaacattgtgagagaccctttctgtacgaaaaatacaaaaattagccagccatggtggcaggagcctgtaatcccagctactcgggaggctaaggcaggagtattgcttgagcctgggaggtggaggttgcagtgagccaagatcatgccactgcactccagcctgggtgacagagtaagaccctgtctcaaaaacaaacaaacaaacaaatcccacttctgttggctcctattaacgtgtcatttaaggaagccaattggccagtttaggcagcacatgacacagtctccactgatggccctgagtgtggccctgggttcacaggacgagaggtggctagcgtcttacaggtactaaccaaaatcacaataaatcttataatcagaagaccattattactcatttacaataagagagataactgaccagaatgtaagttttctgatgcgagcgcagagcattgtgcctggcacagagtaggcacttaagaagtttttgtaggatggatagtaagaaaaggaagggagagaagagggggtggggaaggagcaagtgaaaggggaaaaaagctcattctctttctgtaggaaggctatttgaggagccaagttaaaatcagattgaatagtgcttattcctccactagactaagtaccaccaagcaggaccatatcacattcactttgcatccccaagtctagctcctgggagatgcttaatacaggtgtgctgaacctatttgtcacttaaatgttcattatctcaggatcttacaaagggcttcttttcctgaaatccagcaaggaggagttttagtccgcatgtgtctgattacccaaagaaatgtttccttccgcttgaaggcaaagccacagtctttctttttttcttttttctttttttgagacggagtctcaggatctcagctcactgcaagctccccctcccaggttcctgccattctcctgtctcaacctcccaagtggctatgactacaggcgcctgccaccgcgcccagctaatcttttatatttttagtagacacgcggtttcaccgtgttagccaggatggtcttgatctcctgacctcatgatccgcccacctcggcctcccaaagtgctgggattacaggcgtgagccactgtgcctggcaatttttgtatttttagtagagaaggggtttcaccatattggtcaggctggtctcaaactcctgacctgaggtgatccacctgtctcggcctcccaaagtgctgggattacaggcatgagccaccatgcctagcaggaagccagagtcttgtatgagctcagtcaagcacaagtggtcccattcttgctggtccttgccttaggaatgggcatgtgccctgatgggatgggatgtaaagggagagctctcaggtttctggaggaagtgctctttgcccttaaaaagggacacaagggctggccttggtggctcatacttgtaatcccagcatattgggagggcaaggtgggaggatcatttgaggccaggagtttgagaccagcctgagcagcatagtgagagacctcatctctgcaaaaaagaaaaaaataaaagaggacacaaggccaggcatggtggcacataactgtggtcccagctacttgggaggttgaggcaggaggattactggagcccaggaggttgacgctgcggtgaatgatgatcgtgccactgcactccagtctgggcaacatagtgagaccctgtctctaaaaaaaggacacaaggaaatgactgtccttctcccactgggcattggcataactggatgtgaggcctgggataaccagccagaggatgaagccaaaacctgaaagaaattagaaccaaaaaaaatcacacagaagcagacccacggcctggacatcctgcatcttgagctgcctgctacagagttcatgttatgaaaaataataaatgcccttgcgcctggctcaaactattttgaatagggatttctgatattgcagccaaagcatgctaatacagcttgttagttaagatgattacatcatgaatccatggcgagtaaacttttgtaagaccattgagtcactctggtgttgcaagtatagacggatctgattgcctaattccaggagggttaggccctgacctcagtcatgactactttctgaataggcttggcaccaggaattgagtgggaggaacctaggtgatctaggagtttaaacaaaaataaaatcttcaattttagaagaaaagatgtcccaagaaactgctccatgatgggtaggagataaaaaagtggaaacaggtacctgagcaggaaaaactatgttcatgattttatactagctcttgaggttttagtcttgtgttaggaaaagtggatttaggattaaagtcttctgtccgtacacaatctacagcattaaaagattttaccctatcagattggcacatgcctgtgggaacagctaatcgggaggctggtgtgggagcatcacttgagcctggaagttggaggttgcagtgagccaagatcaagccactgcactccagcctgagtgacagagtgagacccctatctcaattaaaaaaaaaaaaaaatcttaccctatcaaagattcgagttcagtgaagatccattataaaatacttcctccttcaaatagagatgatgataacaggcatcgatgcaatactcttagtaagcattgactcttggttgttttttagtcaaagatttctaattctggctctattactgaaagaccatctggccacccattatggtacacaggttatataacaagaatgctatggttattgactgaaagccattttataatgagacaccctattgctattacataaaaggcagtctcagctatagaacgaattctcccttggtcagtcactgtggtcctactaatcatggagggaaaagatgtttctctcagaaaatctaaactgagtaggaaagccccaggaggtgcaagcctggttgcacattagaattggctagaagttttaataaatactcatgatagcccttgaacatatgaaaagatgcttgacctcactcctaataagagcaatgcaaaataaaactactttgaacattttttttcacctatcagattggcaagagtctaaaagttgaacataaaattttattaatatccagttctcctctacttctgagaatatggactatacaatttcctgcaccccctgaatttaggcttagcatgtgactcattctggcccataaaatgtgagcagaattaacatattttcctctgggctgaaggatttaatagctggtgctattaatcaaactatggggattctccagttctgttccccaattcagctactaagtgagaaggtgaagtgttccatttggtgcagcctcaggatgggggagtttcaccaccctggatctgagccgctgcaccgaggaacattgccctgtgtcagaaatagttaagccactgctgcataatcccagcccattgtgacacacgctgttgatgaagctgtgagtaaacaggtattctcctatattgctgcaatagtaccaaatgctaaaagcatcatggagggcaatttgaccatagctatagatgcacatttatcatttaatctatcatttaattccacttctgggaattcatcctacagaaatgcctgcatacatatgaaatgatgtatgcacaaagttatacattatggcattgtttgtaacgagagtttggaaataaatatctaagtatggagactggttaaatagactatggtctatcttcacaatggaatagtatgcaaatataaaaacaaacaaacaaacaacaaggaaactctcaaaatgctgatgtggaaattattccaggatatattgttagatttttaaaaagcaagacgcagaagagtggatatgtttcctttagtgtaagaaagggggaaaataaaaatattcttacataaacatttgtgtgatacacaagagatgaatagaagtagttaactatagggtcctccaagtcggatgggatgggagcaggacttctcaataaataccatttgtatcactttatatttgaaccattttaatacattatttttttttaatatagtactcaggtctccctgcaagccaaataaataaatcagtcttctgggatcaggactgggctttttgttgttgttgtttttttatgctatgcaggtgatcaaatgttcagtcagcactgagaatcggtgttttaagcttcagtctcagatgaaacacgatatctgagaggcagtttttgtgttgtgggtatgggtagtatttggcctttgctctgtgttctagaacctaactctgatggctcaagtaacccttctggttggaatactataactagatgagggagctccatctggcacagatgttgacagtgctgtgggatatgcccggatcatgtgccaggctatctggaactgaatactctgaactagagaattgggctagacacagagatgaagtaagatgcaaaccaatattgaatttatcaaggctgtgtggttataatcaggggtcttttttaggggaagacatctattagaagttgtggtagtaggttgggcacggtggctcacgcctgtaatcctagcactttgggaggccaaggcgggcagatcacgaggtcaggagtttgagaccagcttgaccaacatggtcaaaccctgtctctactaaaaatacaaatattagccaggcgtggtggcaggcgcctgtaatcccagctactcaggaggctgaggcaggagaatcgcttgagcatgggaggcggaggttgcagtgagccaagattgcgccactgcactccagcctcggcgacagggcaagactccgtctcaaaaaaacaaaaaagaatttgtggtagtgaccttaaaaaagttctgggtcacactgggagcaacacaaaaggcacacattcaatatagaagatttttgacctaaagttggcaaacaatggcccatgggccaaatcttgcccatcaactctacctttatggcttgtgggcaaagagtgtttttttgtttgtttgtttgttttgagatggagttttgctcttgttgcccaggctggagtgcaatggcacgatcttggctcaccgcaacctctgcctcccgggttcaagcaattttcctgcctcagcctcccaagtagctgggattacaggcatgtgccaccacgcctggctacttttgtatttttagtagagacagggtttctccatgttgatcaagctggtctcacctcaggtgatccacccacctcagcctcccaaagtgttgggcgtgagccaccgcacccagtcaagagtggtttttacatctttaaacggttggggggaaaatcaaaagaatatctcatgatacatgaagattatgtgaaattcaaatttcagggcccataaataaagttttcctggaatatagctgtacctaaacctattgggacaaagtcacatacagtgtggctgctttcccactacaatggcagagttgagtagttgtggcagacacgtacctggcactctcatccctttgtgctgctgctcagtgcactacaagttggagtgctgcaattataattcagcagtattttggccaggcgtggtggcacacgcctgtaatcccagcactttgggaggctgaggtgggcagatcacaaggtcaggagttcgagaccagcctgatcaacatggtgaaaccccatctctactaaaaatacaaaaattagccaggtgtggtggtgggtgcctgtagtcccagctactcaggaggccgaggtagaggaatcacttgaacctgggaggcggaggttgccgtgagccgagatcatgccactgcactccagcctggcgacagagcaagactccttctcaaaaaaaaaaaaaaaaaaaattgccaatgcacgttcttgtatcaaaagaagaaaagtataattttctttttttgagacagggtctcgctgtctcaatgcccaagctggagtgccgtggtgtttaatcacagctaactgcagccttgacctcctgggctcaagcaattctcctacctcagcctcctgagtagctggggccactatgcacagctaatttttaaaaattttttgtggaaatggggtcttgctatgttgcccaggctggtctcaaactcctgacctcaagtgatcctcctgccccagcctcccaaagtgctgcgattacaggcatgagccaccacaccaggccagaaaagtagactttggatgtcacactttcaaggcaaagtgtagattattttgttactgtatacaattgcaaggtcgggggcgcagtggctcacacctgtaatcccagctacttgggaggctgaggcagaagaatcacttgaacccgggagacggaggttgcagtaagccgagattgcaccactgcactccagcctgggtgacaagagtaaaactgtctcaaaaaaaaaaaaagcatacaattgcgaagtattgtgtttattatgcagtgacaccgtatctgtgctaaaagaataaaatgtatgttaacttagactaagcagtcatcacagtattaccaatttataggaaagcaacagtcagaaaaattggaaaattttggctaggtgctgtggctcatgcctgtaatcccaacactttgggaggctgaggcaggagaactgcttgagcccaggaatttgagaccatcctgggtaacacagcaagacctcatcactaccaaaaaaaaaaaaaaattggccaggagtggtggcatgtgcctgtgctcccagctgcttgggaagctgaggtgggaagactgcctcagcccaggaagtcgtggctgcagtgagctgtgatcatgccaccgcactccagcctgggtgacaaagcaaaacccgtctcagaaaaaggaaaaaaaaaaaaaaagaaagaaataaagaaaaaaaataggaaaatttcaaatggaacatcttatcagaatttctgcacaaaaatgaaaaatgaggctgggtgtggtagctcatgcttataatcccaacactttgggaggccaaggtgggaggatcacttgagcccaggagtttgagaccagactgggcaacatagcaagaccctgcctgtacaaaaaaaaattttttaattaggcaggtgtggtggcacatgcctatagtaccagctacttgggaggctgaggtgggagaatcacttgagccctggaggtagaggctgcagtgagctgtgatcatgccactgcactccaacttgggtgccagagtgaaaccctgtttcaaaaaaaaaaaagaaaagaaaaaatgaaaatgaaactgcaaaagtaagtttccaaggggcttatgtgttagccaaagaaagctgcttactggcggtgagttcattaaattgtgtttgtcgtagcagaagaaaagtgtccaaagaaaaatgattttgaatgattttccttgattatcaacgacttgatagatgttaccattagtgctcaattgttgtttatttgaggtgccaatgctgaatataaaatcactgacaaatacatttctcttgaatagtgtgcatggaataactataggcaatattctgaaaagttggccgggtatggtggctcatgcttgtaatcctaacactttgggaggccaaggacagcagactgcttgagcccaggaattcgagaccagcctgggcaacacagtgggccctcatctctaatagacttaacctctgccaggcacagtggctcatgcctgtaatccagcacttttggaggctgacgcaggcagatcacctgaggtcgggagttcgagaccagcctggccaacagggtgaaacgctgtctctactacaaatgcaaaaattagccagacgtgttggcacacacctgtcattccagctgctcgggaagctgaggcatgagagtcgcttgagcctgggaggcagaggttgcactgagccaagatcatgccactgcactccagcctgggtgacagagtgagactctgtctcaaaaataaataaataggccgggtgtggtggctcacacctgtaatcccagcactttgggaggccgaggcaggcggatcacctgaggtcaggagttcaagaccagcctgcccaacatggtgaaacccagtgtctacaaaaatacaaaaattagccatgcatgttggcgcgcgcctgtaatcccagctactcaggaggctgaggcaggaaaatcacttgaacccaggaggcagaggttgcagtgagccgagatcatgccattgcactctagcctgggcgacagagcgagactccatctcaaaaaaacaaacaaacaataacaaaataaataaataaaagacttgaactcagaccagacgtgatgaccagctgaatttaagcatattagtcagcagaggaaaagaaactaaccaggattccctcagtaatggcaagtgaacaggtaagagcccagcaccaaatgcctgccttgcagagtttttacatatatatgtgtgtgtgtgtgtgtgcattatatatatacgtattctttttaagttgagaaaacaataattcagtataacccaaagtggaatctgctaaaatgggtaacaagtgatggtggtaatcatgtatgaagcagaaaaaggcttagttgagcaaatttataaagccctggaaaatataaggtgtttagagcctatggttatttatgacattattcatctgaaactaatccatgataaaaatatatatatatttttgagacagagtctctctcagtcacccaggctggcgtgcagtggcgcaatctcagttcactgcaacctctgcctcccaggttcaagtgattctcctgcctcagccccctgagtagctgggactacaggcgcacgccaccatgcctcgctaatttttctatttttagtagagatggggtttcaccacgctggtctcaaactcctgacctcaggtgagctgcctgccttggcctcccaaagtgctgggattacaggtgtgagccaccacacccagccctttttttttttttttttgagacacagtctcactgtgtcacccaggctagaatacagtggcatgatctggggctcactgcagcttcaacctcctaggctcaagcactcctcctgactcagacttccaaagtgttgtgtttacaggcatgagccaccacacgtggcaactgtagctattattttttgatacggagtctcactctgtcaccaaggctggagtgcattggtgcgatctcggctcactgcaacctccacctcctgggctcaagcgattctcctgcctcagccttcccagtagctgggactacaggcatgtgccaccatgcctggtctttagtagagacggggtttcaccatgttggccaggctggtcttgaactcctgacctcagctgatctgcctatctcggcctcccaaagtgttgggattacaggcatgagccaccgcagctggtctggcgattgtaattattttagaagacaagagtttaagtataataccatctagaaaccctgggaatatgcaagctaaggaagaatcaaaatctatatgttacagcttttttttttttttttttgagacggagtctggctctatcgcccaggctggagtgcagtggtgcaatctcggctcactgcaagctccgcctcccgggttcacgccattctcctgcctcagcctcccgagtagcggggactacaggcgcctgccaccatgcccggctaattttttgtatttttagtagagatgggttttcaccatgttagccaggatagtcttgatctccttacatcgtgatccacccacctcggcctccaaaagtgctgggattacaggcatgagccactgcgcccggcctattacagcttttttaatggtttctttctgtttctctactcattgctgttttgctatctcagcatttagtaactttttttggaatgtttttgacagggtcttgctctgttgcctaggctgaggtgcagtggcacaatcaaggcttactgcagcctcgacctcctgggctcagatgatcccccaacctcagcctcctgagtagctgggacttgaacacctgggctcaagtgatctacccaccttggcctcccaaagtgctgggattacaggcatgagccaacatgcccagcctggaaagtttattttatgcttgtctcaactgtgctaaggaaaaataaaggaaagtatcttttacaaaaattttattatgacaaattccaaacatacataaaagtattatagaatataattaaccctaccctcgcatcatgtcacctggtttcaataattatcaatctcacatggccattcttgtttcacttttatctaacccacaccttattcccctctggagtatttagaagcaaaatgagagatatttggttctttttttttttttttttttgagatggtgtctcactctgtctcccaggctggagggtagtggcacaatcttggctcactgcaacctccgcctcccaggttcaagctattctcctgtctcagcctcctaagtagctgggactacaggtgagcgccaccatgctcagctaattttggtatttttagtagagacagggtttcactatgttggccagactggtcttgaactcctcacctcaagtgatctgcccacctcagccttgcaaagtgctgggattacaggtgtgaaccactgtgcccggactttacttttttctaaaaagagagtttatttaaggaaaatagagagcagagagtttatttttacaatgtttttacattgactgggtgccgtggctcactcctgtaatcccagcactttgggaggccaaggtgggcgggttgcgaggtcaggagttcaagaccagcctggccaatatgttgaaacctggtctctactaaaaaatacaaaaattagccaggtgttgtggcatgcgcctgtagtcccagctactcaggaggctgaggcaggaagaatcacttgaaccagggaggcggaggttgcagtgagccgagatcacgccactgcactctagcctgagcaacagagtgagactctgtctcgaaaaaaagaatgtttttactttttttaaaatagagatggggttttgcaatgttgtccaggctggtctctaactcctggcctcaaaggatccacctgcttcaccttcccaaaatgctgggattacaggtgtgagccactgcacctggccaagagcagatagtttatatagacagatagtacaccctgaaaagatgaggcaaagagggctgaggcaaagagggctgctgaaaagggagtgagccagcagctaatgttcaattatcatttttctctggcttcctcccatctttatccatctacattcaaaaaccatacattaagtatgtatcggctgggcgtggtggctcacacctgtaatccgagcactttgggaggccaaggcgggcagattatgaggtcaggagttcgagaccagcctggctaacatggtgaaaccctatctctactaaaaatacaaaaattagtcaggcatggtggcgcgtgcctgtaatcccaactactcaggaggctgaagcaggagaatcacttgaatccagaaggcagaggttgcagtgagccgagattgcaccactacactccagcctgggcagcagaatgagaccccatctcaaaaaaaaaaaaaagtatgtattatgtgctaggtactgggaatagaaaaaataatatatagcaggctgccctcaagatgctcagattgggatgagaaaaatatttatgaacaattacaatagaatgtgataaaaattaatttaggctgtgcccacagtgtatacatagtaatcagagagtatggtcagttttggttctgcttttagaatatgtgtttggagtcaccagagatgtgacccctaaatgcttcatgctgattattagcctactaaaggaaaaactatggagaggtgaaggacgctctgcatttagagggcagagagcgggttgctgtggctcacatctgtaatcctagctactttggaggctgaggcaggaggactacttgagcctaggaatttgagacgagagtcagcaacagagagacatgtctttaaaaacaaaacaaaacccaaaaagcctaattcagtcaaagcatgggtagaagccagattaagaaggttgagcagctgggtgggtggctcacgtctgtaatcccaacactttgggaggccaagctgggaggattacctgagcccagcagttccagatcagcttgggcaatacagtgagacctcatctctacaaaaaatttaaaaattaaaaaatcaccactaggattacaggcggtggctcacgcctgtaatcccagcactttgggaggctgaggcaggaggatcatgaggtcaggagttcaagaccagcctggcgaacatggtgaaaccctgtctctactaaaaatacaaaaattagctgggcatggtggtgcatgcctgtaatcaatcccacctacttggcaggctgaggcaggagaattgcttgaacctggacctgggaggcagaggttgcagtgagctgagatcacgccactgcactcctccagcctgggctacagagctagagtccgtatcagaataaaaaaaaaaaaaaagggctgggcaaggagcaggtgattatgaagtggtaaatctgacagtgaaaagtagttagaaaacaaagtggagatttttctctccaccctcacccacccactgagggtgtatgctcagggttttagggtatagaggtagaggcccagggaatgactgaataataataatggaagactcatatgatgcttactatgtgccaggtactattctaagcactttgcatatattaacttgtttcatacatagctgggcggggtggctcacatcttggctgagggggaggattgtttgagctcaaaagtctgagacgagcctgggcaacatggtgagatttcgtctctattaaaaatcaaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatcaaaaaaattagctgggcatggcagcgcgagcctgtagtcccaactactcggaaggctgaggtgggaggatcccttgagatggggaaatcaaggctgcagtgagccatgatagttccactgcactccagcctgggtgacagaaggagaacctgtctcaaaaacaaacaaaataaaacaaacaggctgggcacggtggctcacgcctgtaatcctagcactttgggaagctgaggcaggcagatcacctgaggtcaggagtttgagaccagcctggccaacatggtgaaaccccgtttctactaaaaatacaaaaattagcagggcatggcggcggacagctgtaatcccagctactcgggaggctgaggcaggagaatcgcttgaacccgggaggcggaggttgcagtgagccgagatcgcgcccctgcactccaacctggtgacagagcgagactccgtcgaaagaaggaaaggaaagggaaagggaaaggaaagggaaagggaaaggaaaggaagagagagagagagagaaagaaaagaaaagaaaaaagaaaagaaagaaagaaagaaagaaagaaagaaagaaagaaagaaagaaagaaaacaaacaaaaacaaatagggattaataaataggcagaagcaggcataatccggggcaggggaagcctcggggccacgcccgagaggcatttgtattttactttcagcagttcagagcccatgatagccaggttacccacttgtggacttccttgaccacttaattgagtcaatctaaccctcaccttctctctcctctcactccatttagcgggtcacgtagccactagggcttccttagcctatcaggccacctggggactgagtcattcagtcagtcacctatctggtggtcacatctgcccctgggctcatccttttactgggccacctcggcccatcgggacctgtcagtccttgacctccctcaggcccctaggctggccaggtcgcctcagtgccacgcctccctggcccgcgattcagcctgcacgttacgctttgttcccagaagcaggttttcgaaacgcggttccctctcggctccagctgttttcctgccagcgctgggagacccggcagccgcagcgcccccagcggcgcgcagcggcccaggaagagagtgcctaccgccggcgcctcttcagcctcctcctggaacgcgggagcgggcgcgaccagcgcccaccctgatcgtcgcgacggtgctcctgattggctgcgctgtgtgacgtaacgggagggccccggcggccgccgggagccggggcccagcgcgtgcgcagacggagcgcgctgagcggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtacgcgagagccctccccgaccgcggaggaaggtcgagaaccgggtctgtcgaagagtgcttgtataggggggtggggcgcgcttgaacccatattccccgcattctgaaccaaattattttccagaaggccttcctaacagaaagctagtgtcaggatctgggtcactggataagaggatgcgttttttttttttccctctcacgaggctgtttctcaatgtgaagaggatgcgttttgaatgtttaacggtggttgcatagttaaaatgcacgctttttgcctttcgtgactttctctgggtgtaatactgatgcagggatttgttggtttttctaaaaacctcttttttttttttttttttgagacggagtctcgctgtgtcgccaggctggagtgcagtggtgcgatctcggctcactgcaacctccgcctcccgggttcaagcgattctcctgccttagcctcccgagtagctgggactactggctcacgccaccacacccagctaatttttgtatttttagtagagacggtgtttcaccatgttggcctggatggtctcgatctcttgccctcgtgatccgcctgcctcggtctcccaaaatgctgggattacaggcgtgagccaccacacccggccaaaaaccgtttttaagccatagacttctttgagaatctgaagatagccgagcactcaccaccccacccccacccccacccccacccctccccgccaaaggcacgtacacacaagtttgcacaccatcccgggtgcttgtactccctccagatctctgaactccaggttaagaactccaggactgcagcctttggaacagtcaaaaaaatgaaaatgctttagcgtttagaaacaaaaaaacctttaaccaaaatatcagaactgtatattgatactgtggtgccaagtttgaagcaggccagacaccaccacttttatagtacgttaattacaaagataagagaaggtgcattggcttcagcgaggatattttttggaaaatttattgcatattttctccccgaggaccattagtaggccagagatcagtctggttaatttccaaggtggaattaggctagaatgttattaaggaaaatttttgaatgacacttagttgtatcctagttcaatttcagacatgctttttgtgttaagtctaatgattttgtatttcttattttaaaattaacgcaaagtgaccaagcattctcttttccaagtgaaatacgttattttaattgattagttgctttaatttgccttaagcgttttagcagagatttgcttttattgttgtgtttgccctgtaacactgattttatcagaggtttcttttatttaaattatcccaaatttgagttgaaaagttgcctagaatttttaaagtaacaaactggccagttcgtttcttaaacatctattttaaaaggactgggtgttgatacagtttttccagggttagatgtttatgactttatggatttgtcgaccgggtattactctaaactttaaacattaaaagctattataattgaggacaccaactgtttgcatagtgggatagagatagaaaaaaaaaagccatgacagtataatgactacaagattaactactgaactaaatggactttaaaagtggggagaaagtgattataaatcaaatactgtataacaaagaccaggacaccaagaatctgattggtgaaacctgcggttcctggcagatgctggtagttgcagtcaactttgagcacaatataattccaatttaaggagttgagaatcttagaacccactgtagtgagatttgtaatatgactgaataaattcttcctctcgtttgtgagcgtgaattatataattaataccaggcattcattaagccatgcatatgcttatgttgaggtcatgagtactaataatacagctgtttcaaaaagcaagttaatgggcgggtgtggtagctcacgccagtaatcccagcactttgggaagccaagccgggcgaatcacgaggtcaggagttcaagaccatcttggccaacatggtgaaaccccgtctctgctaaaaatacaaaaaattagctgggcgtagtggtgggtgcctgtaatcccagctactcgggaggctgaggcaggagaatcgctcgaacccgggaggcggaggttgcagtgagccgagatcgcgccactgcacagcccgggtgacagagtgagactctgtctcaaaaaaaaaaaaggaaaaagttaatgacttgagtctccttctagaggaaggaaaagaagtatgccgcttctctctatccacagaatcgcctccagattttccgtacatgcatgcatcttcttagagaacaagcatgtaattctgtctttgccctctttcgtccttcctttactgcagctgtactaggctgctcacttattccctggtagccatccttccttactcatacctttgtacctttgcacctttgctccagctgttggctcttcactgactgccttaactacacctcactctccatctgttgaaatcctacctgttgttccagtcccctcacagattatagggcctttctctgaccctacccctcacgttcagctttgtttctccttctctgtgccctctgcctcaggcctgttgctttaatttagtttttcattttcctaggtatctctgaaggagatcaccatgctggttgaattagatcctgactgagtttactttgttatactgaatcttcgaattgccactcccaagcctggttttcatggcttaggtttaacatgttattagccttttatagaaagctagtgactactagagcctgggccaaacggaaaactcagtgtaatgcttcttcgcatcccaaacagggtacatttagtggcttaactttgcaggcatcaaaactgagcttttaaagccagagtttcatgcctcttggctaatattttggtttatcttgcatagctaaaatttgtaacaataatgtcctactcgaaatttaaggactggtggcttgcattgttatagtcttatccttttcattagaatgcttcataatttttaattttatatttttattcaaatgtttataagagaattataacccagtgtaacccagtgtaggtactgggaaagatgtgtgacagacatactttcttcctgtggaactcctactgtagtggagaagacagactgaaaagtagaaaaataaagtactagtaagatcaatatacaggagggacctacctggggtggcgtggtcagagaaagcatgaagctaagacctgagggtaaagaagaacccagcctaggcaaggcttggcctgagaggaggagaagagccttccaagtttagggaaaagcttatgtagatgtcctgaggtgagaaagtccattgtgttgggagtgtgtttcttttctttctttcttttttctttttttttttcttgagacggagtcttgctctgtcgcccaggctggagtgtgcgatctcggctcactgcaagctccgcctcctgggttcacaccattctcctgcctcagcctcccgagtagctgggactacaggcgcctgcaaccatgccgggcaaattttttgtatttttagtggagacggggtttcaccatgttagccaggatagtctcgatctcctaacctagtgatccgcccgcctcggcctcccaaagtgctggaattacaagtgtgagccactgcgcccggctttttttttttttttttttttttggtagatgacgtctcactctgtggccaggctagagtgcagtggcccaatctcggctcactgcaacctctgcctcccaggttcaagtgattctcctacctcagcctcctgagtagctgggactgcatgggactacaggcacccgccaccatgtccggctaatttttgtatttttagtagagacaaggtttcaccatgttggccaggatggtccctatatcttgacctcatgatccacctgcctcagcctcccaaagtgctgggattacagatgtgagccaccctctccggcctgggagtgtgtttcttaaaggagaaagggggacatataaaatgagtttggagataaagatcagggtcaggaattgggtttttatttaaagtgctgtgggctccaaggaaggaatttgaggcagaggagtgacctggggctgttattgtaatccagctacaaaatgatggtgactaatagtgacagtggagctgtgacttggagatgcctattttggagataaaattgatttgctggtgggtggggatgaagggaaagggaagaagggatgatttggtctatttgtaactttgttatcttctgtgtttttatctttaactgctttttgtatttgtggtattcctatggtggattttattttatttatttttttgagaccaagtctccctctgtcccccaggctgtagtgaagtggcataatctgggctcactgccacctccgcctctggggtttaagattctcctgcctcagcctccctagtagctgggattacaggcatgcactgccacacctggctaatttttgtatttttggtagagacagggtttcaccatgttggccaggctggtcttgaactcttgacctcaagtgatccacctgcctgggcctcccaaagtgctgggattacaggtgtgagccactgcgcctggcctagctctagtgtatttttatttaataagggctgtttccagtttaacaacagaatgcttcagaaggtagcttgctttgtttgacattttccatttctagcttgtgtcgatagataaattcaggctatgaagaaaaattagaataaataaaattttaccattaaaaactaaaggaagttggcccttcaagaaaataatgtactgtactcagcagactttgagcattacatgtacctggtaatatggaaccaacattgaatcagacagccctatcatgcttctgaggagcttactggttactaaaaaaaaaatttttttttttttgagacggagtcttgttctgtcgcccaggctggagtgcagtggcgggatcttggctcactgcaagctccgcctcctgggttcacgccattctcctgcctcagcctcttgagttagctgggactacaggtgcccgccaccatgcccgggtaactttttgtatttttagtagagacggggtttcaccgtgttagccaggatggtctcgatctcctgacctcgtgaaccgcccgcctgggcctcccaaagtgctgggattacagttatgagccaccgcgcctggcatttttttttttttttttgagacagagtcttgctctgttgccaggctggagtgtggtggtgcaatcttggctcactgcaacctccacctcctaggttcaagtgattctcctgcctcagcctcccaagtagctgggactacaggcgcacgcgctaccacacctggctaatttgtgtatttttagtagagatggggtttcaccatgttgagcaggatggttttctgtctcttgacctcaggggatctgctcgcctcggcctcccaaagtgctgggattacaggcgtaagtcaccgcgcctggctactaaaaaaaaaaaaaatgtaaaggttggctgtgctcggtggctcgtgcctgtaatcccagcacttcgggaggttaaggcaggaggatcgctagatcccaggagtttgagaccagccctggcaagatagtgagaccccattcccacaaaaaattaaaaaattagctgagcatggtgtcatgcgcctttaagtcccagctacttgggaggctgaagtggaaagattgcttgagcatgggaggtcgaggctacagtgagctatgatcatgccactgcacttcagcctgggcaacagagccagaccttgtctcaaaaaatgaatgaatgaatgaatgtaagttgtatatatttaatatatttaatctccatgcatggtgaaacagctgtgggagaactgagaaagggtgcttagtctaacctgagagcccagaagaggagcctcacacacctgtgaagtagaagccaatccctgaagggacaggaggaaacaagaagcatggttgtgcctcctctttacatcccctgttctaattatttaagaactcaaatctagacttccataatttggaatggggaaaggattgccagtaattttaatcagcatagaattcaactctgtgaataaacccctttgcgtttctcctgaccagtagttaaaatcatgtgaatttgattcagagaaaaatacaagaacatggccaggtgcagtggctcacgcctgtaatcccagcactttgggaggccaaggtgggtggattgcctgagtgcaggagtttgagaccagcctgggcaacacggtgaaaccctgtctctactaaaatacaaaaaattagctgggcatggcggcgtgtgcctaagaggctaaaggcaggagaatcacttgaacctggggggtggaagttaaagtgagtcgaggtcgtgcagctggactccatcctgggcgacagagtgagactctctccaaaaaaacaaaaaacaagaacactgtcatgctgagaatggaatcttgtccaattaagagttgtgttcccagccggatgtggtggctcacgcctgtaatcccagcactgtgggaggcttaggcgggcggatcatgaggtcaggagatcaagaccatcctggccaacatagtgaaaccccgtctctactaaaaatacaaaaactagctgggcgtggtggcatgcatctgtagtcccagctactccggaggttgagacaggagaatcgcttgaacctgggaggcagaggttgcactgagccaagatcacaccactgcactccagcctgccaacagagcgagactccgtctcaaaaaaaaaaaaaaaaaaagagttgtgttcccatggaaagtactagtagccattcgatttgtgacttttaaaactcaaatccacagaattgtgacctaaatttttccttttgatctgaatgattagactagatttctgagggtctttaagattaaaatattttaattctgggccgggcgtggtggctcacgactgtaatcccagcactttgggaggtctggcaggtcgggagttcgagactgaacctgggaggcagagatgacagtgagccgagattgcgccagcgccactgcactccagtctggtcaacagagcgagacttcgtctcggaaaacaaaaaacaaacaaacaaaaaacattattttaattctttcagataagtaaaagggggcacagcctattagttgggagttcagattaacttgagttgaatctgagctaaaatcataacaagttgggtggggccaccaggcacatagcaactcacctggaatgaacgtgacaagaacagtggaagaggatgagaagaggctttgaaggtgcacactcaacggtattcgaattctgtcacaccagttttgtgacagtattaaaccagagttaggtaatttgaatacctgagcttttgtgctttcagaaacaaaaaaggagggaaataggaaagggaagttctttgatatatagaggcctacaatataccaaagctcactgctagactcttggaatctaatggaagtaaaccatgtttttgtttttgatttttgtctttgagaagctttggtctattgaaaaaattagaatgccatgacagcttaaaagcaaaggcaatcaactgtacctaagaggtggggagaggcttgaaagaggagatgctcttcaactgattctttaaggatgagaacaagtatacgaggtagaagaggtggtggtagaagagatggtggcagtgcttgctggtaaagacacagttataattaatgtagatgatgggcaggaacctaggaaggaaagataaagccaacttgtaaagggcctcctcagccttgtaaatgagcttaacaatgggagccatctaaagtttttaaaaagagaactgtcagattttaaaaggagaactgatgagttttacttttgagaaactgctctgggtggggaaagatctgaaggactaattctctgttactggagagggaccctgagaagctgagccaagatcaaatgccataggaatgtaaagtggcacatagaaggtgaggggagaggtatgatgacttcagagaggattgagtggtgcctttgagacaagagaaagggattagggtgggtgcgtgattcttttcaacaggaagaatctttctttgaggtacctgctggaagccaggtggtatttagcaatctgatgggtttgttattgagaagagaggtaagggctgaatacatatagatttgggaatcgcagcttagatgggatcacccagaatgaggaggcagaacaggaataagtagagaaagagaagctgcggaaggagaggcagccacaagcataggaggaggagccattagtgatggcctgaaagcccagggacagaagggaggggacctgggcattaaatgctggtcagtgataaagaatggtggttactggctggacatggtggctcacgcctgtaatcctagcaccttgggaggcggaggcaggtggattgcctgagctcatgcgttcgagaccagcctggccaacacagtgaaaccctgtctctactaaaatataaaaaattagccaggcatggtggcgtgcgcctatagtcccagctactcgggaggctgaggcaggagaatggcttgaacctgggaggcagagattgcagtgagccaagatcgcaccactgcactccagcttgggtgacagagcaagactccgtctcaaaaaaaaaaaaaaaaaaaaaaaaagaatggtggttaaagcagtttcactagagaagtacttagctcatcttggaattgaattttttttttttttttttgagacagtgtcgctctgtcgcccaggctgaagtgcagtggcatgatctcggttcactgcagtctccacctcccgggttcaagtgattctcctgcctcagtctcctgagtagctgcgattacaggcgcccaccaccatgcccggctaatttttgtatttttagtagagatggggtttcaccatattggaccaggctggtctcaaactcctgacctcaggtgatccaattgcctcggccccctaatgtgctgggattacaggcatgagccagtcaccacgcccagctggaattaagttttctacctttttttttttttttttaactgtgaaatatttcatacatagaaaagagtaagggtgccgtggctcacgcctgtaatctcagcacattgggaagccaagacaggtggatcacttgaggtcaggagttcgagaccagcctggccaacgtggtgaaaccctgtctctactaaaaagacaaaaattagccgggcgtggtggtagatgcctgtaatcccagctacttgggacgctgaggcaggataattgtttgaacccgggaggtggaggttgcaatgagttgagatcgcaccattgcactccagtctgggtaacagagcaagactctgtctcaaaaaaaaaaaaaaaaaaaaaaaaggaaaaagagtaagcctgggcacgttggctcatgtctgtaatcccagcactttgggaggccgagggaggcagatcacttgaggtcaggagtttaagaccagcctggccagcatgtgaaacccatctctgttaaaaatacaaaattagcccggcagtagtggggccctgtaatcccagctactggggaggcttaggcacaagaatagcttgaacccaggaggcagaggttttggtgagctgagatcacaccactacactccagcctgggcaatagagtgagactctgtctcaaaaaaaaagtatatgtaagctgggtgtggtggcatgcacctgtagtcccaaatagtggggaggctgaggtaggaggattgcttgagcccaggagttcaagaccagcctgggcaacataaacccccatctctgcaaaaaattaaacaaggattggctgggcatggtggctcatgcctgtagtcccagctacatgggaggctgaggtgggaggatcacttgagcctgggaggtcaaggctatagtgagccatgatcgtactgctgcactccagcctgggccatagagcaagacgctatctcaaaaaaatttacaaaacaagccaaaaaaaactatcatctgtgtgctccctttaaaaaataaataaataaaacattggccaggcgtggtggcccagactgtaatcccaggactttgggaggctgaggtgggaagattgcttgagctcaggagttcaagaccagcttagacaacatggcaagaccctgtttctaccaaaaatacaaaaattaatcggatgtggtggcatgcacctgtagtcccagctacacagaaggctgaggtgggaggatcgcttgagccttggaggttgaggctgcaatgagccatgattgtgcctctgcactctagctcgggcaacagaacgagatcccatctcaaaaaaaaaaaaaaaaaaaaaaaaaggaatattaccagcacctttgaaacttcctttttctagaagttgattgtattggttcttagcatgcataaggagattttaagcttagaacatattagcacttggtttaaagatgttttgtgtatggtttatacatgtagaaactgagaacgcttttaaccaaaagagctgagagattcgttatcatcagaaaagaaaagtcagttacgaattagttgttaggggctttgctgctcaaagtgtgtagtggacaataggcaaaaagtgagaagcatggtcaagggtgtttggatgggcttgaaaaccctgtgcattttattttattttattttatttatttatttttgagtcggagtctcactctgttacccagactggagtgcagtggcgcgatctcggctcactgcaagctctgcctcccgggttcacaccattctcctgcctcagcctcccgagtagctgggactacaggcgcctgccaccacgctcagctaatttttttgtatttttagtagagatggggtttcactgtgttagccaggatggtctcgatctcctgacctcttgatccgcccgccttggcctcccaaagtgctgggattacaggcgtgagccactgcacctgccttatctatttaattttttgagacggaatctctgtctgtcgcccaggctggagtgcagtggcatgatctcagctcactgcaacctccgcctcccgggttcaagcaattctcttgcctcagcctcccaagtagctgggcctacaggcacacgccaccacacctggctaatttttgtattttaatagtgacagggttttgtcatgttggccaggttggtctcaaactcctgacctcatgatccacctgcctcggccttccaaagtgctaggattgcaggcatgagccactgcgcctgggcaacactttatattttaaagggaagttgggggagggtgctattttcaaccttgctcaaagaacaaataattgggaagcaataaattttctgatgaatatgcttcatatttctttagacagtggggtctaatggaaaggctaagatatctgacatggagcaacatgtatttatctcttcagtggaactaatgtgtaattttcaggggagtttgatgaataaatgagtttgagaatatagggcagaggacttggaatttgtgtcagggttatggctggtgagattgatttggtgtcaaatttatgaatatctctgcagatactaacacagaaaatgagccccaaggtcactatagcagtatagtagtggagggaaatagaaactatctttatcaaatttctacacagacatacccctcaccagggaagcaaggaagttgaaaagcacactttgcctccctaacccaggaatttagatgggggatcagcaaactgttgagtaaagggtcagattttaaatattttcagcttttccatagagtctctgtccaactactcaactatgcctttgtagtgaaaaacagtcatagacaatacgtaaatgaatgggcttggctatcttcttttttttgtttgtttttaagatggagtcttgctctgtcacccaggctggagtgcagtggtgtgatctcagctcattgcaacctctgcctcccaggttcaagcaattctcttccctcggcctcccaagtagctgggcctacaggcgcacgccaccacacctggctaacttttgtatttttagtagtgacagggttttttgtcatgttggccaggttggtcttgaactcctgacctcaagtgatcctcccgcctcggcctcccagtgttgggattacaggcgtgagccaccacacgcctggctttttttttttttttttttttttttttttgagatagagtcttaactgtttcaggcagtgacgtgatcttggctcactgcaagctccgcctcccgggtttacaccattctcctgcctcagcctcccgagtggctgggactacaggcgtgtgccaccacacctggctaattttttgtatttttagtagagagacagggtttcaccgtgttagccaggatggtctcaatctcctgaccttgtgatccgtccacctcagcctcccaaagtgctgggattacaggcgtgagccaccacacactggctaactgcttttaactatacaaataataaaatactcttggatggagtctaaggtggaactgactgtgctcttaatagtgtctgaaatttatatggtacttactggactgttcacaggctctctgtggctcttgaaatagcaggggctgggtgtgatggctcacacctgtaatcccaacactttgggaggccaaggcgagagaattgcttgaggctagaagttcaagacaagccctgaaaacatagtgagacccccatctctacagaaaatttaaaaattggctgtgtgtgatggcaactgcctgtagtcccagctactcaggaggctgaagtgggaggatcacttgagcttgggaagtggaggctacagtgagctgtggttgtgccactctgcactccagccaggatgacagcaagaccctgtctcaaaaaaaagagaaagaaatagaagcagggatatacttgaaggggtatgtgtgtgttcatgtcggtacattggatgcttggtgctgctcggtaattttgaatgcctcacatgcattatgccattaattctcatacacctgacagatgcagggttcgtccctaaggctgattagctcattatgagtgaagagtttagaaccagactccctgagtgcaagtctaacctcttctttggctcctcatttgtaaaatggggataataacagcatctacctcacagactattaaataatccaatctcttcaaagatcgtaaaccatgcctagcatagataataagtatgagctctttattattactcttgctcctactactcttgctagctatttatttttatttttattttattttattttatttttttgagacggagtctcgctctgtcacccaggctggagtgcagtggtgcaatcttggctcactgcaagctccgcctcccgggctcacaccgttctcctgcctcagcctcctgagtaagtgggactacaggcacccaccaccatgcccggctaattttttgtatttttagtagagacggggtttcaccgtgttagccaggatggtctcgatctcctgacctcatgatccgcccacctcagcctcccaaagtgctgggattacaggcatgagccactgcgccggcctcttatttatttatgttttgagacagtcttgttctgttgcccaggctggagtgtaatgatgcagtcatagctcactgcagcttctaactcctgggctcaagtaatgctcctgcctcagcctcttgagtatctgggaccgcaggtgtgtgccactatgcccggctcattttttgtctgtttagtagagacagggttttgatatgttggacaggcaggtctccaagtcatctgcctgccttggcctcccaaggtgctgggattacaggtctgagccaccacgcctggtggatttattatttttaatttggcaagtctgtaagcccttttttgttccttttttttcaagaggccagaggcagaggcctttgtcattttctgtgtgtccagggaagtgtgcaggatgtaagccatagattaggactgggaggaagagtgtgtggtggttgtgacaagggtccaaaggaaggcagcttccgaacttacttgagattataaaaataaatttaaaccaggtatctctgtgtaatcaaaaggtttctgtaaaacagagatggagtgtatgtgtgtgtgtatacttgtaatttgaaaagacattcagaatagtaacttttgggacagtacagactacaaaaattacaacatgatagaaccttcttaactactaagaatatagaaaggaaaataaagccaggcgtggtggctcacacctgtaatgacagcactttgggaggctgaggcgggtggatcacatgaggccagcaggagtttgagaccagcctggccaacatgccaaaatcctgtctctactaaaaatacaaaatttagctgggtatggtgttgcacatctgtaatctcagctactcgggaggctgaggcagaaaaatcacttgaacacgggaggtagaggttacagtgaactgaaattgcgctactgcactccagcctgggtgacagagcaagattctgtctccaaaaaaaaggctgggctcagtggctcacacctgtaatcccagcactttgggaggccgaggcaggcagatcacgaggtcaggagatcaagaccatcctggctaacaaggtgaaattccgtctctactaaaaatagaaaaaattagcggggcgtggtggcatgtgcctgtagtcccagctactcaggaggctgaggcaggagaattgcttgaacttgggatgcagaggttgcagtgagctgagatcctgccactgcactccagcctgggcaacagaacaagactccatctccaaaaaaaatgtagaggccgggcatggtggctcatgcttgtaatcccagcacgttgggaggccgaggtgcgtggatcgcccgaggtcaggagttcaagaccagcctggccaacatggtgaaaccccttctctactaaaaataaaaaaagttacctgggcgtggtagtgggcgcctgtaatcccagctactcaggaggctgaggcaggagcatcacttgaacctgggaggcagagtttgcagtgagctaagatcacgctattgcactccagcctgggcgacaagagcaaaacttgtctcataaaaaaggaaaataatttattatagaggagagtggtatattaagaagtttgacaggcactggcttagagtaagatttttctcttagagtaattttctttctctcttaaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggtaaaatctgttcagattagctttttgggtcctttgacatttggttttaatttttagttttagtttagtttctgctcatttaagcttatattcatggaattagagcactggatgattttggaagatacgcactgttagcgtttcattttaaaatttttttatagagacgaggtctctaattttaaaagagttgtttgcccaggctgatttcgaggtcctggcctcaagcaatcctcctacctcgacctcccaaagtactgggattacagatgtgagccaccatgcctggcccattattagtgtttcacagcttgttttgttctgtcctattccttgtttgccccaaattctcagccttcttgctctttcttgttcccaaagcctaacagatttagttttgcagttgttggtttttcttccagtaaggaaagataatgattaaggaagacccatgacctagaggcaaaatcaacatatatggttctgtatttctaacattggaatcagttgagaaatatgaaaatgtcttagaatttctcttgagcttggtagaggaatgaattttttttttttttttttttttttttgagatggagtctcactctgtcgcccaggctggagttcagtggctcaatctccgctcactgcaagctccacctcctgggttcacaccattctcctacctcagcctcccaagtagctggaacgacaggcacccgccaccacgcctggctaatttttttgtattttcagtagagacagggtttcaccgtattagccaggatggtgtcgatctcctgacctcgtgatctgcctatcttggcctcctaaagtgctgggattacaggtgtgagccaccgtgcccggcccaggaatgattttttttgagatggagtcttactttgtcacccaggctccagcacagtggcatgatcttgcctcatggcaacgtctgcctcctgggttcaaatgattatcctgcctcagcctccttagtagctgggattacagatgcctgccaccatgcccgtcgaatttttgtatttttagtatagatggggtttcaccatgttggccaggctggttttgaactcctgacctcaggcgatctgcctgccttggcctcccaaagtgctgggattacagacatgtgcgaccacgcccagccatagaggaatgattttaaaatacatcagcccttgcttgttatggattttgtaaattagaatagcatgaaatagaacttgaacattttaattaccaagtcattttcttttcttttttttttttttgagacagagtctcgctctattgccttgttgcctaagctggagtgcagtggcgtgatcttggctcactgcatcctccgcctcctgagttcaagtgattctcctgcctcagcctcccgagtagcggggctacaggcatgcaccaccctgcccggctaatttttgtatttttagtagagacggggtttcaccatgttggccaggctggtctcgaactcctgacctcaggtgacccacccaccttagcccgcaagtgctgggattacaggcatgatccactgcacttggccaagtcattttcttctaactaaatattactttttaaaaaaactctttctcagctgggcacagtggctcatgcctgtaatcccagcactttgggagggcgaggctggtggataacttgaggtctggagtttgagaccagtctggtcacagacatggtgaaaccccatctctaccaaaaaatacaaaaatgagccagacgtggtgggcatgcacctgtagcctcagctactcaggagactgaggtggaacaattgcttgaaccaggtaattagaggttgcagtgagccgagatcatgacactgcatttaagcctgggcaatagggtgagaccctatctcaaaaaaaggggggagaatgttgagagagagcctaagtgcatttcagaaggatgaagtaagggaccctcttgcttcaaaaaaaccaaatcctgactcaccaaacagcctgcccacagataaaagttagctagaattggtttcatgggtatttttccataggttgtcctcagtgtttttttgtttttgtttttgttttgttttgttttgagacggagtttcgctcttgttgcccaggctggagtgcaatggcacgatctcggttcactgcaacctccgcctcctggattcaagccattctcctgcctcagcctccggagtagctgggattacaggcatgtgccaccatgcccggctaatttttttgtatttttaatagagacggggtttctccatgttggtgaggctggtctcgaactgctgacttcaggtgatctgcccacctcggcctcccaaagtgctgggattacaggcgtgagctaccatgcctggccctcaagtttttctttggaccagtagtagtatctgaatgaactgcacctgaaggtttgtttcaatgtttgattttttgcctccctttcatgttggctataaggaaaaggagcatttgaggctgtggtgggggtcagggactgagaggctccaggtctcaggaggctgcctccacagataggagtgctggctgagcaggccttccagctttctttccttttttttttttcgagatggagtctcatttgttgcccaagctggagtgcagttgatagaatctcagctcactgcaacctctgcctcctgggctcaagcgattcttctgcttcagcctctcaagtagctgggattacaggtgcccgccaccatacccaactgtttttagtagagaccgggtttcactatgttggccaggctggtcttgaactcctagcctctgatcatctgcccgcctcagcctcccaaagtgctcggattacaggcgtgagccgctgcacctggccaggccttccagctttctcacccacacacagacctgcctaggcacaggtgcatgcctctggcctggtctatgcctcagcaccttggtgctctgggctgttaataccctgtagcatgcattgtgttttcagccttttgaggcattttcacgtccatcatagcataggattggggagctaggagtcagagtgggtgtgactcgtgtgtgtttggcagctgctcgttgagaaccttgaaagtcgaggctcccagtcagaattttaggtacctgcctgttgacctctggctctaggatgtgtgttttagaaacctgtatctagtgtgcgtgcgtgtgtgctcactggagcgagtactaggaggttgtagggaggaataccaggtattacagaagggatcacttagagcttggtgagtgggtggataagtaggtgcctgagagaggtcaggagtaggaggaaggaagcctggttaatgattgtgtattttaagataacctacatacttggccatacatagttcctagtctctctggccccagagagaggttctccacacctgagcctcatgacactaacccagccagctgagcttcagccaagggtttgtttggtgcttgactgagagagaatgtaaatgggacctgagaaatagacctttaccaaattccatttagtggtattttgctttctgaatatttaaatgaaactttaggttatagcataagtaaatttttttttttttcgagactgagtctctgtcactcaggctggagtgcagtggcatgatctccgctcgctgcaacctccacctcacgggtttaagcgattctcatgcctcagcctcctgagtagctggggtaaatgtttttatgattgttatcttctaaaactattattaggatagtggtgcctgtctgatcttgttaaaaacaactcttgggacttttgcaattaggttactaggaaaagtattaaaattaaaatgagaaacagacaagtaggacaaaatgtgctgataattgaagcttcgttattcccctagatagtattacagagaatgatgatggcttaggtgactttattccttaaattattttacaattttttttaatcttgattttcaaaagaggattcctgtaagtaaagagatattttaaaaccagtttgtgtttagctattttcttttcttgctgacttttctgcaaggaaagagttgatcctgagatttgatttgaaggggaatacttggtatctgtaaggtgagtagagcttgtgtgatgagactaacgtcactgaatagctgtagacaggtgagcatgctgggcaaagggcaaaagtggcaaaagacagccagggcagtgggctgttgccatatcacgaagggctgagctgaggagattaacaattttcttgcattgccttcatttgagtcatgaaacagccagtttctcacaactgacaaggtcaggtttacaggcaatttctttttatatattaatttttaaatttagagcaaatgcttgactgtcatgtaataatatcattctcattcatttgcattccagtatgcttttctgactaaaacggaagaaatagcaactttagaattgtacttaaccctgggtacacacacccatgactatttgtatgaaaatttgtatttaagtgtctaaatgcagcctcacctgtgcttttcccccatggtgtggcataagaaaacaattggtgacacaagctggggatctgtgggaattgaagtcagtgaaacagatcgtgtggaggaaaaatagtttcccaggcttacaagtgagacttaaagtgatttgggatggaattggtataaatcaagcagaaaggttgtattgataccttaggtcatttagttcaatcattttccctgtgcttttagccctcttcagagtctaactccatggccctccagtctcaacttggacacctccaaaaaaacattcacttcaacaaaagtttattgagtgcctattatgtgacaggctaggaacttgggatacagtagtgaacaaaacaaagatgtatttcctgtggcacatctggaacataagttgctttttttttttttttttttttttttgagacagagtcttgctctgtctcccaggctggagtgcagtggcgccatcttggctcactgcaagctccgcctcccgggttcacgccattctcctgcctcagcctccggagtagctgggactacaggcacctgccaccacgcccggctaatttttttttttgtattttttagtagagacggggcttcaccgtgttagccaggatggtctccatctcctgacctcgtgatccacctgcctaggcctcccaaaatgctgggattacaggcgtgagccaccgcgcctggcccataacagtttcatgaggtggtctgtctcatgttgtatggctgtggtagctgacaagtcttgtgttctggctctccaccagggagaaagaagccacagccaagtccccttcttgtgtttgcctagcccagtgtgtggacttaaaagtgcatggccccatagttgtccctcttgagttttgtagttttgttgttggtttggtttttattggtcttgtcatatgatctgcgtacatctctgaatccttttttttttttttttgagttgaagtctcgctcttgtcgcccaggctggagtgcaatggcgtgatctcggctcactgcaccctctacctcccaggttcaagtgattctcctgcctcagcctcctgagtagctgggattacaggcacctgccaaccgcgcctggctaatttttttatttttagtagagaaagggtttcaccatgttggccaggctggtctcaaactcctaacctcaggcaatccgcccgcctcagcctcccaaagtgctgggattataggcatgagccaccacgcccagcctctgaatcttttaaaatcctggttatgtcatctagcatattcattaccctccagtttcctaactgcaggttttgtaaaagcaccaacagatctttgtactaaagtccttctatgcagcctctccagatctgcctcttatatctataaaaagacagtgaggttgatctggcgtgacttgttcttggtgggctcatgctgcttccagatgctccacttcccattctaaattctcacaaaccatctgttagctaatcgcatccagaattttgtctgggtttcatttcaagctcactgttttacattttatggaatttgccatcttttgacaaaaaacaagagacttgacccttcctaagtcttccagtgtcctgtgatgtaatttctctatgacaggagactagtcttggactcttactgctgtttgccagtgtgtttggtcagctcttaagaacaccctttcctcatctttggtgctccttttttttttttttttttttggcattttttttcttagtgatactcagcgttctttgaggtcaccagcatcctcaacattcttgctcttcattcccataattgctctgtgtcatctgtgattgcgtttttataatttcttcttggattgtctttgccccatttcaaaacctgtagtaatttggattacatctggtctctgtgtcttttgaattggccttcccaagggcccatggtacaacttcctttactgactgacctggaattatcagattcccactttaccaattggttttgcttcattgcttagaattaaatttgtattagcattttcttcattgctgcatctgcttgctgaggtgaagtaatctgcaaagtaagtttaggtttcattaatactgattggactttgtattggactcatgatgaatccctaagagatcatcatgagttcctcctgctgggtggcctgcagtgctcttggggctgtatgtgttcatcatgaagcatctgactcagccctgggggtccatgtggcaagcttacaggctcccagtgtaatggggcttctgtccctcacctcacgtcacattctagcaacgtgaagccttcttaccaaggcttcccagaaaggcccacaagttagcattcaccttaagcaagaatctcaggtgtgtccttcccatgccgtggtggtgtgtggatgtctggtgcccgaggaatcatttccacttgcctccttggacctttcatcaggactgaccaggatcctcctccacccttctgtctttgacattgtgtcagttgtccttcacagcatctcagctttatttctttagtaccaaaagtgctttttttccttgactataataccatgcaaatgtaggaatctttagaaagtcctttagaatattctcgtatttaaaaatatatacatatgtgtgtttgtgtatgtgtatatatatatatattttatgtgtgtgtgtgtgtgtgtgtgtgtgtgtgtgtgtgtgtgtatatatatattttttttttttttttttttttttgagatagagtcttgctctgtcacccaggctggagtgcagtggcatgatatcagctcactgcaacctctgcctcccgggttcaagcagttctctgcctcagcctcccgagtagctgggattacaggtgcccgccaccaggccgggctagtttttgtatttctagtagagatggggtttcaccaccttggctaggctgctcttgaactcctgacaacgtgagccactgcacccggcccagaaaaaaatatttttaaaaggtttttgttcctctttcctaatgtgtaaattaagtcagaatgccatggaattggggccctggtgtggttcaggcagggcctgtcccatcctggtcattaggctgacctctgttttctgtgatagctgttctctggtgatagctgttgagtaagaagaaccatcagctaggggttcacagagagaagtttattctcatgactgctcccacactaagagcttgaggtttatatagtttgccaactatctaccttctgtctatgaatttacctattctacctacctgatataagtaaaatgatacaatatttgtcctttgggtctgaattatttcattgggtacaatgttttcagagttcatccagattgtagcatatatcaaaacttcatttcttgtcccagcatggggtgactcacacctgtaatcccagtgctttgaaaggccaaggtgggaagatcacttgaggcaaggagtttgagaccagcctgggcaacatagtgagactccatctgtacaggaaattatgataaagacttcattcctttagggctgaataatattccattgttatgtatatatcacgttttgttaatccatttatctcttgatggatacttgagttgttttcgttattttggctatggtgaataatgctgcagtggacattgacacacaaatgtttgagtccttgctttcagttattttggttatatatctcagagtggatttctgggtcaaatgggtaattctgtgtttagctttttttttttgaaacggagttttgctctgttgcccaggctggagtgcagtggcaccatctcggctcactgcaacctccatctcctgggttcaagcgatttctcctgcctcagcctcctgagtagctgggattataggcacgtgccaccacacctggctaatttttgtattttttagtagagacagggttttgccatgttagccaggctttgaactcctgacctcaactgatcgctcacctcagcctcccaaagtgctgggattataggcatgagcctcctatgtttagctttttgaggaactgtcaaactattttccatagcagctgtaccatattccattccaaccagcagtatataagggctcccttcttcaccgccaaaaaaaaattcttccacatcctcatcaacacttgttattttccatattttttattatagccatcctagtaggtgtgaagtggtatgtcattgtggttttgatttgcatgttcctagtgactgatgttgagcatcttttcatattggcttttggcaaatctttggataaatattttcaagttctttgcccattttttaattgggttatttgagcgtttttgttttttattttgttttatattttttgagacagagtctcactctgtcgccctggctggagtacaatggcactcacgatctcgactcactgcaacttctgccttccagattcaagcaattctcctgcctcagcctcccaaatagccaggattacaggcactcaccaccataccccgctaattttttgtatttttagtagagatggggttttaccatgttggccaggctcttctggactcctaaagtgaggtgatccacctgccttggcctcccaaagtgccaggattacaggcgtgcgccaccatgcctgaccttagttattgtatttaggctgttgatccattttaaatgactttttgtgtatagtgtgaggtaaggtttcagagtctttcttttgcatgtggaaattggtgcagttgtcccagcaaggttattctttccctgttgaatagacttggcaccctagtcaaaaatcagttggccaagctgggtgtggtggtgcacacctgtaatcccaggtaccctggagactgaggtgagaagattgcttgagcctaggagttgaagatcagcctgggctacatagtgagactcccacgtgttaaaaaaaaatcacttgatcataaatgtgtgggtttatttttgacctctgagttctattccattgttctatatgtctctccatatgccagcaccacactgttgattactatagctttttgtagtaattttgaagtcaaggaagtgtaagtcctctaactttgatgcttttcaaggttgttttggctattcaggttcctcgcaattctatatgaatttgaggattggttttcccattgctgcaaaaaaaaaggctgttagaattttgatagggattgtgttgtatttgtagatcactttgggtagtattagctttttttttttttttttttttaatttcttttatgaggcagggtctcactatgttgcccagactggtctcaaactcctgggctcaagtgatcctcctgtctcagcctcccaaagtgctggcattacaggtgtgagccactgcacctagccaatattaatatcttaatcataagtctttccatccattaacacaaatgtttttgcatttatttaggtctttaataatttttggtatgcaagtgtttcaccatggttaaattattctcgttttgttttgttttgtttagacagagtcttggctttgtcaccaggctggagtgcagtggtgcaatctcggctcactgcaacctccacctccctggttcaagcgattctcctgcctcagcctcccaagtagctgggactacagacatgcgccaccatgcccagctaatttttgtatttttagtagagatggggtttcactatgttggccaggatggtctcgatctcttgacctcgtgatccacctgcctcggcctcccaaagtgctgggattacaggcatgagccaccgcacagcctattcttggatatttttattttagatgctattgtaaatggaatcacttttttttttttcttcttggagacagagcctcactcccgctccattgcccaggctagagtgcagtggcacaattcttgtgcctcagcctcctgagtagctgggactacaggtgcctgccaccacgcccagctaacttttttttgtattttagtagaattggggttttaccatgttgcccagcatgatcttggcgcctcccaaagtgctaggattcaggcatgagctaccgtgccctgcctggaattactttctttctttttttttgggatggagtttcgctctatcacccgggctggagtgcagtggtgtgatcttggctcactgcaagcgccacctcccgggtgcacgccattctcctgactcagcctcccaagtagctgggactacaggcgcctcctaccacgcccggctaattttttgtatttttagtagagacggggtttcacggtattagccaggatggtctcgatctcctgacctcctgatctgcctgcctcggcctcccaaagtgctgggattacaggcatgagccaccgcacccggcttggaattactttcttaattattcattaccaatatataagacgcaactgatatctatgtgttgatctcgtaccctgcgactttgctgaatttgtatcttttcttatatatatgatcgtgtcttgacttcctcttttccaaaagcccacatactcttgtaccacagcatactggcctgtgatacctttagccccgccccctacctttcccaaataaaatctctgtgttaaccagtaaacagccctcttgaatcaagttactactctgaaggatagtggtaattttaagaaagagaccaagtcttcagtattaaaaccctattagatagcattcagttgtgggtttgagtgtatgagattacttgactgctagccagggcacacagacagggagcctagccctcttaaagcctctatctctctggctactctgattcaggtgcaggtgcacagagaacacaggggcaggcagtggacccatgcagctccgtgagggccaggggtgtttgtctcctttgtgtcctctgttgtatctcttcacggcctacacatagatgttcaatatttgttgaatgactagaggaataaaagccacagagagcaggatgatacctgtctggtgattatagtacatgggctttgttttgttttagatattttgggggctataagcccctttgagaatccagtgaaagttgtgcagtcttcagaaaaacagcatacattcatgtatttgcatacaacttcgcaggatgttctttgatcactgagacccattcacatcactcaagttagaatttatgattccagtgtcaccagtgtactcctgatcttacttttatgtaacctgaaagcatacaatctcagcctatcagtacagggagcggagactgattatggaaccaaaaaactgctgtgacgaccagtgcttgggccctccagtgcgttgactgctctttgaatcaagtgccagatgccagtcagtagagtcatttcctggacaacactctggacaagtagggctgtaggaaactattgccagcagcaagaggtaccctcttgccatttaactcttggtagacataaaagggctgactagtgtccctggcatatgtgttttagagttaatgtgtccactccccaggtgctaagtgcggccagccacaaagatagtgttttgacagttctaataatgattaggattggcctgttccatagagtgaaaattaataaggatgatgcattaggtatgtgcttcctcttaatctgttgataaggtcagccacatctcccaggtgtagtttgccccgtgaactgagttggtatctacccacatcaagattggtctgccctctaagactatactttcagggatcatttctatagttcattactagagaagtttctctgaaggtgtagagcacccctccctccaaaaaaaaaaaacagattgatctgccctccacagtgagtgcttctttgagctggatccgtgtaccatgaacccagaggaagagcaccacaccagaatagggagtgatgagggaaacggcaagatggctgccaagctaccagccattttaggatctgagcacaagcactgtttggtagagccatggaagaagctggtccatagccaggcctgtaactggacagcaggctgcataacagccaggatatctttactgtgttgagatagaaaacagcatgaagaatgatgatggtgttttagcatgtggaaactcctgcaaggccacaatgaggcactaatggtcaaggggccaccagaagtctctcagccattctcttcctaggctgctctttgacctacttctgctggtccaggttccctctgtctaagcagtagctccttgaatcctgtgctctgcagcattgagttaatagtgtttttctgccacttgctgcttttatgtgttttctgtctctctctcttttttttttttttcaatagaagctaggtctcactatgtcacccaggctggtcttgaacatgtggcctcaagtgatcctcccaccttggcttcccaaagtgctgggattacaggtgtgagccactgcgcccagctacaccaagtgcagtgacacgattttggctcactgcaacctccacctcccaggttcaagtgattctcctgcgtcagcctcccgagtagttggaatttgggattacaggcatctgccaccacgcctggtgatttttgtatttttcagtagagatgaggttttgccgtgttggccatgctggtctcgaactcctgacctcaggtgatccatctgccttggcctcccaaagtgttgggattacagatgtgagccactgcgcctaggctttttcttttcttttcttttcttttttctttttttcatttttttttttttttttttttgagacagggtcttgctctgtcacccaggctggagtgcagtagtgtgatcacagcttactgcacccctgcaacctctgcctcctgcgcttaaacgatcttcgcacctcattctcccaagtagctgggactgcaggtgcatgccaccacgcctggctcatttttgtattttagagacagggtttcactgtgttgcccaggctggtcttgaactcctgggctcaagtgatccacccacttcagcttcccaaagtgctgggattacaggtgtgagccactgcgcccggccactttgtgcttttcacactatgttattatctgacaaagattcattgtgtatcccactcaaaagacagaagttttttaaggatacgaactgacctgcccattttccatggagtagatgttcagtaaatttatttaattgattaggtaggatcatgtagaaagtatcctgttgaagaccgccagactcacaagttaattggaaggcgtgaggtgtgagtgttcttggcagctttcaatccttagcctcatctttaatcttcccgtagtcttctttggctgcttagtatccatcacagtcatttattagaccccgttttcagcctgttcctcattggttttgagaggacccttgttggtgacaaggttggaaatcctctgatatatacagtgttgtgcttctcagtgctaattccagctcttcccttcgtgcatccaaagggtatgatcattagagggggcgtggggttgggggatgggttctattcaggaatctctactcaagtaacaatcatttaattactgcaagaacctttcaaagttggaaggaaactgagacttggagaacttaagcagtttgctacagtcatgtagtttctaaaagtggcagaaccaggacatttgtttggtgtcctgcatgctccaaagttcatggcacggaccattggactgtgccataaaaaccttatgcctgtttttattttgagatgtagtcttgctgcgttgcgccggctggtctcaaactcctgggctcaagcagtcctcccacctcagtctgccaaggacctggaactagaggcatgtaccacgatgcctggttctatatgtgtttaagcagacaaaagcttatttcttattgtcttagatcttaggtgggtcttatattcaagtagcgtttttatggacctaagtacacaatacagaaccttagattagtgctctgctgaacagagtaacaccctgtctacaatgactaccacctgaaggtctttttttaaaatacacctttttgtgtaatttgactttaaccattctcagaatcatgtgttcatttctatcctgttggggttagtggccaaaatagaaggttggtgtggggtggggagctgctttgtgctcaaaagctgtttctgtgtgtgtgtgtgttttgatttttgtttttttgagacagggtctcactcggttgcccagtctggggtgccgtggcactatcacggctcactgcagcctcagcctcatgggctcaagccatcctctcacttcagcctcctgagtagttgggactgcagtcatgtaccaccacacccggctaatttttctattttttagaagagatgaggtttcaccatgttgcccaggctggtctcgaactcctgacctcaagtaatcccaggagttcaaggttacaatgagctgtaatcgggccactgcattccagcctgggcgacagaccccgtctataaaaaattaaaaaataatgtgcatggtggtgcacgcctgtagtcacagctattcaagaggtggaggtggaaggatcacttgagcccaggcgttagaggttacattgagcagggatctcaccactacactccagcatggctaacagagtgagaccctgtgtctaaataataatgtatgggccctttggataaggtagtgtttgtgatttaatgtaaactgtctttttcttgttgcagagaaatgctaactttgtcttcttcatccatacaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacatggaaagggtcttccttctcattgctgcccgtttgtacatgggactgattctgttgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggcttttttttttcttttgttttggtttggttttggaaaactaattaattagacttgtgtgggggtttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagtagctgggactgcaggcgcgcacaccacgcccagctaatttttgtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccaacagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatatgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgactggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcagcttcggtgtttcagtgtctcctcagtccgcccccactagcctcctggcagttcatcagtggtgaaatctctgatgcttctcagagacccttagtgctgctgctgaccaagagctagaatgaagtcttggcatccgcccattccaacactcgggcacccagaggagagcacctggggtctccctccaaaagagaaatctgcctcccagagtgtctgtcttgtaggtattgtatgggagcctagtgcttggccttctgagcatgaggcaatagttcccacaggttgcaccaccacagagaacttggatctttttccttctaggcacccatatctgaggcttctagtaaatatttcttcagcatgagctaaccagggttgaatggtatcaagcagaagtcatgggaagtgagcagcctcattgcaggtcagggcatgatatctgtgcggctttcttgaatccttttctgttcttggctgtaggtggttctcctgatgaactttgggagacctccaagtggattggcttgaggtgttgggaggcccactgacaccccctcagccagggccttgtctctcctactcccagctctcagtacattttatctttcacttcactgtactctattcccatgcctatttgtgtattttgaggtgcatattttcttgtaaaacctcaggaagccatttttaaaaattatggctggatgtggtggctcatgcctgtaatctcagcactttgggaggccgagatgggcagatctggagttcaggaccagcctggccaacacggtgaaatctcatctcggcaaaaaatataaaaatgagccaggcatggtgatgcaggcctgtagtcccaactactgtgcagggagggccaaggtgggaagatcttttgagcttgggaggcagaggttgcagtgagctgacataccactgcactccagcctgggtgacagaggaagatccttctcaccgccctccccgcccccacccccactaagacagtcttgctctgttgcccagagctggaatgcagtggtgtgacgtcacctcattgcaacctccacctcccgggttcaagcaattcttctgcctcagcctcccctgagtagctgggattacaggtgtgtgccaccacgtccagctaacttttgtattttttagtagagacggggtttcaccatgttggccaggctggtctcaaactcctgacctcaggtgagccacccacctcagccttccaaagtgttgagattacaggcatgagccactgcgcccagctgagaccctgtcttaaaaataaatttaccagcactttgggaggctgaggcactttggatcacaaggtcaggagttcaagaccagcctggccaagatggtgaaaccccgtctctactaaaaataaaaaaattagctgggcatggtggcgggcgcctgtaatcccagctactcgggaggctgaggcaggagaattgcttgaacccgggaggcagaggttgcagtgagccaagatcacaccactgcactccagccccatgggtgacagagtgagactccatctcaaaaaaaaaaaagttaaaaatttatttaagacagtgtcttgctcaggctggagtgcagtggtaagatgatagctcactgcagcctccaactcctgggcccaggcaatcctcccaccttggcctcctcagaagctgggattacaggcatgaccctctgtgcctggcccaggatatatatatatatatatatatagaactatgaggctaaaatgtccctggttcctactttcaggtttctgctgaatttgagagaagtctgtcttgaaatatcaaaactgtcacatcattctggaagaaacaatactccagagacatctttgaaaactacctttagagcctggtgcggtggtgcgttcttatagtcccagctactctggaggctgaggctggaggattgcttgagcctaggagttccagactgcagtgagttatgactgtgcctgcgaatagccactgcactccagcacggtcgacatagtgacacctattgagacatagtaggatctcaattttttttttttttttttttgagacagtgtcttctgcagtggtgtattctcggctcactgcaacctccacctcccaggtttaagcgattctcctgcctcagcctccccagtagctgggactacaggcttgcgccaccatgcctagctactttttgtgtttttagtagagagcaggtttcaccatgttgaccaggctgctcttgaactcctgacctcaggggatccgcccaccttggcctcccaaagtgctgggattacaggcatgagccaccacctggccagcatctcaatttttaataaataactaaaaaataacttgtttgaacaggtatatcttggccagcaatgctggactgggttcctttgaggtgagggaaactcttggacatgggacctagtgggggcctctgcttgcctccctgctgggttaacagtacagctggcccagccagtcttgaaaccttaccctgcaacaaaaacttgacacctccaggctggtaattctggaggtgtcttctctgccaagtcggtgactccccaacccgctattatggctggactctgctcttgcagtcttagtgtacaccctggttcttcaagggcagcaagcaggactattccggtagcaaccagagctggagctcagggccccgcactggaaagctggggcagcttaggtggtaactagtgtgctgaggatgaggggcgctatggagcccaggcgggtttaggaagcattcttggcttcctggaggaggggaaatactggtaattcaggctgaaggagctggatggggccaggggcagtgactcacgcctgtaatcccagaactttggaaggcctgagacgggagggtcgcttgagcccagaagttcgagaccagcctgggaaacatggcaagacctcgtctcaaaaaagccacgcgtggtatgcgcctgtgctcccagctgcttgggaggctgaggctggaggatcgcttgagccctggaggtcgagactgctgtgagccgtgattgcaccactggactccagccttggtggcagtgagaccctgtccccaaagaactgggtgatctcgaccctccacatcgctggctctccacgggcgctgcacagtggagacccaggatctgattgcataggactgggcactggagtttaagttctccaggggggtttaatatgcaacgaagttgggaaccactaccagtgaaccccttcattctgtgcggctccagctcccggaagccctcggacaaggaactgtagcccatgtaccgcgtgacgtgagagcggagcccgggtctgcccgggcgcgggcccgcggccacggcgtttggatcccagatcccagcccccgcgctcagtccgggcttcctgaccggcgctctccgcgtcccttctcgcgcgcccttacctggggctggggaggtggggacagagccgggcgcagtcgggggcacagccctgaggcggggctgagggccaggccgccacgtccctggaccctgaaaacgggctcggacccccgctgcagcgtggactccggtgtggccgcggggcgtgcaacccggaccctggccagctccgtgtcctccagacctttactcatgtccccgcatcgccaggccgagctgcaccttcggtccccgcccgcggcagccgaggtagggcatctccagcgccgactccggggaaggtggacatcgcacggaagggggtgaagggcagggaggatcccagcttgggatgggggtagagggtggcggaccttgcgcggggcgggtgtggagggcggcccaactctcgtggcccctggtgcttccgggagctccgtcctcgctctcggatcccaaggaagaacttgacctttccctgacatcctccagtgcccatggcttctggcgtccacggatggcggggaggggaggggggcgcattcagcgactgcagagactgggggctgtgggccggggcagctgcggggcggagggtggcgtgtggtggggttgggtggcgtggggttgcagaaggcggggcatggggcccaacggccggctgcgccgcccttctccgtatggctcttcggagccgttgcatttgccctctcagggcttcctgggctctcggccctaagtaacctgtgtcccagagtccctgagggaggcgcaggatcactgagctctgccctccctaagatggaagcaggaccgtgtggaggagggacggccgcatgggatggccagggtgggggccccaagaggacagcctccgcccgctcgcccgcccgccaaggaaagccctgggggaacacactttcaggctaaggggtctgaggaagagaagactaacaagggggaagccctcgagatgcccaacagtcaagtccgggaaggacggagtagataaccagtaactgcctagagggtgggagccaagaagaggaggggcctggacagggctgcaaggaggaagacacaggcccccatgccagccttctggaaacagcggtttgcagaccacctgagctcaccaagacagctctgaagaatttagggaattatgctttggcttctgggttgaaggaaaaaaatagctataggatgcagcattcaaaagacccgtaggcagggcgcggtggctcacacctctaaccccagcaatttgggaagctgaggcggagaggatcatgtgagccccagggttcaagaccagcctgggcaatatagtgagtctacaaaaaaataaaaatgaaaaaattagctgggcttggtggcatacctatagtcccagctactccacaggctgaggtgggaggatggtttgaacctgggagttggcccaggtgtggtggctcatgcctgtaaccccatcactttgggagactgaggcaggtgaattacttgaggttaggagtttgagaccagcctggctaatcatggtgaaaccccatctctactaaaaatacaaaaattagctgggtgtggtggcccacgcctgtaatcccagctactcaggaggctgaggccggagaattgctttaacctgggaggcggaggttgcagtgagctgagatcgcaccattgcactccagcctgggcaacaaagcaagactcagtctcaaaaaagaaagaaagaaagaaagaaagaaaggccaggtgcggtggctcatgcctgtattcccagcactttgggaggccgaggtgagcgaattgcttgagtccaggagttcaagaccagcctgggcagcatggcgaaaacctgcctctacgaaaaaatttttaaaattagccagccatggtggcacgcccactcctgtagtcccagctactcaggagaatgaggtgggagggtcacctgagcccgggaagtgaaggttgcagtgagccgtaatcgcaccactgcactccagcctgggcaacagagcgagaccctgtctcaaaagaaaaaaaaaagaaaatatttaaaatatttaggcccagcatggtggctcatgcttgtaatcccagcactttgggaggccgaggcaggcagattgcttgagctcaggagttcgagatcagcctgggcaacatggtgaaaccctgtctctaccaagaaaatacaaaaattagctaggcatggtgacaaatgcctgtagtcccagctactccggaggctgaggtgggaggatcccctgagcctgggaggtggaggctgcagtgagctgtcatcacgccactgcactccagtctgtgccacagagcaggaccctgtatcaaaaaaaaaatatgtatttttaacacaattacaaaacactgtttataattaaaaataataaaatgtttgtaataaaaaaactttttcacggcagaataatattccactgtgtggactgagacagctggttttgtttgtttgtttgtttgtttttgtttttgtttcattttgttttttgttttttttttagacagagtcccgctccttcgcccaggctggaatgcagtggcgcgatctcagctcactgcaacctccacctcctgggttcaagcaattctcctgcctcagcctcccaagtaggtgggattacaggtgcccgccaccatgcccagctaatttttttttttttgtatttttagtagagacggggtctcgccatgttggccaacctggtctcgaactcctaacctcagatgatccacctgcctcggcctactaaagtgctgggattacaggcatgagccatcacgcctggcctgagacagctcatactagctcatcggtcactgggagtgtggagcttgttgtcaatcgtgtgtgtgtgtgtgtgcacgcacgcgcgtgtgcgtgtgtttagagagggggttttgtcatgttgcccaggctggtcttgaactccagggctccagcaatcctcctgccttggcctcccaaagaactgggattacaggtgtgagccacgctcctggcctgttgccaaattgatgatagaaattcctcatggggtctaattaagtgccacagggacagggctaccctgcagccctgtgggctagctcttgcccagccctcactgtaggagtcctctgacctcttccgcctacctcttgcctccttccagtccaacaccagtcttagatttctttcctgaagacacatgcaaccgggcacagtggcatatgcctgtagtcccatctacatgggagaatgaggcaggagaatcccttgagcctaggagttcaaggctgcagtgagctatgatcgtactcctgaactccagcctgggtgacagagagaaaccccatttcaaaaacaaaacacatgtgatgaagactccttacccagctccccctgttcctccagaccagccaacctccatgccaggcccctgcccagaacttcatggcaagctggactggactggcatattctgagttctccagaatttaccatcttacctccttgcccacactgtttcttctgtgtgaatgcccttttcctctcctatgaacacctacgggcatctgccctcagctcctgccacctccctccatgagaacagggattaagactggctatccctcaccaggcgcggtggctcatgcctgtaatcccggcactttgggaggccaaggcaggcagatcacctggggtcaggagttcaagaccagcctgaccaacatggagaaaccctatctctactaaaaatacaaaattagccgggcatggtggcacacgcctgtaatcccagctactcgggaggctgaggcaggaaaattgcttgaacctgggaggcggaggttacggtgaccccaaatcatgccattgcactccagcctgggcaaaaagagtgaaactccatctcaaaaaaaaaaaaaaaaaaaaaaagtccgggcgcggtggctcacacctgtaatcccagcactttgggaggccaaggtgggcggatcacaaagtcaggagatcgagaccatcctgactcacacggggaaaccctgtctttatgaaaaataccaaaaaatcttagcccggcatggtggcaggcgcctgtagtcccagctactggggaggctgaggcaggagaatggcgtgaacccaggaggcggagcttgcagtgagccaagatcgcgccactgcactccagcctgggagacagagcaagagtccgtctcaaaataaataaataaataaataaataaataaataaataaataaataagactggctatcccagagcctggggacaggagagtgtgcgctgcaaagccagccatttgaggagggcctagtctgaactgaataggtcaatgggctggagctgactttggacagagttgaacaaccccaaagaatccagtgggtgctgggcatacagtcgtcaggcctgtgtagacagacctgggccgagaagaagctgggctgcagtagccagggcaaggcagaggggcaggaacaggcatgggcgatggggttgggccccagttctttgacctggggaatcccccaacctatgcttccatatgaatgaatcactgtgcatctgtgggcaccactgcatcagcttgcccctccacacagctgcccttggctcatgttggctgtgctgtatcagtccttcaacgtttcctggggatcagttaattaagttgaggtctctgcgtctggaaatccgcctcagcctgcagggaaaaggcccctagtcttgtttctgccttcagaaccctgagacagaacaaggagaatcctgctgattctcagattgggctccagaggggcgacagtgtcaatcacaatgttagatactgaagttggctcagttctttttttttttttccttccccttctcccctcccgtcccctcctttcctctcccttcccttcccctcccctccccttcctcccttttctttctctttctcttttttttttggcggagtctcactctgccatctcactctgcagtggcgcaacctcggctcactgcaacctctgcctcctgggttcaagcgattctcctgcgtcagcctcctgagtagctgggattacaggtgtgtgccaccacacccagctaatttttgtatttttagtagagatggggtttcatcttgttggccaggctggtcttgaacccctgacctcaagtaatcctcctaccttggtctcccaaaatactgggattacaggtgtgagccactgcacccggccttttttttttttttcttcttttgagacagggtctcactttgtcgcccaggctggatgtagtggcagaatcatggctcactgcagccttgactgcccaggcccaagccatcctcccacctcagcctcccaagtggctgggactacaggcttgcaccaccacaccaaggtgaagtgttgttttgtttgttttttgtagagacagttttgccatgttgcccaggcagtgatcctcctgcttcagcccccacaaagtgttgggatcacaggcgtgagccgctacgcccggccactttcttacctaaaatacctgcacaccctacttggagaccctagggtgaggggagtggggaacaggagaacctgacagtagagggtacatgtaaggaggagagggacaagcttgctgtgtggtggggtgctccagggctgggggtgcctagggatccacctctctcccaggctgtggaattatcctccccgcactcactgcttctctaaccttggctatctcctgctgcctttggggtgtctgatgggcttgagggacctcccagctgctctaggtcatctcaccgcagccatgtgccccatttggtactgtcaaagctgctggaatattatcgtctttccagaactatccctggggcaatatcaggacctcaggctgcccggggctcagagccctcctgggtcttcctggggcccctggtccacatgcatctccactaagcctgagggcccttcgggagaggcagcacttttagcctgcccttggttttagcttttgctctacgaagatcttgtgatttctgccccaccatggggcagcaggaacctcaagcacagtgcctgcggcaaagggagccacaatggacttgccccaggtcaggcctgcacttgccttgtgtcagggtatctccccaagttgctggcctcagtccctacactgacctgtttccccagctttatctctggcaccccaaactcagcagccccgaccccacttcccaagcaccccctgtgcctggctctgtgcctgtcatggtgtcctggcagcagtctgggagagtatttcagttacctgcggtgtcctgggaaggctggagcagaggggtccactcactgattgccaaggtcacagaacaggacttgcattgtgcactggaggccctgtggtcttgcatgagcctggtaggcctctcccctcctgcttccagccctccatctgggaggccagcctgcccagggctgctctgccacttagcagctgtgtggccctggagagtccctaacctcactgaacctcagtttctccgtttgtgaaatggagataatacaaagagaactttccttctcaggctgttgtgatgggtaaggaaataaatgcatgcaaaatcacagctgtagttactatgaggcacactgtcttcctggctagaggagattctgaaggtgggtggggcagcaagatcaccacgtgtatgaaatgggggcaggctggttggagactgagggcaccagccccaagcactgccatctgccctgtgatgggactctcctgtggcagtggcaacggtcccactgtggaagcaacacatgagctgagaggacttgcctgaactgagccacatgtgccctctgggcctggtcaccccaccacctgcccccagtgtgacccatgcagggcctgttcctgaccctgaacgagaccaggactccctgggctgcatttcctatctgtaaaattgtaggagggtggtggtggtgggggctcgaacttgccccctgggtggggtggggcataaatagtcccagaggatggcctgggaaggctggctgggcctggcacaggggactttactgctgtcattattgtcctccttacaggagaggagagcaaggcccagaccggggaggaacccacacagcctctgtgctccagcctgcttgaaagacaaggtctacctacaacgcagagatgcacacattaaggacaatgaaacacccaagtgttaggaaccagaataatcagccctaatagaggggaggctgatcagggagggcctcctggaggaggaggcacaacatcagggtgcactgtgatttctggagacccaaggagttctggtaaatgacaggtgagaaaaagaaaatgtaataaaatataattgaaaacagaccctggtatgtgtggagagagggccgggaggaacctaggacaccggggaacctgaactcccccaaccagtgaagggagctgtgggcagcaaggtttgattggggttttctttcttgtggaggtttctcagagtgattcaagttcccccaccccgcccacagatggttctgagactttggaaagaaagaaaaggaaaaaagaccctgcccgcgccccagctgggcatccctgggaggtcgcgaggatccccggagacccagactcgggcccggggcgcccccggccagagcggcccctggctgcctccctacgccccgcgactccggtccggacgccgagggcctcggcctgcccctgtcccccggccgccccccacctgctccggcccggcggggcggtgctgggcccgcgggctccccggccgcagtgcaaacgcagcgccagacacgccccgcccgcgcctccccgcccccccgcgcccgcggccccaagcggttcccgagcccaggcccgcgccgagcccaggtgagcgcccgccccggggaccctggtccccggaaccccggtccccgcccgccgccccgcctcttcgccccggcgccgggggccagcgcttgcgctcccaagtctcggaccccggcccggcacgttaggggctgggggttggcaagcggggccagaggcactggccggggtccgaagctcacctcgtccttctctcgtcccacaacggccccttcccggctcgccgcggggccccactgtgtgccagtcccccttctcgggctgcaaggtctggcgggggcaacgggacggagccggcgaggctgctggcatcggcttcccagagagagggaactgcacgtgcagaggcggggagagtggacagaggcttgccctgagctccgtgggggaggggagagcgcggagcccccacactcgaaggcaggactgggatcagatgccacccctaggacgcctggaagccactgggagtccgatctgggcaggagcccttgggatgaggcagtgggggcaggtggcgagaggtggaggagtggggagaggaccctgcccagcctgcaccctgggggcgccaggagccctgggagggtcaggtggagcaggggccgctctgtgagatgggagtaatccagtcccgcctcacaggtcctggggtccctgggacagacacagactcctgctgggtggttagcactgggctctgctagaacttttctgcagtgggcagctcatgggcaaggaatagcactcgggcgctctgcactctgggggtccctcctgccctgcccctggcaaggacctttgcctttgagtggggtgactgggctccaagccgatctagcacacagtaggccgaaggcacaggggccccacccagtctccttcctggcccaggccctgggggattcaggtccctgggtactcgggaagggacagcacagcctgggcaggtccccagtggcaagaccaggtctgaccttttctgggatctgtggcccatcaggtgaggcctgaggtcagccaggaaggaagcgggcagggctgaaccagggctgaaaccaggacccaggaagggacagcctagtgcccagggaaggggcaggtggggcaggtggcagttgagttttacagaccttctttgatgacaagtgggggaaagagccaaggcacgccccagtggctgtgggagccaccgcctcctcccctgtaatgggcacctcgaggaccgacaggcgcaggggccaggcaccaagggtccctctccaacctggccttttgtttccaccccttgctctcaggcacccacccacggcccttcctggtatctggaccagaccaggtgggtctcagccccacctcaagtgagacttcaggaagaacttccagaggaaactggaggatggcagtgggatggactgtggggaggtcatttgcaaacaaggcagcttatgcctgtgccctgggccttccaaagtccacctgtaggctgcatcttccggaaggcccaccctgtagcctggaaggcacctggctacagtgatctctctgctgtgcaggtgtcccctcccccagggcaccttgcagggccttagggtgatatgggggctttctgggcccctgcccaccttaaaactgatcaaggtgggagggtggggtgggaggccacagggatgcccctgctgcttgaccttgatgggaccttgaccccttgctttccccatatgctgttgggcatgactgcccacaggcctggtgggcgtttgtgaagggctggagtcgggggtagggggagcttatggctgctgggcacaggcgtggcagggctgtgtgcctggcttccctttcccctaaccccatcaggcccgggctggccgcccacttctgttcaccacagagcagggtttccctggggaccagtggactggcccagccccacaccgccccccagcccctcctggccacagcttgagctgggaggagggtggaggctgggccgcctcctggacccctgccctccctgcccggccttccaaggcccggcagcctcagtccactgctgggcctggaacacggagcagtggctgccctgcgaggaggtgggtgtccggagtgctagccagggtggggctgggctagggggagcctgatgtcacccccattgtaggagggagaagaccaaggatgagaagggctttggcttccccaaggtgaccccctctttgagcctaggcatagtggtctcccgggagaatggagggtcccagagctctcaggctgtgggatttggagaggggaaggggggcacgaggaggcagtagaaatcagggaggatttcctgggcaaggcagccgcggggctggacgatgggcggccgaggttcgggcagaggaactccactggaggagtgagggagctgagcttggagggcttcaaaggggaggtgacctccagggccccacgctctgggatcaggctcacgccatggttcccagctcaaatgtaagactctttccgaagctcccactgtctctctccgtccctctgtgtctctacctgcccacacgccccggtcctgatggctccagtctcccctgcaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccaggtacctcctgtcttcttgtctccatcctttctcctccctccccgcctcctcctcccccgtctcccccccctccccctctgcactcggtaggcctccgaagtaggtcaggctatccaagaacccgctcggaatgttaatacgctgccgccaggagggggtagggggcctggagcagttcccccagctggcccctgctccagtgggtgcccctttttctttggggctttgagtgttggtggtgggaataacagcaggacccttcttggaaaaggaaagtcagggttcctcctgttgcagggttggggaaggggctatgcccccagggccagggaaggggggagctggggacacgctcagccactctgtgacctagggcatgcaagttacccctctgagcctctgtttttctctctgcaaaagagagggcctggccaccctgacctcttagagttgctgtgagggtgtagtgggcagatcctggctctctttgcctcctctgatcccctgtgtggtctcgggctgccttcttggcctttctgggcacacttccccatttatacaggaaatcaccatccaacctagcctgagctactccagccagaagtgggagtgtcctggggtgctaggggaggcctgggtcttttctccactaaagactcatgtctgcggagctctccctctggccccccactttccctcttctctcctcacaacacctggggaggcaggagtgtgcagctttgtcacaggtggagaaactgaggcttagagagacctcaagagcgcagccagtgctccactcaacctgccaggccacgctgccccagccagctcaccccagccagctcaccccagccagctcaccccagctccccttacctgatacccatcagctccgttaccttggaacttgtgaggcttttctccctttcctgggtctaagggagaacttgggcgagggaggagggctgtgatgacccaccaggcagagggacccacttgcctctgctccaagaagccactcttcctcccccgctcctgtgctgtggacacctaggcctgggctggatccctctctgcctcaaaatgtgccttgggcagatgacgtccattgtctccccctagcagtgggtgggatgatgccagctggcctcataccaggcgtctgtggcaccgctgggctggcaggaggccctggcagaagatgccacctgcaggttcttttaaaggaccccaaatggctggcctgcctgggacccgtggccccaggacttccagtgtcgggggtggccaccctcaccaaaggcagtcctaagaacttaggcaaatccagccctgcccctttctggctgtgtggccttgggcaggtgatttcccctctctgagcctctgcatcctcattgtaaagtggggctgttgtgcctagcatgagggcctggcacaccagaagcacttgcggaattttttttttttgagacagagttcactccttctcccatgctggagtgcagtggcgtgatctcggctcactgcaagctccgcctcccaggttcatgccattctcctgcctcagcctcccaagtagctggaactacaggcgcccgccaccacgcccagctatttttttgtatttttagtagagacggggtttcaccgtgttagccaggatggtctctatctcctgaccttgtgatccgcccatctcggcctcccaaggaatattatttgttatcccttttctgagctgggctctgtgctgccaggcctcccctgtggggctgtagccagaggctcaggccccaggtgcccatgctgggcaggtcaggcatgaggctcagggaatttccagatatgggagtgacagcatttggggcctgagggttcagctggggtcttaaggggccacaaagagactagatcaagcagaagacctctgtgcaaatccttcactttctatcttgctccactcgattctgtggctccgtgtgcatcagcacctgcttcctgggttcccctctgtgctcctgtgtgtcctgtctgagtagttgataagaaggtatcagaccagtccctcacctagctcagagctaggaggaagtgcagctctcttagcatctgttcacctgccttttattaggccataactgatacctaaaggctttccatcctcaccatggctgctaggaggctcagagctaactggtaaaacactgctgcccaactccatctattgagcttctactctgggttacatacagtatttccttcagcattcactgtcaccaacgaggtaggcatttgctgttctctctgttttattttcattttttgagatggggtctcattctgttgcccaggttggagtaaagtcgcataatcatagctcgcagcaacctagaactcctgggctcaagtgatcctcccacctcctgagtagcagggactacaggcctgcaccaccacgactggcaattttatttatttttttaacttttttattttttgagagacaatctcactccctcacccaggctggagtgcaatggcttgatcttggctcactgcaacctccgcctcccaggttcaagcgattctcctgcctcaggctcccaagtagctgggattataagcgcatgccatcatgcctggctaatttttatatttttagtagagactgggttttgccatgttggccaggctggtctcgaactcctgacctcaagtgatctgcctgcctcggcctctcaaagtgctgggattacaggcatgagccatcattcccggccaactggcaatttttaaattttttgtagagactgcatctcaccctgttgcccaggctggtcttgaactcctggactcaagcgatcctcctgccttggcctcccaaagtgttgggattacaggcatgagccaccacacctggccttctctccattttataataaaggcatcttaaggcccaaaggggctaaggcaggtcttatgggcagccagaagtcatggagctggggctgatccagttttgtgggtgagcagagacgcctctcccctctacctttccaaagggcccctgacttaatggcttccattagactgcatcagtgagtgggcttggagccttctgggaggaggtggaggatgagagcagcctggcttggcattatctggcccccctgccaggctatttgtgagctcccacagcttccacagctggtgtcagctaagtccaaagtatttctctttttaattcttccaaaaacattctaacaccattacataaggtatagaaaatggaatgaaagccccacccataaccccccacctgatacgatggcctcagtgtggctctgtgctctgcatcctccctgctgggctggggtcaaggaactgaccttttctttgcccctgtgccctgctatgcctgggcctgagctgagggctgggacttggggctggggaggggacctggccagcgtggaggatttagcagagcatgagatgatggatgggctgggcagccaggagaggcaactcctgagccttgtctgggtagataggaaggatggcagccccagcccaggggacagctcaggcaaaggcctggaggtgcatctcggcagcctctctgggttcttggtttctggagtgtcagttctgaggtggaagggatgagaggtaaaacccagaggtgctggtgccttgggaagtgagagaggtacctcctgctccagcatcgggcccatgctgtgccaggggcttagtgtccatcactcagcttcctccctgcagcagcagcctgggaggccagattattgctgctaaaaattctgtttattgttcccttctaattagaaaaatatcccaggcacatcacagggaatttggaaaatgtgcaaaagtataaagaagaaaatggcaatctctggctcactccccgctagagctggccccgtgggcacgctggggaagtggctctgtatggaggctgtggggggggggggctgtgccccctctgtgccatccacatgcattcccatgctcaggttcacccccagggcacacgaggacactgaaaacccagcacctggttagtgatgaaggattctcaaattggtgagaagagctattttgagaagttgaaatcgggccgggagtggtggcccacgcctgtaatcccagcattttgggaggccgaagcgggtggatcacctgaggtcaggagttcgagaccagcctgaccaacatggagccctgtctctactaaaaatacaaaaattagtcaggtgtggtggcacacgcctgtaatcccagctgctcaagaggttgaggcaggagaatcgcttgaacctgggagggggaagttgcagtgagccaagatcgcaccattgcactccagcctgggcaacaacagcgaaactccatctcaaaaaaaaaaaaaaaagaagaagttgaaattatgctgtgaattatgctgtgtacattttttttaatttttgaaaaaaattcaaatatatgggaaagttgtaagactagaacaatgaacccttgacttcctgtcacccagattcactggctgggaactgagctgctgccacttttgaattcctgtatgtacatgagtcataccctgagatgtcagggacattgtcattgtccatcagaagatgcaggactgtagggcctcagggttctttctgccacagaggtttctgcagccaggagaactgcagggtcgaaggaactcagctctgtgtccccctcactaacactgtaattgaaaaaggaggcggggtgtggtagctcaagcctgtaatcccagcactttgggaggctgaggcgggcagatcacttgaggtcaggagtttgagaccagcctggccaacatggcaaaaccctgtctctaccaaccctgtcacgccacacctctggcgtggtggtatgcacatgaagtcccagctactggggaggctgagatgggagaatcacttgaacccaggaggcagagactgcagcgagccgagattgcatgactgcactacagcttgggcgacagagtgagaccctgtctcaaaaaaaaaaagaaaaaagagacatgcagaaacgaattcaagcagacccgggagcacccccacccatccatgcccctccgctgcttcgtgccaggtttaaggctctttgctgggctggtggtgcagagggaattctggggaggttgccaggcagggctgagcctcctggcaccccgaggagctggcctctgcacccagcttgagggatgggggaggaagttggctgaggtggggggctcaaggcgctgccttgcccacagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagtgggttctgggcttgcctgggagcggggatcaggggtcccaaggtgggagggtgagggggccatagccgggggtcggggttggcctgaaggggctatgaccagctgctgccctggtcactgcctttgtggcttctaccggtctgggcctgctccccagaaggctggacactgggaggagctgccaggaggttgtgcctggtgtctggcctgacctctgagtgctgcggttccccaggatgcgggaagtggagctgggctgggggaaggtgttgctggtgaaggacaatggggagttccacgccctgggccataagtgtccgcactacggcgcacccctggtgaaaggtgagctgtcaggtgggaggcgtgagggggaccttccaggccccatgccagcttggctcctccccagaccccaggatcttcatctattagtgaagtctcctgggctgtggggaggggcccgcagttgccggggcactgagatccttgggaagcaacccctgctggtgggcgcagcctaacacctccccttcccaggcgttctgtcccgtggtcgggtgcgctgcccctggcacggcgcctgcttcaacatcagcactggggacctggaggacttccctggcctggacagtctacacaagttccaggtggggccaggagtgcgatggggtgggaacctgggggtgtggggttcggggctggtcctgagcaatgcagcccttgcaggtgaagattgagaaggagaaggtgtacgtccgggccagcaagcaggtgaggggatagctcggggctcaggcagaagggaggagccgggagggcatcttggcccagagaatgccatgtgcaaagccctgtggtgggaggagcttggcacgtgtcactggagcagagtgaggggttgcggtagggatgaggctgggctggagcgccaggacctgcctgccaggatgatggcatgcagaggatggcagtgaccctccaccctcctggcacccacaggccctacagctgcagcgaaggaccaaggtgatggccaagtgtatctctccaagtgctgggtacagcagtagcaccaatgtgctcattgtgggtgcaggttggtagtggggtcatgaggggcagggtgggagatgggattggtgagaagtggttcctggcccacgggcccctcccctcaggtgcagctggcctggtgtgtgcagagacactgcggcaggagggcttctccgaccggatcgtcctgtgcacgctagaccggcaccttccctacgaccgtcccaagctcagcaaggtacagggggtggggcaagtagggaccctatccctctgggtcccagttaagcccacttcaagccttgcttgtcaccccattggggtctggccggctgccctccctgcttatgccaggcctgtccgtggtacccccaaaagatctagatttgttgttgttgttttgagacagggtctcactctgtcgcccaggctgggatgcagtggcgccttctcggctcactgcaacttccacctcctgggttcaagcgattctcatgcttcagccttccgagtagctgggattacaggtgtgcaccaccaccatgcctggctaattttttgtatttttagtagagatggggtttcaccatgttgcccagaccagtcttgaactcctgagctcagcccatccgcccacctcagcctcccaaggtgctaggattacaggtgtgagccactgcacctggcttttctttttttgagacagagtcttgctctgtcactcaggctggagagcagtgcctgtctcacggctcactgcagcgtcgacctccacctcccgggctcaaacgatcctcccacctctgcctcccgggtagctaggactacaggcgcgcaccaccatgcctggctaatattttgtattttttgtagaaatgaggtcatttttgtcatgctgcccaggctggtcttgaactcctggttcaagcgatcctcctgtctcagcctcccaaagtgttgggatcacaggcatgagtcactgcgcctggccagatctgggtttgctgagttctgtcctgcagcccctatgtgactggggctggccccaccttccctgggccccagtgtcttctgctgtaaactggctcctctcaagctggctctcccctgcagtccctggacacacagcctgagcagctggccctgaggcccaaggagtttttccgagcctatggcatcgaggtgctcaccgaggctcaggtacagggtcaagggtgggaaacaggcccgaggagggaaggtgggaaccgtgaggttgtgtgggcccctggggtggggtcttggtgctctaccttcctggccccacagcccaggcacctgggaggtgctccaggcttgggagacagcaaggagctttttcctgatgggtcataggcacacacagagccccacggtgtgtggagatgaacgatcagggctggataggagatactggtgggacttgggagggtaaggagaggtttgaggggaaggtgatgtctgaagcgtaaagaatgaagcccaggtggcaggatctgttttaatgggagcttctcagaggctgtggctgggctgtgggtgtactgcaggaccggggagtgggcggcgaggcccagccccatgcccaagctcatgctctgcctggtggggattgcaggtggtcacagtggacgtgagaactaagaaggtcgtgttcaaggatggcttcaagctggagtacagcaagctgctgctggcaccagggagcaggtgggagggtctcctttttacccatcggacactaggcagggcactggcctggacggggctggggctgccaggaggccctcactgacacggccatgtctcagccccaagactctgagctgcaaaggcaaagaagtggagaacgtgttcactatccggacgccagaggatgccaatcgcgtggtgaggctggcccgaggccgcaacgtggtcgtcgtgggagccggcttcctgggtgagaggtagtgggcagtggagatggtggtcaggtcgtcatggccagtcccagggaagttctggtcgaggaaggtgcaggtgccagcctgccaccccctgcccatcaccagggatggaggtggccgcttacctgacggagaaggcccactctgtgtctgtggtggagctggaggagacgcccttcaggaggttcctgggggagcgcgtgggtcgagccctcatgaaggtgagcccaccccagcacccagtgccttggagccctggggcccagcccggcccctggctgggctctcatccaccgcccacctgcccacttgccctgacagatgtttgagaacaaccgggtgaagttctacatgcagacggaggtgtctgagctgcggggccaggagggaaaggtgggcccttctcccttctccctgctgctttctgtcctctgtcccctgagcctgggagctgggtccacctgtttatccacccactccccacagctgaaggaggttgtgctgaagagcagcaaggtcgtgcgggctgacgtctgcgtggtgggcattggtgagttggtgtgtgggcaggcaggcacaaagcagcccagccgtctgcacatgctcacatgtgaccttgggctagtcccttcccctcccagagcctcagtttccaccacatctgtcaaatgggaacccccaaccgcccccactttacggagctgttggggaaggtatgtactgggctcagcccaggcctggcacagtggatgctcccagtgcccgctgcccagtaacactcatctccatgccctgcgagagttgacatagacgagactcgaactggcttctgctccagctgaagtgccaatttgggtaggggccaagatgggaggtggtagcacctgcaggggctgaggaggtatggcatgctgtccctccacttaagggcctcatggagcacttcttggagaaggtgatatctgaggtcttgcgggaggcaccgggtctgtgggagaccgggtagtggggaccagggtgcatgaaggcctcaggtagacagcccctggaggatcagtctggggctggcacatcaagcgcatgctgtagggtgtggagagtgactacgcagaaggcagggacaggggagtggacacaggcttccgtcctgtcaggtgcagtgcccgccacaggcttcctgaggcaaagcggcatcggtttggattcccgaggcttcatccctgtcaacaaggtggggtggatggcactgggtggggaggacccggtgctgggctgggagtggcaggaggttcaggtcagggcccctgtcacacccatggagctctgggccctctctctacagatgatgcagaccaatgtcccaggcgtgtttgcagctggcgatgctgtcaccttcccccttgcctggaggaacaaccgcaaagtgaacattccacattggcagatggctcatgctcagggtatggccagtcccgaggcacatggaggggtgggagggagtctcagggtctcagtgtccccatgcccatgcctcagttgctgaccttgggtcctggacactgttaggcatcaaagctctgatgtggattctctggccagcctcatctcggcgatccagccaacacagagagcgacaccccactgagccagccatagctcctcaatctcagttttccttctggtagtctctcccttttttgtcttcaaggacatatattctgcagaattcctgatcaacctgtgcattaccctggggagggagggagggatttagtggatcaccttcccatttatgcctctgtttcccttgggccactcaagtatctctgtgaactcagttcagcctcatgcaggtccccgaggtgccatctgagcccagagacgtgggctcagtggaggcactgtgctttctgaggaatagctttcccctcctgatgtttgctggccaccaagtcccccaagcctcatccactgtgcacatctggtctgggcccctaagctgcaggtgccatcacattagttgcctcactgcctcagagagaggactgccagactcccagcctgggacaaaggacttctctgcacccatctcccctttcctctgcctttacacctgagggtctgctgcttgaaaccccacttctggtaccaatttctattcaagtccaaagtcgaaagttgttgctaggttgtaagtaaccaaggcaacttatcagccaagtataattaggatttaactgagagagtttaggggactttgaagtacatccaactacaggggtctactggggcctcataggaactggggagccatccacactggtctctttggggccttgtgtgtggctgtcatctgtgcttccctgtgtacttgtgccccattttcctccctcttcagacctgatacgtctgattaggtgtctgtgtgcacagctgaaatggtggcgtactcccccaaccccaagaagcagaccttccagagtcagggcactttattcagattctttaaggaagcaatcaagtggctagctttgaggcaggtgttcccctgcaccagtcagctgcaggtgcaagtgagcagtgggctgaacaatgatgtctcttgacctctggggagaccaggaggagtagccacacgtgtcaggggtccccagggcatcaggagcaggtagtgtgggagtggtaagagcgagagttagggttctcacggccctgggtcccgcagggcgcgtggcagcccagaacatgttggcgcaggaggcggagatgagcactgtgccctacctctggaccgccatgtttggcaagagcctgcgctacgcgggtaaccccggggcctcggatgggggcggggccgagggcgtttaggggcggggcttgggtgtggggcggggctgggagcctaggggcagggctatgaccgcactaggaagaggccggtaagaactcgctggcggcaaggctacgaactacctaaaaggacgtatggagcagggcctgggcggggttaggaggggatcctgtgacgtctcgttccctcccccggctcacgtgggtgccacccacctgcccggcccacaggctacggagaaggcttcgacgacgtcatcatccagggggatctggaggagctgaagtttgtggctttttacactaagtgagagcaccggggtgcagcttggcgcgaagcagcgggagctcagtcgggaagggggattcatcccaggcaaaatcccagaacaagagcccagccctgagccccgctgaggagtgctggagcttccttaggaaagcccgaagcttgtgcacggtcaagccgcgatgtgcaaagcagggagggctgggtgctcaggccattcttgttgccctggggtaggtccttccctgggccccagatggacagcagtgcatcagggttttcaaaaaggggctgctgcctcgcagtcctcaggcttggccatcctctccttgcagaggcgacgaggtgatcgccgtggccagcatgaactacgatcccattgtgtccaaggtcgctgaggtgctggcctcaggccgtgccatccggaagcgggaggtggagtgagtgtgggtgtgggaagcctgggggtgggagtagttccctggagtactggctaaggtgcctatgacagccagccgcccccacaaccctccagggcctttcccctcttggtttgcatcgcctgaggcttacaggactacagggaggtgtggggcaaggatcatggtttgagagcaggctggttatgtgttcatggtggatggaagggatagagatgtgtgtcaccaggcagggccagtgctgtgggaaggggtcagggcccaatgcatgggcaatcaccaggcgtgggacacctaactggacatagttgtgctgagcctggcagaagctaggtgggaaatgcagctactgatgccctgggtatgccctccacatagatggtgggggtggttctaggtttcactcaacaccagccagttcccttatcctggtgtggtgtcaatgagattcaccctctgggagagagctcccagggactggggacagcctggaggccactgggaggctatgagacaggggcaggcttcaggctggaaacaatggaggaccagaaggggacatgataaatgacatgctctctccttggccttctctccgtttctctctcttgccttcgtgaaggctgtttgtgctgcacagcaagtacgtgtgtccttcatgttgaccgttctgagcctttcccatgtcagcccagaccctccacccaatggtcttatctccctctgtccaagtacacctccctgctgggcactagggtctggcacagaacagaccccctgctgtcctcaagggccagctgttcagggtgcccagagtggagagcctgttttcttctgtcttgacccctcctcccctcactcctgcaggactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcagatctgtatgactcccagtgtaattgggccaataggcacaggaccagaccacagggaaacaggcacaatcacagaatgccaggtgccacaccaaggaaatttggcctgtgaacgcccagaggaggtagcaactaattctgcgccccaagccctcccacatccctctccccctctgcgatcagcgaacgctttttgcttttggctctgagttttgaaggaagggtattccaggtagaagggacaacatgcccaaaggtcttgagatagtaaatgctccttcagaggtggctcatgcttgacactttggggcatttgcccacttagggctgtgggagctgtgtcctgagacagaccccatgcttttcatagccggagcattctcaatccccatgtcggaggtgaaggagctgaggccctgctaagtaggaatgagaatccagaggctcctcgccgggctgcctctcagtcagtaagaaagccaaggggagaggggagttgctgggggtcagggctgagggcgctagcaggaaagggagcgttgagccgcctgcagaggccgctgcgagcccggaaccctccatgggggatcccggcagcggcagacgatccaggccggagccacgcgcagacccagggcatgccgggaactgcgagccggccgcgggtcttcgggctgcgtgggcctgggaggcgccgggaagagcagtcgcgacggggctagggacgacacactgcattcactggaagggacaacgcagcgccagtacatagcctgaaacgctccccagaaggtcccacgctcgccgcgcggtcgacaaccgcatcctgcgctcgcccgcggtgtctcggcaagcggtaggcttgtcgggaagagctggagggcgcaagtgcggcgctggccggacgtgccgcaccgtcagcgcagggctcgccgggaaatgtggtttctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggtacggtgggcttcatggggtcctgaggacaggaagggcgatctgcgagggtcccagggcgggtccaggggcgaagccggggggtggtgtcctggggtaggatctggtaatgaggtggatggtgctgtacaggacgctgttcagggcaggggagagggttccgagggagtcccagagcccgatgtcccgggacagggtactggaactaagttgtgtttgtggatattgggctggggtcccaggtgctctgaggtggggtgaggagtccagagagtcctggagccgtgtcaggggtcctcacttgcaggatgattggtgttatcttagaagatgatggatcttagcagttgagaggtgatacctaacttccgtggcagctctcctgcttagtcccattccttgggtgccccccaggagggtcctgtccttaccgccctccactcctttctttccaggcgcagcaagcacacagtggtggcctataaagatgccatttatgtatttggtggagacaatgggtgagtgagtctcagcatcagtgtttggaccaggtacggagaagtactgtggtcagggactgggcctgtccagctccattactgtcctttcagatgctagctggtgcctctaagcttcagtttccccatctgtgagattccttgcactcacctccctggtcgtggtgaggattaaatgagatcctgcactcatggtcctcagcacagcttccagtgggtggcacatgctcagtatgtggaaatgtccctcttctgagtagatgcagccttgaaagaaacacaaccacccttgcggccagccctgccaggcacttttctttccctgtgcctcatcggtatggaggacacagttttatttatttcatgcatttttcactttttgtgggggttttcccaaattgctccaaacatcaggcaacaacgtgatgttttgttggtgggcacacctcctttcacataaactgtctccacttaagttgtggctggtttccttatgcagagggtggagtatttgcacatgactagttgtgtccatgtgtcctagccctgcctctcagccccaggaactagcatgaagccctggaaggtctggcctcttactggctctgcagccttggtcctgtaggcctccttggggggcgggcttgaggatggtggggtagtctggaccccaccaggatctgcatactgggcagaagagcctccttgggcatggtcccctggcttcaagcctgtcttcctcccactctctttccccaggagtagccggtggggcccatttacaaaagcaagtcagagtatgctcctccttggctcatcctcctgtaatgcctccctgcctctctgagtaaaagcccaagtcctcatgagagtctgctgctcctctgccctcagtccctcactgcactggggcggcacgggctgccttgctatgtttggattgtaccaagtgcccccctgctcaggcccttgcactgcccattctctcctctcaccttcctgcccctcctctgatgtttcttgtgactgaggccttacttggccatctggaccaactggagaccattgcttcccctccatacctcttaccatcttcatttgttcctgaggcacacagatgttggttattatccatctcttcagtcaaggcagggcctgtgctccttttaccattgtatcctggcatctagaaaactccataaatgtttgtcaaatgaaggaatgaaatgaagaagagatgcctacccacaagcatttactgcagccttaatgagaaccctccaaaccagaaagggctttagtgtccagtacaaggcagcaagtgggaaatgggggaccttcatcctcaagagtgtccttagcaggtagtttgtgtgacaactgtgtagcaataagcagaaacatttttgctgcagtatgacaaagaaataggatacaaatttgtctcacactagtcttaactttataaagactgcctgagtacaaagaaagatggcctcctgcggcacgtggggcaagtaaggagggggggggggcggtatcacaatcaccaccagcttctaggctcctggcttcctggctgcatggcctcagacacagcctttgagccactaggctttgttgccatctgtgaaatggaggtgagagagcacccactggtgcagactaagtgagaccgttcagggggcacccagcacaggctgggcatgacggggcactgggctcctgtcagtttgcccttcttcccaagggctgggtagtgatatgccagctggtagtgttaggtggtgcaatggccagtgaatttgttttctatttgattgtatggcttttgcaacaaagaaatggcaggggccaggtgcagtggctcacacctgtaatcccagcactttgggaggctgaggtgggaagatcacttgaggccaggcattcaagacgagcctgggcaggaaagcaagacttcgtttctatttttttttttttttttttgagatggagtcttgctctgtcacccaggctggtgttcagtggcgccatcttggctcactgcaacctctgcctcccgggttcaagcgattctgccgcagcctcccgagtagctgggattacaggcgcctgccaccatgccaggctaatttttttgtatttttagtagagatggggtttcaccatgttggccaggctggtctcaatctcctgacctcaagtgatccgcccgcctaggcttcccaaagtgctgggattacaggcgtgagccaccgagcccagcccattgtctctatttcttttttttaagaagtggcaggaagatcagagagaagcaaagggcctctcctgaggcacgggcaagcacttgcattgcagggtacagctgcagaggaaggggattgggacgtgtgaataggggttctggaggctagggtgaggtgtgagggtgactctggcctttgggccatttcatgccttcatgtcagctgctggttgggctcctggtggccacattcatgctttggtcctgaccccaggcaggctggtgtctgcctgtgtggcagccctggtgcccatatcagttggggagcctcctttgtggtcaccactcttgttcttgggcatcagctggttgcctggctgtgttagtgacccagcccacaacagccccctactctaccctggctacatgcagtgcccatctctggggtcactgcagagtagacctggctaatgccaccctctcttccggctgcctttcaggaagaccatgctcaatgacctcctgcggttcgatgtgaaagactgctcctggtgcaggtgggtggccccgtgctccagggccctgcctttcctcctagaacacagtggcacagtgctgggtcccagttgctagcagagtctctctcatcatgggaagctagaaagaagcttccaggaggagataaccacggcctcagggatgccacatccagagccgccctgtcaggctgaggagatcaagtaaccaccccgcacctgcagctgccaagctgggcacacagggcggcacccttctgggctgtccacctctacctcgaggctgatgctagtatgggtacagaagttgctatgtcttttctctcacacttgattttgtaagatggctagtagttacaaattaatttaaaaaatcattctgaaggcttcacaattatttgtcaaaaattgcttaagtataaaactcagaaaaaagctaggagttcaagaccagctgggcaacaaagtgagaccctgtctaggaagatagatagacagatgatagatagatagatagatagatagatagatagatagatagaaagaaagatagatagatgatagaaagacaaagagagatgatagatagatgataggtagattagacagatagatgacagatagatagatagtggatagatgatagatgacagatcgatagatagatgataggtagatgataggtaggtagattagatagatgatgggtagatagatgacagacaatagatgatagatgataggtagatagatgatagatgacagatagatgatggatagattatataggtagatgataggtggatagatgatggatatatagattatatagattagatgattgatagatgataggtagatagatagatgatggttagatagataggtattaaatgaaattgatggaccccgtgctgtaagatgctgcactgctgctgagagcaggagtgtggatggtcctggagtagcatgaggacctggtcacattctgtgagtggaataagcaatttacaaaatatctgccacttgattccattttaaaaaatttcatggaagcctaagtatgcgtaggagaggtgtgcagggaagacctcaaggtgttgccagaggttttctggtaatgggaatttgcatgagctttagtgcctattttgttttttccttattggtgattttttttttttaagtttctatgatgagacaggtatcaccttcaaaatacaaaagtgaaacgtagctgggcgcggtggctcacgcctgtaatcccagcactttgggaggctgaggtgggcggatcacctgaggtcagaacttcaagaccagcctggccaacatggtgaaaccccgtctctacaaaaatacaaaaaattagctgggcatgatggtgggtgcctgtaatcccagctactcaggaggctgaggcaggacaatcgcttgaacccaggaggtggaggttgagccgggatcgtgccactgcactccagccgggacgacagagagagactccgtctcaaaaaaaaaaaaaaagaaaaaagaaaggcagcacagggatgcagggccaccctgtgggggtgtggacctcatgggtgacccccgctgactctcaccacccctgtgcccaccccagggcctttaccactgggaccccaccggccccccgttaccaccactcggccgtcgtctatgggagcagcatgtttgtctttggtaagcagcctcttgcctcccaggggctgtgtcgccccgaggcccacagacaccctgcccttctgcaggcctggggcatttgtgctcgtgctgtgtacagcaggggctctctctccacccgtggctttgtctgccagtcttcggaattctgcgctggatctgggaccccttgccctaacggccctgagctcacagggttgggtgtctttctgtgttactgagctgtggctgggaacagtgtcctgctcatctctgtgtccccagagcccagcacagaggcagacaggcagcaggtcgttccggggcttgtggaaggagtcctggcttatgcattttcaggggggccagattctgctccaccttccagggtttgaaatctccaagactgccctttgggtttgacagtttctcactctctttactcagggggttacactggggacatttattccaattctaacttgaagaataaaaacgacctctttgaatacaagtttgcaactggccagtggacggagtggaaaattgaaggacggtgagaaactttgcagaaacatttgggacaggctgggtcctgggtggcattggacctgggatctgcccccttttgcctcccagatgaggaccctgagggcacgcaatagcagggagcttgggattggtggaatatcccccggtgcagctatgcatggcctgctcccagcccttagactccctcctttcagaagagacccaaatggaccaggcgtggtggcgcatgcctgtagtcctagtactttgggaagccgaggtgggaagatcacttgagcccatgacttcaaggctgcagtgaaccatgtgtgccccactgcactccagcctgggagacagaacaagaccttgtcacaaaaaaatgttcaataagatccaatgtactgctgatggcgcttctggggtcccgctttttgagcaccccctttgatattttgggggcacctaggagaaggttctgtgcctctgtggctgtctgaattcctcttcaagccactagtcggcctctggggctgttgtttattcctagtgccttgtggaggtcctgaagccccagtgtcgggtggatgtagccatgcagcctggctgtggcccctgcactgaccacatggggctgggtggctcaggtctgtgctgggcggcctcactccctcccctcttccctcacactccaggttgccagtcgctaggtcagcccatggggccacggtgtacagtgacaagctgtggatctttgctggctatgacggcaacgccaggtgggtggtggtccggcctgtgcaccccacctccgacagcactgagacccggagcaggccgtcctggcatttgagggcttaggctgggaggattttgagtgcctggtggattttgagtgccactctgtctgggggtttcttgggagggggatggggaaagaggaggatggacagatggaggtgagggccactgggtggagccccgtggctaccagagtagcttggatgaggatcctcagccaggagttgccctgcggagctgagttggtgggcgggtgggcggtgcccaggctcaggcccagccctggttcttgcccaggccaaaggccttttcctccttattttagaaagttggctttgctctctttttctgatcacaaaagtagcatatgctggtttcccaaaacttcagcatcatagaaactcctaacgatgcagtgatggtggcatctgggatatctgtgtcctctccccacccaggagggacactgagtgaggagctggcactgccacactgccctgatgtcatgcatgagagtacttgttctgtctgggccgggcagggggcctggcacagcagggatttgaggcagtggctgccaccccacacagaagttcccgcctcatggccgcacaagtctcctaccctgtgtgggggtggggctcctccctgcagccatcccttccagccaggactaggcccaccctgaccaccagacccaaggggtcctcactggtctgtcctaatacaggttgaatgacatgtggacaattggcctccaggaccgagagctcacctgctgggaggaggtgaggggcgtggggagccagggcgcaggtagaggaggtgaggggcacggggagccagggcgcaggtggaggaggtgaggggcatggggagacagggtgcaggtggagggaggtgggaggcagggggagccaggctgggggtcgaggctgctttcttccccttgcaaagcccagcctcgacctgagcctcgctctcctccctggtgacctgcgggccttcacgaccagttcctcactgtggctgcacagtgattcgaggtttggtgctttggatgggcagagtgccacgtgtgtgaggatgtggttttgctttaacgcaccctttatttcagtgcagtgagggccgtctgctatccagtgtcctgctccctggagctccccctgggcttgctttcccctttagaaacatggaatttatttatttattcattaaaaaaaattgtttttcagtcttctgggcatgaaaaacatgagtttagcccctgatgatttaaccctgacgattttaaccccagctgttcacaactgggccccgtgaagtggatgagacagggctatgagctgttccaagacaaaggaatctgtgaatcctcatctggggaagtttcaagaataaaagcagtcccatctcagcagtctcgagtgtggtgaaatgtgagcgggccctgtgaggccggggctgagctgtcctctccccctgcaggtggcccagagtggcgagatccccccatcttgctgcaacttccccgtggctgtgtgccgggacaagatgtttgtattctctgggcaaagcggagccaaaataaccaacaacctcttccagtttgaattcaaggacaagacgtgagtactctggccagtggggtggagggaggacggtcagttccctcgaatccttctgaatatgaagaacgcctcttgcacctggtggccatggtaaccatccttgtgagctctgcaaacagcaggaggttacagcccggagcagggatgtgcggtgcccctggcaggtccccaggatatggctacagcttagcaagataaggcctggcgaggaggcccctggctaggcctccctctgaacgtgaaggacgtccccttcctcgtgaatagcttggtcagtgccaccagtaacagacgtggcctgcatagatctcaaataatggcagaagaccagaggggcctgcaggtcctgagaggtctggcccatgctgcccctggctgctggccagcccttgatccctgcaatggggctgcaggagagggcacaaggagtgtgagctgcaggtacagggggtttgggaagggacttgggagcttccctggaggccacgggtgcgtgggaggaagggcagggagccccaggatgagggaaattgtcaagggcctggggctcagcatggagccagatggcatagccctgccaggccaggatctgttctgaagtcttcagctaacttagcaaaagagaggacttgctgggaggtactgggaagcctgggaggtggaaggtgctggggcagcatcaggatgtggggtacaggcagctcccaggatggggactcagctgtggggatgctctgactgggcagcgtgaacacagtgacctgcaatggtctctgcacaactttactccccagagagcaggactgcctgggcgggtcagatgccaccctcctgcccatcactgctgcctgctccatggggagaggggggagctctggcaggaccctgcggtgggccacatggagccaggcagggctggtgcccgtgctggatggggtgagaggtgctcagcgcaggtgtctaggccctccctctggaccctgggctagtcaccgtaagggatgcagggggacctcccagtgaaggcctgctgtggggaggccccgagggtgagcaggagcccctgtcccagcattgattcactgttgtgtacccccaggtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggtgagggtgcccaggggtgtcctgacctgccagctggacaccagtagctcctaccctgctcccacccagctcctcacagctttggggccccctggggttccagacagctaccaggagcaaggccaggacacctgggcctcagccctggacacctgccccggcctccagccccagcttcaccccacagcctgcaggtagttaacgcttcacaccccatcatggctgcatggggctgctgtgctgcagacctttcctgggaagcccacggccatgcagctcttccttctttcagaacccactctcaaggccaggatggtgggggtctctgggcacctacctggcccttgccaactggtctcatgcccatgtgtctcccctcttcaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggaggtacaggctgggatcctcattaagactccatcaccccctgaaacaggtcctgtgatcaacacctctcacacatggggagactgaggccccgagaaatacttgcttggggtcacaccacaaagggggtacagggccaagggccctcaccctgctggccaggctgcagctttctggggtgggtgccacacactggcccaagtgccctgaccactctgagggtctccatggcccgtcatgccccactcgcctacatgggtaccaggtcccacctgtgtctgtacccaggggccctcatcccttggggaccctgccccctggcccttcatggccatgaggtgccgcatccttgccttacctggctgcaccagccgcactgtggaggctctgctcccccaccattccaccctgccttcttgtcccccagctgcccagtgggaggctcttccacgcggctgctgtcatctcggacgccatgtacatcttcgggggcacggtggacaacaacatccgcagcggggagatgtacaggttccaggtgtggggcctgtgggcctgtagagccggctgggtggacggatcccccgtgatgagaaactgaggccaagttggggggcagggcttatccaggccattgccagggccacacctggcaggatggaagccttgggaggagccctgtgggctgagggtgggctgaggtggcactaaagtgggcagccttcgtgcagtggggcaggcagatggtgctggggctcacggcagagtcagtggagggagccgggccaagctgggctcagcaccagagcctcacaggcatcatagcctggcccagggcagagccagggccgacagtggcttgcgttgacagccccttcccaggcctggaggagcaggtggtcagggcagggactcacagccacagtgaggtcagggccagcttcctggaggaggttgggatgtgctggtgggggccagtgtgaggacgcaggtccaggcagagtggagacggcagagctctgctgaggcctggggcccagccgaaggcaagagaggcaggggagccctttcctgctgtggagccggccgtggacagttgcaggtgctgaggctggagccaggctgtattttcagggtggggtagcggctgcttcctctcctcagccaggcccacctgcctcctgggccctgagggtcagcatgggccaggtggggacctcagggtcggcctgcacagccacactggggccaccctgctgtctgcaacatctagtctcactgggcccctcttgcagttctcctgttaccctaaatgcacgctgcacgaggactacgggcggctgtgggagagccgccagttctgcgacgtggagttcgtgctgggtgaggtgggtgcctgtcctcgcaccctgctctgcctgctgtgcctgggcagtgggaatttcgcccctcagaaaaacagctgctggcctggtggtgctgaccttggctggctgggtctctgttctctggggcgagggtcctgtgccctctgccagtgcatcattctttgtgcagaaggaggagtgcgtgcagggccacgtagccattgtcacagcgcggagccgctggcttcgcaggaagatcacgcaggcgcgggagaggctggcccaggtgaggtgcctaaccgccctgccctgacctggcagccatgcctggtgtccactggggtgtccttgagctcccttctccccacagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggtccgcctgggtgggggtggagcagggttggtgtgggctggggtgcgggcagcagagccaaaaggtgggtgctgccagccctgccttactgatgggccccctgaggctcagaggctgcaggtcaccctccttacccatgatcactgcagctggacgccatctgagtcccccgaggccttgttcctacctagtggccccagcccacactcttccatggggggagccctgcgccctgtgccctgccctcccctctccggctccctgagattcgggggctctggggcgcaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggtgtggggtggggtcagcgcaatcagggttgggtggggtgtgctcaggcttaggccccctccctgcccaccactgtgagcccctcgcccagcctggggccctggcttgactctgcctgcctgcctgtgcctgtctgccccaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggtagggagccccgttccccttccctgggggctgggagggatggtgttcatctgcggtaggagattgggagccatggagagcacctgccaggccctcggggtgggggtgggtgccatgggaccccagagtgctctcctgggtacagggaggaaacagatgaaggcagaagcccccgacccatggggcttgccacagtgggctgtgtcctggtgacctgggatttcctgagccaatttctgggggtggacatggggcacctctttcgggctaggatgtcaggtctgatggcccagggtcacggtgatcagtctctggacttctctttgcttgtaatgtcacaggccccttcattcccccagctctccctggggcttgtgctgaccccggttgctggctcttggtgatgtctgcaggcaccagaggccatgcagtgggcctggagggggcttgatcatgaggtcagcgagggggtacagcaagctgggtggaagatgagacgctgggtggtgggctgtgcgtggggcatagtgcttgagtcggccagggcgccgagggaggacagaatgtggctgatggtacctcagggcgagtgaggccttctgcctgggtgaagttttgttcagggcagcaacatgggcagatatgcaggaaggtagtgccgtggggccccaaggccagaatcccaggctgtacctgctcagggaccctcctacccccaggcacatctctgatccaggacatgaaggcatacctggagggagcgggcgcggaattctgtgacatcactctgttgcttgacgggcacccacggccagcccacaaggctatcctggccgcccgctccaggtgggtgggggctggacaggaggggagggtgggcctggatggtgtcttcgttctgctgacggccaggtgcctaccgctcgttgtctgcagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctgcatcctcactccccagtgaactcccaggtccccaccaaggggtcctggcacccacctcaggtggctttgaggcccgctctcctgccccagctaggtgatctgggcccagcgcctccctccagagggtttgctggtgcctggggctgggcctggtgctctctgaagcagttggcagctggcaaggaggggtttgcagccaggaggaaccagtgggttcctgaccctcacaactgcccagaggacggggtgggtcattgctttgtgtgacagttgagcacagacatggaggtactccttatgtcacttcagtaggggtctgaacatggagggtcaggatgcctgttaggcctgcaaggccatggaacagcgctacagatgtacagacactatttttctcgggaggggattcatggttttctttggatcctgaatggggcctttgacccactaagtagttcagaatccatttggagagcatgctggcgtgggggcttggggctccagctgcgcccttccctgtccttccctgggagggtgcgggcggaccagcttcctttagtcagctccttaaccaggccccagctacttgtttgcggccccctactactacggcttctacaacaaccggctgcaggcgtactgcaagcagaacctggagatgaacgtgacggtgcagaacgtgctgcaggtagccccccagccccgtgcacatggctgcagctcccactgagtgggtgaaaggggcagcgcctcaaggtccctgccattgcagatcctggaggcagctgacaaaacgcaggcactggacatgaagcggcactgcctgcacatcattgtgcaccagttcaccaaggtcagggctctggcctccccttcaggactcgcttccccttggcagtggccatgcccaggcagggagggtgcccaggctctgtggtcccctgcagtggtgggccctgggggtgagagaagcagagcagcccatcactggccgcaccttgcttcatccttgggaccagcctgagccctgagcagggtaggccccacagggctccactgcccaccatggcccttaggtggatctggtcccatctccttccggcctgcttgccttacaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatgctgtcaactcctgcctccacctggggtcacccagtcacattgggaagggctgtgaaggcctccaggctggccccttccaggggaatcctggaggcctggggtgggctcctgccccttctgccctgccttgcccctgcactatgctcttggctcctgtggaaggagggctgccctcttgccctagtgagggccccatgtggatccactctagtgctgggagccagcgctcccttactgggaacaggattccaggacccctttcttgttgtggctgccatgaagccacagctccttggggaagtgacctgctctcctttgggtgtatgcaggtgtgtggggggccctgagtggcaagttgcttagctaacaggagatccataggcagcctgcaggctaggaagtggcctagtgcaagatgagctgggaacaagggaggagagagcaggagctggggcagaggctgagccgggaggcccttgaggtgaggacacagcaggcccaggaccatggctggggaggatatgtcagcacctggaagtggagtgcaggctgcagcgcccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctagacttatatgaataaatgaaattacatgccaagggccctaaaaagcaaattttacgaaattgtgtggcagtttctgggactagaatgaatttcatttgtgctcctcggcagggagaggccatacttgcagtgagtcaccccaagacggagctgtttgagaactgcagctgcagcaaggccttccaggttcctgggagttgaaggaaaaggatgctgaggccaggacctgagtgcttgtctccatgttctggccacctcttcctagatttccagggactagcttgttggggctttactacctgctgacatgacccaggaggttgatgattgtcatcatcatccccgtttttcaaatagagatggtagtgaagggggcggggagagggttgtccagcttacccaccaggctgatggggcctgtggacagaagcctgtcatgctcctgcttgagaaccggatctagactgggttttagaagtgttctcaaaggggctggctggtttaagtcagggctgtttcagatcctatggaaagggcgcctggagctgtcttcctggcccctactcacaccatcctgccccttcagagaaccctgtggggcacggagctgcgctagcagggctgactgccacctgtctaccagtagctctgaggggtgagagccaggctccctgttctccttggcaaagagcttggactgagccctctaggagctgcagccactgtctggggcagcaagcttagtactcagaggggctccagcccccagctgagccagacagcaggccctccgtctagaatccgctttattatggcacctggtgggtctggtgggatctgagggaggaagaggctgcagtcttgctgggcagcccctcggtcagtccagcagcccctcaggccatgctgctgctcagctgcatggcaaagtcctgcacatgctccttcagagtctggcgggcatctgcctgtgcccgcttctcccgtgcccgctcctgctgcagcttggtcagtctcaaccgcagccgctgctcccgccgcttgcaggcctgcagctggcgctgggccttgtcaagggcatcaagggctgcctcggctcgccgcttccagagtaaggcgctgcccacctggtagctgtgttcattctggatgtaggctccggcgggtgggggcaggcgcagcatatacgctgagggggagactggccgtggttcgagaggggagggctgccgctctggtgaaggctgggcgctgcagcctgcttcatctgcctgggcacccaaggggcccagtaggtctgaaaaggggctgctaaggccaggctccagcctcccagctggggaggccggcaaagtggcaggtgctgaggcctcttccacaggaaagcaggtgacatcagcaggtggaggtggagaaaatggagttgtgggccctcggccctcggagcagctggtaagggggaagagagagactgatgggctaggctgagggcttgccagacccccctccaccagcccacctgatccacccttaacacccaaacccgatccacaggttctgtgtagcaagaaccctgtccagcgagactgctggcagacacccctagggcccagtccctcagcctaggggtgggagtggggcatcccccacccatatcacataccgcttcctgcatcgtctgagccggctgacttcagcggggccaggtgggtaactgtgtcctttggtcttggttgtccggcgcaacttggagaaagactcaaatatggtggggactgccccctcctttagcctgtgatatccactgcggggaaaagcaacccagatgagctggagagcaagtgctgcctccccaggccaatctgcccccagcagcagcgccgtgggatgctggaaggcatcgtgcaaacaatacgtctggggaacgccaagttacagctacaccaatcgcttccccgcaggactcctcacagtccaggtgtgtggaaagcctgcataagccgagctgggctgaccagccagaaagaattctttgatttgtggacttgctggcaagactggggctctgaaagatactctctggaaaggctcctgttttccccttgtgtcacaggcacagtgatcctgggggtgggtttcactgtgcagagctgggaacaggaaacagcccccttggacgcaggctgctcaagggacttccatgacctgcagctgtcccagtccgccgggagccccacatcctaccccagcgtcggccggcagggaggcccacctgattcccaccagctcaaagcagtcctcctcaaagtgtttggagcagaagtagatgtactcggatgccgggtcccacaggccctggccgctggggtccagccgctggcagttggccagccacaagcctcgcctcgggttgtccttcttgggaagtctgtggagccacaaacccgtgagcaccaggctgtccacagccctgggctcatgctgcccaagcaccccagaggggaaacgcagacccaacacgcgccgccacgagacctccctgcgaccccgccgggtaagcaccaccgcccgggcacagacgaggcaacggaggcctcgagaagaaaagcagtttcctcagcgtcatctggcaggtaacagagtggggcgggtccaagccggctagacttcccgtcctccccttcccgactgcattcagtcccgccgggaccgttccgcttcacctcccacccacaggttcaagcctcctcagtatctgagaaaggcgcgaagcctctacgcagttgcgacccgaggcgagcaacaactagcgcatgcgcacgtgagcccgcggcgcacgcgcgctgacctgtggaaggagatgccgcggttgcgcgtctcgcgcgtgtcccgtgtgcagcagccggcggcggagcagtgacgcggcatctgggaaagaggcgggagttaagtcgcaagcggctctccgggcatccggaggagcctcgcgcctccagccgccgctcctccccaaggggctctggcctgtcgggtcccccccggcccgttgtcgccccaaccccgtcccagccgattctcttgacttctgtcagcggcactcacgctctggccattgctgcgccgccgaagtctcgcgaggggtagcgcgcgccggaagttggtaccatagagactggagagccggaggtgcccccgccaccggggcggggcggggcgaggtcctagctagctgggttagtaagcggcgcgagcgtgcgagtttctgacgcgcccgcgtcgtcccagctccctggactaccagtattgtcgcccacgtgggcttctctttcgtccgctcaggcctcacttttctccgtaaacaccccggcacgatggagcggccccagcgttcgggagcggcccgggagcggaaagcggcagtgtcctgggagcctcgaaagccgcaggggcggcagctcgcctcggaatgacctctgacggaagaaataaaacggggcctgggacgcttgcacgaaagaacccgacaaaaaccagagcccgcactcactctcgtactggggaggtggacttcagggagggttatctggaggaggaatctctcaaagtacaacacaggagaaagacagtatcgcaatacagaaattttattttttattttattattattttcctgagaccggagtctcgctctgtcgcccaggctggagtgcagtggcgcgatctcggctcactgcaaactccgcctcccgggttcacgccattcggctgcctcaccctccacagtagctgggactacaagcgcccgccaccacgcccggctaatttgcaatacggaaattttaataggtaattagctctcctagcgttatggtggggaatacagagggatggttgcctgccgcaccctcccctcactattcttcgccttcttcagcctcagcttccacggaatccatgcccacatcttcataatcctccagagctgccagatcctcgcgggcctcggagaattcccccactgccatgccctcccccacgtaccagtgcactaaggcgcacttggccgaacttatggtccaggcaggcccaggcctccgtgatggccgtggtgttgctcagcatgcacaccgcccgctgcactttggccaggtctcccacagggaccaccgtggggggctggtagttaatgcccacctgtcagagatgggcagcatagaatgaagtttatattggcctcagaaatgggagctcattaaaaatcagagctgtggaccagttccaacactgtgttttaagaattgcttctatattttttggcattatctgttatctatcgacaattaatatcctttgacgacttttttttttcttttcttctccttcttcctccttctcctccttctttgttgttgttgttgagacagggtctagctctgttgcccaggctggagtgcagtggtgcaatctcggctcactgcaacctttgtctcccaggttcaagcaattctcctacctcagcgtcctgagtagctgggattatgggcatgtaagatggagcccggaagacggagatttcagtgagctgagatttcgccactgcactccagcctgggctacagagcgagactctgtctcagaaaaaaaaaaaaattattacccatattacccatacagtaaaacacatgaaaaagaatgagaaccctgtcttgggatataaatacatccaaggtatattgtatactttgtaaaaagaaaagtgagttgaagtctatgtatttatgtgtaaaaaaatccatgtaataacatacacaggctagaaccttgggcagctagggtagcatcatgccggaggaggacaaacgcctgctgaggtggtgaccctgccttgccctgccaagcacgtagcagttagcaccaactagatacagacatactccacaggagttggaaggggcagagagaagggttcgtaccctgatcagggagtgtcctcccacaactctaaggccaagcctatcagcccttccaagtgggagtgctgccagctttctgtttactgtgaccacctgtgtgcagcaattgggtctgtcacctacaggaaagggacatacatatctgctggccactgtcaacatcacctgtataacaagagattaatatgccttgaatatgtacagaatgtttttcaaaggacagaagcagctctggggaagaagaggacttcagcttttcagtcttctgcattctttcagtattttgccacatatcaggttttgttttgtttttgagacagggtctcactctgtcacccagccttgagtgcagtggtgtgatcttggctcactgcaacctctgcctcctgggttcaagcgattttcccactttaagtgatccgcctgcatcagcctcccaaagtattgggattacaggtgtgagccaccgcgcccggcccatatcaagttttttttttttttttttttttttttttttttttttttttttttttgagatggagtcttgctctgtcattcaggctggagtgcagtggcacaatctcggctcactgcaacctccacctcctgggttcaagcaattctcctgcctcagcctccagagtagctggaattacaggcaaccgccaccatgcctgactaatttttgtatttttagtagagatagggtttcaccatgttggccaggctggtcttgaactcctgacctccggtgatccgcctaccttggcctcccagaatgctgggattataggcgtgagccactgaccgcacccagctttttttttttttttttttttgagatgggttttgctctgtcgcccaggttagagtgaagtacaatggtgccatcttggctcactgcagcctcaacctcccgggcttaagcagtcctcctgtctcagcctcctgagtagctagcactacaggaaatgtgccaccatgcccagctaattttttattttttgtagagacaggttttgccacgttgcccaggctggtctcaaagtcctgggctcaagccatccacccaatggattacaggtgtgagacactgtgcctggccaacataagtacttttataataaaaaacccaaatgttcgtatttttttttctaagggtcttgttctgtcacccaggctggagtgcagtggcgcagtcatggctcactgcaacatctgcctcccagtctcaggtgatcctcctacctcagcctcccaagtaactggaactataggtgtgtgccatcacacccggctaattttttgtattttgtgtagagatggggtttcaccatgttcccccaatggatcctgaactcctggactcaagcttttttttttttttttggtgagagagggtctcacttggtcacccagcctggagtgcagtggtgcaatcttggctcactgcaacctccacctcctaggctcaagtgatcctcccacctcagccttccaagtagctataagtgcgtggcatcatgcccggctaattttttgtatttttggtagagatgaggtttcaccatgttgcctaggctggtctcgaactcctaagctcaggtgatccaccgacctcagcctcccaaagtgttgggattacaggcatgagccactcggtccagcccccaaatgtttttaagcatggaaaagactcttcgaaaatagcatatccgaagctgggtgcagtgactcacgcctgtgattccagcacttcgggaggccaaggcggttggatcacttgagttcaggagctcgagaccagcttagccaacatggtgaaaccctgtgtctaccaaaaatacaaaaattagccaggcttggtggcgcatgcctgtaattccagctgcttgagaggctgagacaggagaattgcttgaacctgggaggcggaggttgcagtgtgttccattgtactccagcctgggtgacagggcgagactccatctcaaacaaacaaacaaaaaaaaagcaaatggttgttaaagaatgtatggttggctgggtgcggtggctcacacctgtaatcccagcattttgggaggccaaggcggatggatcaactgaggtcaggagttcaagaccagcctgcccaacacggtgaaacctcatctctactaaaaatacaaaaaattggtcaggcgtggtggctcatgcctgtaatcccagcactttgggaggccgaggcgggcggatcactaggtcaggagatcaagaccatcctggctaacacggtgaaaccccggctctactaaaaaataaaaaaaaaaaaaaaaaaaacgttagccaggcgcgatggcgggcacctgtagtcccagctactcgggaggctgaagcaggagaatggcatgaaccccggaggcggagcttgcagtgagctgagattgtgccactgcactccagcctgggcgacagagcaagactctgtctcaaaaaaaaaaaaaaaaaatagccaggcatggtggcgggcgcctgtaatcccagctactcaggaggctgagtcaggagaattgcttgaaccggggaggcagaggctgcagtgagccgagatcacatcactgcactccagcctgagtgacaagagtgaaactccgtctcaaaacaaacaaacaaacaagaatgtatggtaaatcacactaagactgacaaaaaggaacttaagagcaaagagaattaattcaacaaggtccatctaaggctggactatcttctggggggaggagaggctgtgactttatctccccacagactagcctccctactgtctcacaatacttagttacaataggaaacctctgcacagcatagcatctcccacagtgcctgccagctaaggatgtcttcaccttccaaatgtaacactaattgaaagaaaaattcctctactcaagttgagaggcttaataattagacacagaatggagggtttcacctcctacctgtaacatcttacatctaaggtctgtaatcctcctatgtaacatgtaatgaacattccaggttggtgtaactgttgtagattttacccttctttttcctcttttttttttttttttttttttttgagacagtcacgctctgttgcccaggttggagtacagtggtgatcttggctcactgcaatctctgcctccctgtctcaagcgatcctcccacctccacctccccattagctatgactgcaggcatgcacaaccatacctggataatttttatatcttttgtagagacagggtcgcactatgttgcccaggctggtcttgaactcctgggttcaagcaatcttctcacctgggcttctcaaagtgctgggattacaggcatgtgtcactgagcctggccgattttaccctgttctatgaatcactttaaatctgtcaacttaaagatggtttgcatcaacgtgagatgaaaaagagagatgatctgtgtcaaggtgttgtaaagtggctgagagagggccagacagattcaagaagttgtgtgcgttcagaggcaagttatggccattccacatgggaaaaagaagacacatacctgtgactttctcatatcatttcaatctggaatgatcctggaacttgcaactcctcaaacaccttcagaactcattgagacttataaatgtgggatctatagctttgcctaatgtgggaaaccactgtagacaggggctcttaactaaccatagggcacaaagttgaccaacacaggtgtggtgaggcatttagcctagtcatcacaacagatcttcgagcctgacattctgttatttggcttccaaatacatggtacttttcttttggtagacaactgactgtaagcatagctaaaggagcaccaaatcatcagtctgattgtgtgtgaggcagaggtctctgcttggtttggagaaagggcaaagacctgcctttggtcttcacagtaaacactgcacaatatatttaaaaatctttacagaaatattagtgttgcccaaaattcagtgacaacaggtgaccaagatgatgtaaagtgtaaaaaccactatttataacacaaaaaatgataacatagaacctgacaaattactaaagtgagcagtggagtaatgtggaggacagaccaggacctgcagtcagataatctctgatttctctctgcatcacttgctgcctgtgaggctccagacacctaaagctatctcagcctttgttttcttttcttttttctttttctttcttttttttttttttgagatgtagtctcgctctgttgcccaggctggagtgcagtggtgcaatctcgactcactgcaagctctgcctcccgggttcacgccatcctcctgcctcagcctcccgaatagctgggaccacaggtgtctgccaccacacccggctaattttttgtattttttagtagagccggggtttcaccgtgttagccaggatggtctcaatctcctgacctcgtgatctgcctgccttggcctcccaaagtgctgggattacaggcatgagccaccgtgcccagcctcagcctctgttttctaaagtgtaagatactggtaatattgccccatgaactttaaagggtagtggttaaggtatgagggaacataaagtatttggtaaagtataaggcggtaggaaataaattactaaaattattatccttgcaacctagctgacgtgaaaaggggttgtctccataaaggatgcgggccttcaggggcagcattattctgcaggtctcctgcttcctgatggcacaaggactccacatcacccagtcctaccttaaatccaatcggacaccagtccacaaactggttggtgtgcttgctcttgatggtggcgacagccgcactgacatctttcaggaccacatcccctctgtacaacatgcagcaggccatgtacttgccatggtgagggtcacacttgaccatctgattggctggctcgaagcgggcactggcgatcttggccacggacagctgctcatggtaggccttcttggctgagatgaccagggcgtaggtggccagggggaggtggatgtgggggtatggcaccaagttggtttggaattctgtcaagtacacattcagggccccatcgaatcacagggaggccgtgatggaggacacgatctgcccagacgactgaggttggtgtacatgggacactcgatgtccaggttgtgctgacatgtcataggtggctttgctgtcgactatgaaggcacagtcagaatgttccagggtcgtgtaggtggtcaggatggagttgtagggctccgtcatggccatggagacctggggggctgggcaaatggcaaactccagcttggacttcttcccgtagtccaccgagagccgcttcatgagcagagacacgaacccagagccagtgccgcccccaaagctgtggaagatgaggaagccctgcagtcccatgcacagatctgcctgagagaaaccagacaacgtaagccaatgcccgtgggagccacaccaccaacctccaccaagccggggccacttctctttgcctctgagagttgatacggattcagaccatccataatgaacacgcatcacactttgaagcagagaaaagcagacaatacagatctatgcacaaatcaccacgcacacttcacagtaagacgttgcagaggtctaggaaggctggtttgaagaaatacacagaagaaaaacggatggactaaccagagcgctcagccagcctgctggactggcacccgtggctacagacactcttgtttagcaccatggagagctccctgcacagaagcaaggactcagggcattgccccctctctacctgagaactagactcagcgcccagcactggatttgataatacaggtactcaaatacatgtgctttcctctttactcagacacttctagggctggcagggtcagacagtaatcccccactttgtggggaggccctgtttttgctgaacagctcaagggcaggaagattctttcttccacacacccctgcaactgccaatacttgttctgtgtgacccttgcagccatcctatgcggtaggtgctaccattgccatggatcaagtggggacgcacagatccaagctccttcacctctcaagggagttgggccctcccacagatctcttggaggaaaaaaatggccttgctgggcctgtcgatttccagtccccacccacctccctcatgtacatgtgtctgtttgtgaaaccttcatagcaccttagcttccaggccctccatcccggctgcctctctggcacttgcccttttactgtgcgggtccaaagagacacctatgttcagtttgtcaaagtctgaaataagcctgtcttttaatttcactgactcccagtagtaatttttttagaagacaaactgcttctctggcagttacactccagggccaattctcaaaggccaagtctggtgccaccccactccctctaagctgcttgagccagatgagagcttctgaaatgctgcagaaaagagctctcctggggcatccattaaaatgcagattcactggcattcccctaagagtttggttcagcaggtccagggtcaacatctgcatgcctcacccagggtcacaggtgattgttactattattggaccatttgaggagaggcaggtagaagtgcaaattcctggcaaagcaaacactcaggggcatgagagtgatgagaccaaggaatcccaaccatgtcttctacctcacctggaacaaaatctataccctttttgccacggcctacagccctgcagccctctgccctctccaccccacagcctggccacgcttccctggctccctagcctaggcacactgctgtctgccagtctgggaaacaggcccgcatgctcactgttcctctgcttgaaatgctctccctctgatcttgccatggctgactccttcccaccctgcacatttcagcttaaatgtcacctcacagaggcctccccagccacctctttaaagcagggggtccccattcttctctagaagcataaactatttgtttcttttgcagtgccaataattactcagaatgatattgttaacattgtcccttgaggtcaggaacttggttttgttcaaggtggatccctggtggctaagtcagtgcccagcacatacagcagcgcgcaatgagatatttgtggaaggaatgaagagttccgtgtggctggagtggaagaggagtggggcaaggtggggtgtggggagcaggaaccagagcacatgctccctggcgatgtgcagcgcggtcctgccaacccccacccatccctgccccaggaagctgagctttcatggccatggtgccctgcgcaggcattacctgcttggtcattcagctggttgtagctcaggtccagggacttcaggtctgtgtgggccagcaggagttcggcaaggtgctgggccgcctgctcctccaggccattccctgacagctgcatcttccgcatggcctggttcactgtgagggcggcacagagggcctgggctcctgccactcccagctggttctccaacaggtccacatctgggggacggagccactcctcagccagtgggatgcaaagccaggtaccacccccctcccccctcttctgccatcccccaaacctccaggtctgaggcagaggaaaaggacttacaggttaactgtcctggggttgcatggtggctctggctcccaatggctgggtcccctctgcccctgacctccccctccctgtgtgcccaccagcttctgtgtcaagcggttaaaactgcctacctcctggtactgtagagactgctgtggtggggggcagccaccccatcaatgattatgtctggcagtgatatcaccacccacttcagaagccctcactgccccattgccaggattggcaataatagcccaggtgactgtgcatggagcacttacatgggtcacacactctgctgatcacttcaggagtgcatttcacttcatgctcaccacagccccaagcctatgaggtcttgtgggggccatttcacagattggaaactgagctgctttcataggtcaccccgttttctcagtggcagagacagcatttggattcagcttcaatgaactcccaccttgcccacccctttcttgaacttccccgcccccaactctctgtgttgcaggactttccactctgcattcaggcactggggagtctcccatgtgcagggcagggcaggagaatgggtgccagccaacaaggaaggagagtggtggggtagggtggatgaggaagggacttgtatccagcatcagctgcacagcagagggtctaactccaccccacataccccctcctgtgatgaggcccctcctctatccaccagcaacaccagcaggacccaggtgacatggcccagctttcaggggtggaggcacatccctgaggaaagggaggactcacgcctgcccacctgccccagacccagcacctaccgcagatgctgctgcttttgctcagggcacctgccagggcctctgtacctgccccatagagcccactgtcccaaaagttcagccacttgacatatggattggagctcaatgaggaagccagagaccggcgccctgggacagacagagcaaacacactggccactatcctggctcatgctccagggctcagcccgctccacgtcccccacctggaaagtacccccctttccacctgcttaagggacacatgcttctccttttaggccccacctaggtgtcccccacccccacctctcccagagcccccagcgggttagaagcctgaaggctccccaacccttcatgccatctgtcatagcatcaatcccatctgtctctcagatgtcgagggtagggcatgcctggcacaggcagaagctggggagtacaggggacagactcaggggcactcccatggctgttgtctcccggggcctctccctgtaagcctggacccagtgtccttccagtggtacctggggccccaggccaccgtgcagcaggttcagctctggggcactcccttggcacagaaagcagaagatgggcacaatgctatggatccagcaagacctcaggtacagggtgtccccgaccagttctccaagtccatgggtgcctggtaggagacagggggatgaatgtgaacccctgcatggctatagccacctgcctcctcccctgccctgcatcactacctggcctattttttgcctctagaagcactgcttcctatgctccttaggaccactgcccgcatatgacagataagaacatcgaggctaaggcaacgcaaatcttttccttaaagtcatacagctgtcaaaagaaagctggacaacctgggcaacatagcgagataaaaaattatttaaattagccagatgtggtagccccctgtagtctcagcgactcaggaggctgaggcaggaggctcaccagagtgcagagttcaaggatgcagtgagctatgatcctgccactgcactgaaagctgggtgacagagcaagaccctggctctaataaatgaatacataaagtctcacagctagtggtagctaatcctgccagagtcaggcctctacctgtctgatgacaaatggcacactatgtcttttaacctgattgcagaccacaaatgttttgtgaatattttccccagggaaaaaaccggaagtagttctaaattctatacatccattatattagttttacctgtggattgggaaaacccagctctgattgcatttcagggcgggacagcctttggtgcactgtctggcgggattttccattttaacctccttctagaagcgccttctcatggtaaagttcctgatgccgccaggagcgccgaggagagggcagggggctggagacgccccgcagagggctacgtgccctgctggacagaggtctcctgcctcctcggcggcgccagcccacctcccacaacccctgcgggagaagcccccaaggggaggagacgggcctggcccctgccccgagcaccttccgtctctaggtcggagtctgaatcggccttgggaccctgcttggcttcggggacccctgcaagacgtccacaggccgccgtcgcctcttcctcctgctttttatcctccccagacctctggcaggaaccgctcatcgttacgcccctttcgcagcctcagaccctgaggcggagaccgcttggcgcctcacttagagcgcgacccggggatgtgggcggagtctgcggctgcgctgaccaatcgagtgtggcgtccatcgactggcgtctgccacggcaattagcgacgcgctcccccgcggcggtcgccccggcaacccagtgctgtaggttgccgtagaaaccgtggctctcctgcgctgaggctcctcgcctgagaggataaactgcacgcgccacgggctatgcactgggctgggcgccttgtgggcatcctccctgccttcctagggggttccagcatcgcccccctttcgtggactgggaaacacgcctgactccaggacttgtgttgtcctcactgcactggggaaggtggcgggggcagcttttcaggagggcctggggaacttcgcagagccaggtcaccctctcactctgtgcctcttagttatcttgcatgctctggtctttgcatacgctgctccctgcaccaggaacctccatccccatctttgtctgcttgtcgaacttcagaaatctgcaagggtcagcttagaggtcacttcttccggaagctttcctcaacaccctccccgccctgctgctgctgccctcaggccctcctctcacagcactgataacagctgtccgtctccaccctcccaccacctccactcccaccccaggaagtgaggccagagggcagggacagagctgctgctgttctctgtgtgccagggcccagcaaagggaatgtagggagggtgggaggtgcagggcagctgggattaggggttgagggctgggtgttggaggctggatctggatcctgctttagtggaagtgtccctttaacagcaactggcctggcctggctcgggccctgctttgcctcctgttcagctgcggctgcagctgccatgctgactcatgtgcccgcagctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtagggtaagagagaagagcttttggccaggctggaggggcaagggaagaggtggggggtggggcttggtcctgctgggttgaagttgagggttgggctgtttaggggctggagtggaagggggcagattgggacggggttggggagagctaggcgatacaagacaggagagcaagaacaagctgtgtgtttgtcctgtgtgtccacttgcctccttcccaggcccccacccaggccccacccagggggcacatgacatagtccttaacatctgtgagagctggagcactaggcccccagagagaccaccagctgtatctcgggtcaggagagtctgtaagggggaagctggatctagtcaggctgggggtgggtgctggctagtgaaggtgattgtctgagggcattggctctctgatgcatggctggagcttctgtctcattcagggggtctggagtgggaagtggggccagagaggaggtggggccttcgatgttgggccgggagcctgtagggtgtggggggagaactgagcatgtagggctcagctccgcccctgtcactacacgctggggacacaccacactgcccgacttctcctccccaggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcaggtgggggccctgatgttgctgacgggggcgcaagtcctttccccactgacagcctgaacacccgccatgcagccagtgtgtgcgagagagaagcatgtgatgccagagacggctgcgggttctcaggaagggcttcacagaggagtggcacctggacaggactttcagggatgtgtaggaggttttggggtggaaaaaggggccactcaagaagccaggccagggttggacgtgctggctcacgcctgtaatcccagcactttgggaggccaaggcaggtggatcacgagattgagagtatcctggctaacacggtgaaaccccatctctattaaaaatacaaaaaattagccgggcatggtggtgggcgcctgtagtcgcagctactcgggaggctggggcaggagaatggcatgaacccgggaggtggagcttgcagtgagccgagattgcaccactgcactccagcctgggtggcaaagcgagactctgtctcaaaaaaaaaaaaaaaaaagccaggccagagaaactgcatttccaaagactgccaacagaaaagaagggagtgtccaggactaatggcttgagcttgagagtggtgtgaggtgctggggcatggaacttccctgtagccctgctccctgacctggggcactacggtcaggtgctgctcctcccctcttctcggctgcgttttcctcctccctccacccagctcatccccagcctcaactgccacttctgctcctctgatgcccagggtgtattcccagtgatcacctgcccagagcacagctgtcttctaggtgcacacccacatgtccaaagatcaattattttcctctcctggcatggcctctgtgacgcccactagtcatggtggctgtgacatccactagtgcctcagccagacccgtgactcaccctggaccccttcctgtcccttccaagatttttcaccactacccatgccatgccatgcatgagactatggcctcctagagggtccctagatgcccctctcgcctcctcccttactgctcggtgcacaccacgcagcagccaagctgaactttcacaccaggcatcatgagagcctgcagcgcctgcttctaccctcaggaattcccccaaccctgcccatgacggtgtccacactttcctcccaatcctaatggctgccactcccagcaccatctggccagccctcaccttcccttcctgggcatacattccccaaattcacagtgctctcacgagcagcactggagggtcagcctttctttccaatgtcctcggccacccgttgaccacagacacagctttccctcttctcccttggcccctgccatgccagtgctgctgtgtgtgagatgggagactcacctcgtctccatcctgagcaggtgctgggcccagctctcccttggatcttcagtactagaagcagcaggctgttggaatattctggttggagccaggcatggtagctggagcctgtagtcccagctacttgggaggctgaggcaggaggacctcttgagtccaggagttagaggttgcagtgagcactgatcacaacactacactccagcctgggtgacgaagtgtaatcctgtctctaaatacacacatacacatgcacacacacacacaaattttggttgagacaagagacttgtctcaagagatggacatgggcacaaggcttcctggtctcaaaaatggccagaaccactgccagcctcccatctctgcttcagtctgccttacagggggacagggttaatgacttgatggggccaacatcccttccctcataaaccaggctgccggcttccggcctttccagtcaacacgagcccagccaggccaaccttgagacttgcctcctagggagagaacgtgttcttcttggtgaccaacttccttgtgacgccagcccaagttcagggcagatgcccagaggtgagtttacccaggatcctcccagcgggtcccttgttcctccatcagccccagggggccacccgtgtttccctttccccttcccaggtggctgaaggctcagcctgtgctcggtgtcccccaggcactgggctacatcttttcctgaatcattatgttcagtcttcacatatcccctgcctggtaggaagtcctgtgatccccatttcagaggagaagactgaggctcagtgaggttgagtcactttcttaaggcctccaggcctgtgggtgacaggaccccgagctctgggcagcagcagttcccatgaggtgtccaggccctcccatcctggtcctgcctctgggtactctccaggttggtagtgtgacacccagagctgcgcacatgctcagggaggttctaatagcaagagccaagctggaatatcacctccccttgtctgtgcccagcctctattaatatgtcctgaggcagctttcatctttgtgggccaacacagcacactcttgctcatggtgaattcaggattgcttatgatttctggatagttttttttgttttatttttgagacggagtttcactctgtcacccacgctggagtgcagtggcagatatcagctcactgcaagctctgcctctcaggttcacgccattctcctgcctcagcctccggagtagctggtactacaggcgcctgccaccacgcccagctaatttttttttttttttgtatttttagtggagacggggtttcacggtgttagccaggatggtctccatctcctgacctcatgatccacctgcctcggcctcccaaagtgctgggattacaggcgtgagccaccacgcccggcctgatttctggatagtttttacatcaaccgtggtcaagccagagtcccccaccttgttcttcttcatttctgatccagaaatgctgattctccccctgacatttcaccttttccccttgcctggggatgtccctgggatcctgcatctgtcacagagcatgctcattctctccagctgtgaattttgtttgaactattgggactcaggacatagtcctgaaagtttacctccacagtgacatctttaggcaagtccaacatttacgtgcctcctgggctggagggtcgttgtgcagacagctgtcccctgagccctggtggctggtcctagcacagttgctggagacatcccatgtccgtagttggaaatatgcacaaaggattgcttactctttttgtttgtttgtttttttgagatggagtcttgctcttgtccccaaggctggagttcaatggcacgatctcggctcactgcaacctccgcctcctgggttcaagcagttctcctgctcaccccctgagtagctgggattacaggtgcccgccactgtgcccagctaatttttgtattttaagtagagacggggtttcaccatgttggccaggctggtctcgaactcctggcctcaggtgacccaccagcctcggcctctcaaagtgctgggattacaggcgtgagcctgccgagagcttggtcggggagacctgaacccagcggtgctaaaggaattaaagacaaacacacataaatatagaggtgtggagtgggaaatcaggggtatcacagccttcagagctgacagcctcgaacagatttacccacatatttattgacagcaagccagtgataagcattgtttctatagattatagattaactaaaagtattccttatgggaaacaaagggatgggctctggttggttagctgcagcaggagcatgtccttaaatcacagatcgctcatgctattgtttgtggtttaagaacgcctttaagcggttttccgccctgggtgggccaggttttccttgccctcattccggtaaacccacaaacttccagtgtgggtgtcgtggctatcacaaacatgtcacagtgctgcagagattttgtttatggccagattttgggggcctcttcccaacatgagccactgtgcctggcaggatgtgcttactcttggtgaacccacacaatgtccttctctttcttaatgctcagatgtgcatttagtgttcagtttgtagaccgttctgaaatttggctggatctgtgggtctgtgtttttcagaatctgtgcaattcctctttgtctgcaaccacacttctggctcttcccatgaaacgtcagggctgggtcgtaattatcagatctgacaacctggctttcccggaagaccagagttctgccagctcctctagggatcctggtgcctgatccctcccttacatgcaccatgctctttatagtgtcacctccctcagcagacaccgctgagcctccccgctgggccagggggctagctaggctaaattcacaaaactccatctcccatacttcaaagaccacccacatggacagcccagcccaggtggcaggtcctatgatgggacagaggctgtaggtgggggacctagggctgcacttgagcagaatcttttttttttttttcttttttttttttttgagacagagtctcgctctgtcacccaggctggagtgcagtggcgtgatctcggctcactgcacacctccacctccttggttcaagcgattctcctgcctcagcctcccaagtaggtgggactacaggcacacaccaccacactcggctaatttttgtatttttaatagagacagggttttgctgtgtcggccaggctggtctcaaactcctgacctcaggtaatccgcccaccttggcttctcaaagtgttgggattacaggtgtgccaggccaagcagaatcttaaaaaaaggtggggagaagctggtgagcaggtggatttggttgaagcaggatgtcgacacagagggggcttggtgggtaaaggccctgagctgtgtgaggtgaggtgcctttagggctacctgccactgggtggagctgaagtgaagatttggactggggtgggaagaaggtagttcaggatttcaggggcccctgtaagccccactaaggagctaaactgtttttgtttgtttgttttctttttctcttttcttttttttcctgtagcaatgaggtcttgctttgttgcccaggctggtctcgaactcctgagctcaggcaatccgcctactttggactctcaaagtgctaggattacaggcgtgagccactgtgcctggcaggagctaaacttgattagaggaacagaagagagccacacgtgggctcagaggcagggtgctcagtttcctgcacattgggatgcaccacttgggctgctgggcataggtggatgagggtatgggaagacgtgggggccccactggtggtcactgtggggtctagttggaggagacggtagcccagctggggtgaagaggagaggcagacacaggacataggtagggacaaagaagcagagcatgtggctctgctccgacctccacccaatcacgacggccctgtctttcagaaagtcccaccgcctcattctggcttctcagaggccctcagccttccttgcgcccctggtgctggtgttcttcctgctgcccctgagctgagtgccctgggcagcagtgtccatcctcagttggggcaggaccatgcctgggagagtgcccgatgctcaagggtgccttcgtctctggggtctgggaccccagaaagctcacctgtcctccccttctgccagagccccatagtcctatgcctctgtgcaggcattaatgtccccaggttacagaagagcgagcaggaaggagtagcctgtggtccctcagcaagggtgtggggtcctgcttcaatacccaagcccctgactctagggccctgatctttgtcagctatgtccccatgccgggcatcaaaaactcaccctcccaaggtatcttcaccttccctgatctgtcatccaaattggaccagaggagctagacctggaagaatcacttccgcatccaccagggacagaactgtcaggagggaaggggcagggtgcgttgtctcacgcctgtaatcccagcactctgggaggctgagacagaaggattgcttgaggccaggagttaaaaaccagcctggtcaacatagcaagactccatctctacaaaaaaaaaatattaaaaaatcagccaggcacagtggtgtgtgtctgtagtcccagctactgggaatactgaggtgagaggattgcttaagcccgggagggcgaggctgtagtgagccatgatcataccactgcactagagcctggacaacagagtgagaccgaatcactaaaaataaattttttgaaaaaggaggaaaggggtctccctttgtctttgaaatacagtactgtaccttcatctggccagggcattgctccgctccctcctctgaccacctccttttatttgcaccctccagctttcctgtgtggccccacactcagggtactctggcggcggggtggtgaggttgtttaaggtgggaagggggcctgtccttcccaccttgaacctccctgcctttgagactgggctgtggaggggagacatcccctgtgccattggtgactgctctctctcccacctcagcacccgtccgtcccactggctaactgctgggtcgacgaggactgccccgaaggggagggaggcacacacagccacggtaactgtgggctctgtcttccagtgcccccagcagggtgggggccgggctgggatcctgggtggctcctgagtgcaggccctgctcgcctctgtccctgcatctctctttctgccaacaaccccctggctgaaggcctccccaggcctgcagagatttgaaggtctggagttcatcttttgttttctaggtgtaaaaacaggccagtgtgtggtgttcaatgggacccacaggacctgtgagatctggagttggtgccccgtggagagtggcgttgtgccctcgtaagtgtccccacaatcccctaccccaactggcgcagggccccaggcctggcagaggctgtcacctcccttccacctgcaggaggcccctgctggcccaggcccagaacttcacactgttcatcaaaaacacagtcaccttcagcaagttcaacttctctaagtaagcagagtgggtctcatctgccccaagaccctccttgtcccctacctcatctgacctttcccactcctcccaggtccaatgccttggagacctgggaccccacctattttaagcactgccgctatgaaccacaattcagcccctactgtcccgtgttccgcattggggacctcgtggccaaggctggagggaccttcgaggacctggcgttgctggtgggtcccaagttgggggcagggttcctagagggctctgggagagggtcccgggcccacccaccggtggaaaagctatgtgctatgtgcagggtggctctgtaggcatcagagttcactgggattgtgacctggacaccggggactctggctgctggcctcactactccttccagctgcaggagaagagctacaacttcaggtgaggccccactgctcccagtgcccagctgctgggcccatcgccctctcactgtggcggccaggacagaccacacccaggcccaggcctctagatattccactacgtgtgcaagggggtcccaggagcaggagagagctgttctcaaccccacatcctccagcacaggctccgtcctgctgccccaagtcctgagccctccaccccatctgtcccaggcccctgcccagctcaggctcctcactgccagcccttcctccaccccacctcgcttctagtatctcccctccacagcaatggggtgtttcatttttactttccccttctccccttcagctttgttttttttttttttaagacagaatctcattctgtcacccaggctggagtgcagtggcccgacctcggctcactgtaacctctgcttcctgggttcaaccgattctccttcctcagcctcctgagtagctggaattacaggtgctcgccactactcccagctaatttttatattttggtagatagagatgggttttcacaatgttggccaggctggtctcaaacccctgacctcaggtgatccacccacctcagcctcccgaagggctaggattacagacgtaaaccaccatgtctggcctcccttccgcttttacctaaactttttttttttttttgagatggagtctcactctgtcgcccaggctggagtacagtggcgggatctcagctcactgcaagttccgcttcccgtgttcacgccattctcctgcctcagcctcccaagtagctgggactacgggtgcacgcctccacgcccggctaatttttgcatttttagtagagacagggtttcaccatgttggccaggatggtctcgatctcttgacctcgtgatccacctgcctcagcctcccatagtgctgggattacaggcgtgagccaccacgcccgacctttttttttgaaacggagttttcactttcttgtagtccaggctggaatgcaatggcgtggtcttggctcactgcaacctctgcctcctgggttcaggtgattttccagcctctgcctccagagtagctgggatgacaggtgtgcaccaccacacccaactaatttttgtatttttagtagagatggtgttttgccatgttggccaggctggtctcgaacttctgacctcaggtgatctgcccacttcagcctcccaaagtgctgggattacaggcatgagccaccaagcctgttttttttgtgttttttttttttttttttttagatgaagttttgctcttgttgcccagactggagtgcagtggcccgatctcggctcactgcaatctttgcctctcgggttcaagcaattctcctgcctcagcctcctgagtagctgtgattacaggtgcacaccaccacacccagctaatttttgtgtttttactagagatggggtttcaccatattggtcaggctggtctcgaactcctgacctcaggtgatccacctgcctcagcctcccaaagtgctgggattacaggtgtgagccactgtgcctggcctcaagtttcataaattgcatttattatcatgtctttgagtcttctaagcagatctattggatccttctgccaccgagcgtcacctcgtcatgcaggcaggcacacacgaccaccaggcctggggatgatgcccctcaacatagctcactgcaccccgtctgatctggcttccccaacctccccagcccttcgaaaccacgtggggctggctcccacccacatcctgttcccctgacctctgtgctggcaaaccacctgtgtgcatgttccttcaggcccagcctcatgtcccctccaggaagtctaccccagttcccagggaagagtgagttcccatctctggaatccctcagccctgagcctgccccttcacatcccccgctgctgggtctgtttagggactcctctgtcccccgtcctctcagcaggcagggaacttctgagggacaggtcttcgtttgctttttctgttttctcaccaattacatagggctgagacccaggactcaggcttgggctgggggtttatagagtcaattgacaagttggacagaggtctggcagggccagccccacctgggggtgggcaaagcaggtcaccagagccttctttcctgcccacaggacagccactcactggtgggagcaaccgggtgtggaggcccgcaccctgctcaagctctatggaatccgcttcgacatcctcgtcaccgggcaggtaggcacaggtaggggtcaggccggggatgggatggggcaggcagacagggctggaggaggcatgaggctgacagtcgtgggctgagaggttcagctcagatctctctcaggcagggaagttcgggctcatccccacggccgtcacactgggcaccggggcagcttggctgggcgtggtgagtgcgagcactgtgggcacctgcaggctgcagtgagtgctgctgaccagggtgtgtccaatgcatgctggagcctccggtgcctgcacattgagtctcggggtgcaggctggggaggtggcaggagagcaggctcgggggctggaacatgggttggccctgcctctcccaggtcacctttttctgtgacctgctactgctgtatgtggatagagaagcccatttctactggaggacaaagtatgaggaggtgagctgaggtcgctctgcttggaccctgggttctgccacacttaggaagatgttggctggatccctgacctgctgtcctcatctgcaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcattgggttcttcaggaccttctatatccctcctcggtaaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagccaccctcttcctgtgtagtccttacaggcatgactggaaagttggggggcatctatggtagacatggcacagccatgaagagaccagtggggtggtgcagggtggacttggggaccctacccctgaagactgaggccctgcagctaccaggtgggctagaaggtaactggaacaggcctgggcacttgtgcacccatgtaggagcatgagggccacactcttttcacctcaaagcccttgaagagtgggcaaagacagcaagagagctgcagcctgggcccgagctcagaaacagctgtcgcctcagtctgcgcacaggcatgcaccccagggtagtgcctgcagggatgcatgtgtccccgtgggggtgcctgtgccaggcaggcctcaggtgcatgccatgctcagaaccctgctgccctttctaggcagcctccttggggcccaagctctgctccctggatctgccacctagcagacgtggggagcctgaccccatgcctgtcatggaaccctccttgcctggtgtgtgtggctcccctcttcactgggcacctggatccaggcccacctgtgtccctgactcagggtggtcccaggactggcacctactctttagagagccccagcatctttgatgtggattggagacaattgcctggttccctggggcaggtgaagacttggtgccacaaagaatgccacagtggatacgccagcaggccacatggctggccaagcaattattattatggatcccttgggctgtgggccttcccatccaccccaccacaactgcccaggtagctggagctgatcataaacaagaaggctctgggcagagtccatggcaccagcaccagccaaggcccactcctgaagacccgaagcccagcccctggatgaaggtcctaaggtcctgaggactccccagcctgtgcaggcctgcaaacccaggctgcccacaacagaaggggctctcggcttgtctggcctctctggcctcccaagcaggtgtgggagggcggggcaagtgtgggctgatcagctactccatatggccagggtcctgtgctggtgcctggctggggggctgcatagcctgcactgtctcctccaggctgcccctggggaataccacgtagtgtgtggagttcagccctggcagctcccgctggttctccttgctatgccggatgccatagccgaaatacactgcaagtcctagacagggcaggaggcagggcatgagcctgaggtacaggttccagcccttcctgtcctctttgccctcctcctgaccccggtcccagcctggcccccactcacccatcagcagccagatggagaagcgcacccaggtcagatagctaagtttcagcatgaggcagatgttgaggacgatgctcagggctggaatcaggggaaccatggggatctgaggaggcagaggcagggcagggctgggccgggctgcaggaaagatctgccagcccagggctcactttctcgggaatccatagagcctttgttcctcacgggagattgtggagacatgtgctcactcaccatgcagaaaggggtgcgggatgggtgtgtggtcctccccagccccgtgagacttgttcattctgggatggtagtgggggaaggggaggcagctgcctgggccgagtgtgagtgggtgttggctaggggaggtacctgaaataagtcttcccgatactgttgctggtgagcccccaggacaaggaggctgagcagaaacatgacactggtgagcaggagcagcaggatgtaaccccagtgtgggaggtgcagggtcgagttcccaaagacaagcacgcagcctatggtgatggctgaggccaacataacgccaagcgcccaagtcaccactgctccagggctgtacccatccaagaagcccaggtagggcctcagggctggcttcagctcccctggctcagggacggaggcgtgtacagtgcccaccagctgtaggtggtctgagaaggagctctgctgcttggtcagggggccagggctggctgggcctggggagctgggcggggaagacttctggaagcgcagcacaatgatactggtggccacgaatgtgtaggccaggagtgtgccaagggacaggaactgaaccagcgactccaggtccagcagcagtgccaggaaggccgtgaggagcccgaacgccagggtgcccgccacaggcacctgtgtccgggggtgcacatgggcaaacacctggaagaagagcccatcggcggccatggcatagacaatgcgtggcagggagaagaggaggctgagcaggacggtgttcatggctgtagcagagagagtggggagggtcagcatggcggagaagcccaccaggggcctctgctgggggtcggtgcatgggtggctccttgggaacaagggcatgagcttgtctgggctctcagagtaagcatgagtttgtgtaggagtaatagattgtcagcgctttgcccaagaacaggacatctgggttaggtcacaggcccactggagcatcggatgagggctgagtccctctgcctaggaaataatctataaggacatgcccagaactaatatgctatggaccatgtgtggggcggtcccttccaaagtttctgaagaaactttttttgaagtgaagagtttctaataattagcactttccttgccccattatgcaactagtaaaacagccccagttgaaggtgcattccccaagaatctgaggacaaggtcccccttgctcttttccctgccaccctgcccaggaagagtctctcaccgcagatggagccagctgccacgatgaagccagcccacctgtagccccgctggtagaaggcatctgcaagcgctgagtcggggtccaggctgtgccagggcaccatgagggttagcacggtggagacaaggatgtaggcaccagctgcaatggcaagcgagatggcgatggccagaggcacagaccgccgtgggttctgggcctcctcactggaggcggcaatgacgtcgaagcccacgaaagcatagaagcaggaggcagtgccggccatgacgccggagaagccgaagggtgcaaagccgccttcgtcagcgctccagttgtgaggctgggccaggatgaagcccaggatgacaatgaagagaatgacaagcaggctgatggccgagaaggtgtgattgagccaggaggacacgcgggctccacaggagacaaaggcagaggccaggaggatgatgccagcagccaggaagtccgggtagtggcccaggaggggcacctgccaagaacccacgtgggtctcagtgaagttgcggatgctgtggctgaacatagagtccaggtagccactccaggcacgggccacggcggcgccaccgatgatgtattcgaggagaacattccagccgatgaggaaggcccacagctcgcccatggatacgtaggtgaacaggtaggcagagcccgtgcgtggcacacgtgccccaaattctgcatagcatagggctgccagcagggaggccacagcggccacaccgaaggacaagagcacagcagggccagccacctccttggccacggcacctgtgagcacgtagagacccgagcccaccatgccacccacgcccagaagagtcaggtccagcgtggacaggcagcgccgcagtgacgtctccatggtggagtcctccagcggcttcaggcggttcagcttctggcataagcgtgccaggctagcaatggtgggcagcccccgggccatggcaggtggccgagaagagcaccgagccagctactggaacctgctagggccagaggggaatgacaggatgcgtagccggggcctgaccagccttccatccctcctggtctgaccacccccagtcctctctctgtccctgacctggggacctggacaccctcaccaggggcctgctggagagctggaatggggcaggtgtcagaacctgtgggcaggaggtcacaggaagcctggaggccctgtctgcatcccaggcagcaaaggaggcctggtgaggccccacctgctcacccgctcggtggccctgaggggtggggagggagcagctccagggggagcagggtgagaggctgggaacggctcagtggtggggtcccagagccaggtgaaaccgaggcttccccagagtcgagccggacccggaacaggagccgcggctctgcgtcggggcgggtgtggcccaggcagccacctggccacagacagacagtggcggctacatacacccccgcccctgcacccgtggccaggctggggtatccgcgcgccaggcggaatgcaggggcgccctgggcccgcacacctccccatgtccgacacgccgctgctgctagagcctgctccgccgcgcccccgtccccggacacctgcgccttcgcctgttcttgggcctgagcccgtcccagtccccgtccccgcaggatctgctgcaacccacctgctgctgccgcagccgctgcctccgctctgagcactgagcccgcccagttcgccggcgccgagcgcagggcccgcccccatcccaggccccccgcgcggccccacccgctgccacacacccagatatttcaccctgcccactctgcccgacctcgcaaggtcgttaccggagctcaccggggtctagggaagccctgtgactgtgactcagtcacagatggagaaggtcagaccgccggctgactgactagcctaggtcagttcggggaggttaagggccacgtctgaaagtccgcagcccaccttctttctactgcagcggacacccttcttgatccctcaccccagtacatgaaccccacccagctgggccccagacaggccccacagcaccgtcatgtgagcttcaggcacagtgagttagatgaagacatgggtctggcagagtggcctggggcggtccctgacctctactcttacaatggaagagactgcagccttttgagagagttctgcgaattgagggaatgcattctggctgttttgagcctgcagctaccacgtcctgcaaggaagcaagcagcttctgggaccagcctgcagccctcctgtgggggagtagagctcctcagaccccagtggcagcccttcctagcctaggcacctctggcaggccgggagggccctatgggaccccaatagcagatccccacttgtgtttatcagcgacagccactgtgtcctgagtactgcattccagtgccccacgccccaggcaggcagctatgcaacaatacacctggctaattttttaattttaatttttttagagactgggtctcactatgctgcccgggctggtctcgaactcttggcctcccaaaaggctgtgattacattcatgaaccatggctcctggcctccccagaacgctatactagacatgtgttcaggcttacatgtggtttgtggaatggaatcttaggagcatctgcagcctatccagcctattgggctggtgacaggatgatggactcccagacaagatggtgccaatttggaacattctgcctcggccagaatgccaataccttctaatatttggctggtattgtcttgaggaacttctcagatggctcccacttccggtgggatggtagcttccttaccccatccctgtgttgcctgagcagacgtcccttgtcctgaaatgtcaccacaaaagtctaggcacttcaggccagagggttaggcagatttgtaatgggagctccccaaaggccttaccaatgactgccttattgctggtgtccagtgttttggagtgttgactttttatctacctggagaaggtgtgacaccacaccctctgccacaggcaccaacatacaacggatatgtgagactaagcagggctgatgcagtaaattgtacatttccagagatatttccctcactactgagtgagacagctacacagagcaaccccacagtgatgcagtgaagacaaaccaccaggaaacaaaaactttctaactcattctgcaaggccaggattaccctgacactaaactcaacaaagacatcacaagaaaagaaaaccacagaccaaaatcccttatgaatatagatgtagaaatccccagcaaaacacagtggactcttgaacaacacaggtttactaatacatagatatttttcaaccaaatgtcgatcaaaaatacagtatttggctaggcccagtggctcacaccggtaatcccatcactttgggaggctgaggtgagaggatcacttgaacccaggagtctgaggctgcagtgagctatgatcctgtcactgcacttcagcctaggtggcaaagcaagaccctgtctccaaaactactaaataaataaattaaaataagtggtgggtgcctgtaatcgcagctacttgggaggctgaggcaggagaatcgcttgaacccgggaggcagaggttgcaatgagctgagatggcgccattgcactccagcgtgggtgacagagcaagactctgtctcaaaaaaaaataaaaaacaaaaaacaaaaaattcatatggaaatgcaagggatccagaatagccaaaatacttgggtattttgcctgggtaacatagggagacctcacctctacggaaaggtaaaaaaattatatgggcatggtggcatgtgcctgtggtctcagctactgggagtcgggggtggtgttgaggtggaaggatttcttgagcctgggaggttgaggttgcagtgaggcatgtttgtgccactgcactccagcttgggtgatagtcagaccctgtctcaaaaaaaaaagaaaaaagtaaagaaagaaattaaaggcaacataaataaatggaaagacatcccatgttcatagactgtaagactttaaatataaaatggcagtattccccaaactggtctacagattcaggggttgcatagattgagtgcaattcctattgaaatcccaactacctgttttgcaaaaatcatcaaaattcatgtggaaatgcaagggatccagaatagtcaaaatacttttgaaaaagttttggaggacttacaattcctgatttctaaactgattgcaaaatgactgtaatcaagattgtggtggtgacataagagtagacacatagatgaacggaatagaattgacagtccacaaataaacagttacatttatcgtcaagtgattttttaaaaatagactttattagctgggaatggtggtacacgcctgtagtctcagttactcagaaggctgagttgggaggatggcttgagcctaggaggctcaaggctgcagtgagcttgatcatacctgtgaatagcctcttcactccagcctgggcaacatagcaagaccctgtatctaaaaaaaaaaaaagttgagttttcagagcagttttatgttcacagcaatattgagcagaaagtacagttcccatatacttctgctcccacacacgtgtagccccctctcccactactgacatccagcaccaaaggggcatatttgttacaatcgattaacctacattgacacatcattatcacccaaggtctatagtttacattagggttcattcttccggttgtacattctatgggtttggacaaatgtgtaatgacacatagacacaccattattgtatcacacacagtagtttcattgccctaaaaaccctctgtgctctgcctgtccctccctgctaacacctggcaaccaccgatctttttcctgtctccatagtctagtcttacttttgcagaatcttatatagttgggattatagagtatattgccttttcaggcttctttcccttaataatatgcatttgagattcctctatgacttttcatggctgaatagctcgttttaattttattttttatttttgagacagagtctcactctgtcgcccaggctggagtgaagtggagtgatcttggctcactgtagcctctgccttcaggattcaaacgattctcatgtctcagcctcccgaatggctggggactgcaggcgtgcactgtcacaccaggctaaattttgtatttttagtagaaatggggttttcccatgttggccaggttagtctcaaactcatttcctcaagtgatacacctgcttcaacctccccaatgtgctgggattacaagcgtgagccacccaaccaggcctgtgctatttctaaaatgcaggagatgaagttgccatgtgaaagatgcaacattcttatcttcaaggatgagaagttgaaatgagagaattctatacagaccttgttaaaacactgttatcttttaagcctccccatataatttagttgcctcttcataacttattattatttgtccaattcagtgtataagtaacagactctaacttcttctttgggtcttcaaatgtccttatgagggttcccaacccatgtaaaacttgtactcaataaatttgtgggactgtgtggtggctcactcctgtgatcccagtgctttgggaggccgaggggggcttgcttgagtccaggagttcaagaccagtctgggcaatatagtgagatcccggttcaacactttttttttttaattagattggtgtggtgggtggcatgtacctgcagttccagctactcaggaggctgaggtgggaggatagcttgagcccaggagtttgaggctgcaatgagctgtgatctcaccactgcactccagcaccccttatttataaataaatataatggctagccttagggactctgttcgcaagattaaagaacagaaatcagatgtagaatagcatataaataaatttatgtgcttttcttctgttaacctgtcctatgtcaatttaattcttgggcccagctgagactctagggatggaagtggagttttgccacccctacagtttctggtgacaaggatgggatcctctcaagcctaaagatgggatcctgggagaacaaataaaagcgggcacaggtaggaattcttaccaaagtgaactctttttttttttttgagacggagtctcgctctgtagcccaggctggagtgcagtggcacgatctcggctcactgcaagctctgcctcctgggttcacgccattctcctgcctcagcctcacacgtagctgggactacaggcacccgccaccacgcccggctaatttttttttgtatttttggtagagacggggtttcaccgtgttagccaggatggtctcaatctcctgacctcgtgatccgcctgcctcggcctcccaaagtgctgggattacaggcatgagccactgcgcccagcccaaagtgaactcttctggatctctgtctgtaatgcctggttgaaagaggagagtaaaatttttccttgtccctttctaaattcaaactggcaggagaaaagcatggtaagaattgattctttgagttatgactcttatgtcaaccttaaataatgagattcagaaaatatcagctaggcacgttggcttatgcttgtaatcccagcactttgggaggccaaggtggaaggatcacttgaacccaggagttggaggctgcagtgagctataattacatcactgcattccagtctgggtgacacagacctagtctccaaaaaacaaaaacaaaaaaaaccaaaggaaatatgatttttattctagtgcaaagcttgaggatggacacccaggaaacagcttccaaagggttggggtcattgctccaaagtggggaagctaaggtttcactcatagaggcagaaacagtgtcagcaggattgcaacatcttctgtacaaatccagtatgttagattccattagtacagcttgctacattccaaggaaaattgtttcaacattctgtgagaagaagtcaagctctgaggtcatcttatctctgatgctgctcagacatttctaaccatttacagggaaaagcagaagttgcaactgcatgctccatgcctcaggccacatggccacattcctcctgaggctcataataatgtaaagttccaacagcttggtggtggctcacgcctgtaatcccagcactttgggaagctgaggtggctggataacttaagaaaggagtttgagaccagcctggccaacacagcgaaaccccgtctctactaagtatacaaaaattagcccggcatggtggcgggcacctgtagtcccagctactcaggaggctgaggtgggaggattgcatgatcctgggagtttgaggctgtagtgagccatgattgcagcactgcactccagcctgggtgacagagggagaccttgtctcaaaaaaaaaaaaaaaagaattatttgatttcacacttccgaatttggtatttggctctgcatacatagtggctattgacccacagcctcccagaaataaggcttgttttccatgtctctgttgtgtggtttatcatatcttgttttatgtcttgagaacatggctctgtgaccaattgaaatattctctttggtttctgccagctgcaggggttgggaggacaagtccttgttaggctgctagccagctgcccaggaatcagaaacacagtgtctctgtccaacggttccagctctcagaggagtttgtcctacttgtctcagctttcattgccttgataacaattaggatatttgcctgcttaggctatcttgaaaaagactttggatcttgagggggattgtatcttttccagcctgtttgggatgctcttctgtgcctccagttaagccagaaaaggcatactgattttaagccataaaaaggcttattggttttgagtcacaattaaagtaggtataacattgaagatttggacttttgaatctaaaagctttttttttttttttttttaagacagagttccgctctgttgcccaagctggagtgcagtggtgcagtcttggctcactgcaacctctgtttcgtggattcaagtgattctcctgcctcagcctcccgagtagctggtattacaggcatctgccaccatgcctggctaattttttgtatttttagtagagacggggtttcaccatgttggccaggctggtatcgaactcctgacctcatgatctgcctgcctcagcttcccaaagtgctgggattacaggcatgagccactgtgcccagcctaaaagtatttttattaaagcgtgctattggccaggtgtggtggctcacacctgtaatctcaaccttgtgggagactgaggtgggaggatcgcttgagcccaggaggttgagctgcagtgagctatgatcttgccactactgcactccagcctgggcaacacagtgagaccccatctgtaaaccgtccccccccacaaaaaagggtgctttcatcccaaacaaccgtcctattggtaactagagaaatatcaaattaaaaagaagacacaaagaaatataggccaggcacggtggctcatgcctgtaattccagcactttgggaggccaaggtgggtggatcatgagatcaagagatcgaagccatcctggccaaaatgttgaaaccccatctctactaaacatacaaaaattagccgggcgtggtggcgtgcgcttgtagtcccaactactcaggaggctgaggcaggagaatcacttgaacccaggaggctgagtttgcagtgagccgagatcatgccattgcactccagcctgggtgacagagccagactctatctcaaaaaaaaaaataaaataaaataaatatggttagctttagggacttcctttaatcttcctcaatattaaagaacagaaatcagatgtagaaaaaaagttgaaatctgcaccctctgtaaattatcctcctccacccacctgtgctctgctcaacccccaagtccctgtccctgatcccccagaaggtctttcggatatctgggcccctgacttacacttaccctcctcaaaacttggccctattctccttagcaaatttcttttagacctaaaacttctccaaatatcctttcaatgcccagctgcctactttaacttctcttttcctataaaattcacagaaagcaccccagcctgttttccaggcccaagatatacaggtgacatgtatatactgatagccagaaaatagacctaacacaggctctgggaatgagcagccaggcttgcttcactgtaccttacaattcctcctacttcctggggctctgtaatcaaatctcatcagctccaggcattcccatgtttaggccgaaaccacaaaaaagtctactggactatcgtactcttaggaaaaagaaaccataaaaattaccctagatctctgataacaaaaaatatgctctgaaactccttggagaaaatctacattctttctcagttttcttgctctgtcgccagtcttatcatatctttaaaacttaagggccaggcacagtggctcaagcctgtaatcccagcactttgggaggctgaggcaggcggatcacgaggtcaggagatcgagaccatcctggctaacacggtgaaaccccgtctctactaaaaatacaaaaaaattagccaggtgtggcggcgtgcgcctgtagtcccatctgctgggaaggctgagacagcagaatggcgtgaatccgggaggcggagcttgcagtgagccgagatcgcgccactgcactccaacctgggtgacagagcaagactctgtctcaaaaaaaacaaaaaacaaaaaacaaaaaacacaaacttaagtatctgaggaactgggctgggcacagtagctcacgcctgtaatcctagcactttgggaggtcaaggtgcgcagatcgcttgaggtcaggagtttgaaaccagcttggccaacatggtgaaaccctgtctctactaaaaatatatatatataaaaattatccatctgctggggaggctgagacagcagaatggcgtgaacccgggaggcggagcttgcagtgagccgagattgcaccactgcactccagcctgggtgacaggacaagacaccatctcaaaaaaaaaacaaaaacaaaaacaaaaaaaaacttaagtatctgaggaattggctgggtgcagtggctcatgcctgtaatcctagcactttgggaggtcaaggtgggcggatcgcttgaggtcaggagttcgaaaccagcctggccaacatgatgaaaccctgtctctatgaaaaatatatattaaaaaagttagccaggtgtggtggcatgcacctgtaatcccagctacttgggaggctgaggcaggagagaattactggaaccactcgggaggcggaggttgcagtgagctgagatcatgccattgcactccggcctgtacaacagagccaggctccatctcaaaaaaataaaataaaataaaataaaagaatctgaggaattaactagaacaacccccagtatgctagtctgagattaaaaaaagtgttgaatgtttaacattttaggtgctttacttcaataatgtttgatatttgcctaatatatatgtcataaaaattgccagcaaaataaaacttaagataataactagctttgtctaatgtttcatgaagttttcacaattcagatataattgttaaataaactaaacttatataaatgcaagtgggaaaaaatttgtaaataagttattattattattttttgagactgggtgttgctccattgcccaggctaaagtatagtagtgggactgtagctcactgcagccttgaactcctcttgccccagtatcctgagtagctggggcaatgcctggcaaatttttagaaaaattttcttgtagagtggagtcttgctatgttgcccaggctggtctcaaattctgggcctcaagcaacctcctgtcctggcctcccaaagtgctgggattacaggtgggagccactgtgcccagctataaataattttttactgttttaatttttatttttgactgactcattgctagccagagctcgggtttctgtcacccacagcctgggaggccttaagtaagtgattcaacctcactgagcctcactctttgcctctgaaatggggatcacaggaattcctgccaggcaggggatatgtgaagactgaacgaaatgattcacacaaagatgtagcccagtgcctgggggacactaagcacatgctgagccttcagccacctgggaaggataaagggaaacacgggtggccacctggggctgatggaggaatgaggggcccgctgggagtatcctgggcaaactcacctctgggcatctgccctgatcttgggctggcgtcacaaggaagttggtcaccaagaagaacacgttctctccctaggaggcaagtctcaaagttggcctggctgggcttgcattgactggaaaggccagaagccggcagcctggtttatgagggaagggatgttggccccatgaaatcattaaccctgtccccacgtaaggcagattgaagcagagatgggaggctggcagcagttctggccatttctgagaccatgaagcctcatgcccatgtccatctcttgagacaagtttctttctcatttgttcaaccaaaatatcttttattttctttcttctttatttttttttttgagacagagtctcactgtcacccagactggagtgcagtggcatgaactcggttcactgcaacctctgcctcctgggttcaaaggattctcctgcctcagcctcctgagtagctgggattacaggcgcacagagtttcactttactcgtccaggctggagtgcagtggtgtcatcaacccttactgcatcctgtaactcctgggctcaagagatcttcctgcctcagcctcccaagtagctgggactataggctgtaactaccatgcctggcgtcaaccagaatattacgacagcctgctgcttctagtactgaagatccaggggagagctgggccctgcacctgccaggatggagtggaggtgagtctcccatcccacacacagcagcactggcatggcagggcacaggtgagaagacagaaagctctgcctgtggtcaaagggtggccaaggatgttggaaggggaggctgaccctccagtgctgcccatgagaacactgaatttggggaatgcatgcccaggaacggaaggtgagggctgtgcagagggtgctgagagtggcagccattgggattaggagggatgggtggccactatcattggcggggggcctcctgagggtagaaacaggggctgcaggctctcatgatgcctggtgtgaaagttcagcttggctgctgtgtggtgtgcaccaagcagtagggaggaggcgagaggggcatctaagggccttctaggaggccatagtctcatgcaggcatggcatgggcagtagtgaaaaatgttggaagggacaggaaggggttgaggctgagtcatgggtctggctgaggcactagtggatgtcacagccatcatgactagtggatgtcacagaggccatgccaggagagggaaataattgatctttggacatatgagtgtgcacctggaagacagctgtgctctgggcaggtgttcactggggctacatacaccctgggaatcagaggagcagaggtgggtggaagttaaggctgtggataagctgggtggagggaagaggaaaatgcagctgagaagggtggaggaggagcacctgaccgaggtgccccaggtcagggagcagggctacaggaagttccacgccctggccccaccacacccctcccacaccactctcaagctcaagccattagtctcaaacactcccttcttttctgttggcagccttcggaaatgcagtttctctggcctggtttctcaacccatccctttttctaccagaaacctcctacacatccctgaaagtcctgttcaggtgccactcctctgtgaagcccttcctgagaacctgcagccacctttggcatcacatgcttctctctcgcacacactggctgcatggcgggtgttcaagctgtcagtggggaaaggacttgcgcccccgtcagcaacatcagggcccccacctgaggtggcttcacgaagtcggccacatcccacagccggtttccaagctccttgatctgagtcacggaaacccctttgagtttggttgtgatggaaatctggggttccaggtcccgctcctggtagccttttttggcgaggagcgcccacctgggaaggagaagatgggcagtgtggtgtccccccagcgtgtagtgacggggcagagctgggccctacatgctcagttctctccccacaccctacaggctcccagtccagcatcctctctggccccacttcccactgtagactccctgaacgagacagaagctccagccatgcatcagagagccagtgccctcagacaatcaccttcactagccagcacccacccccagcctcagtagacccagctccgagcttatagactcccctgaccggagatatagctggtggtctctctgggggcctagtgctccagctctcacagatgttaaggacaatgtcttgtgccccctgggtggggccgtggggagggactgggaagcaggcaggtggacacacaggacaaacacacagcttgttcttgctctcctgtcttgtattgcctacctcccaccccgtcccattatggccccttcccctccagcccctaaacagcccaaccctcaacttcaacccagcaggaccaagccccacccccgacctcttcccttgcccctccagcctggccaaaagctcttctctcttaccctaccacatagacgacgatcccaaactgcagcagcctctgcagggcgcccccccaccagttcctggtcatcacatacttctccgttttataatccagaagcccctagtctgctgtggcccctggggagcccatgctgccagctcctgctagctgcgggcacatgagtcagcatggcagctgcagccgcagctgaacaggaggcaaagcagggcccgagccaggccacgccagccgctgttaaagggacacttccactaaagcaggatccagcctccaacacccagccttcagcccctaaccccagctgccctgcacctcccaccctccctacattctctttgctgggccctggtggcacacagaaaacagcagctctgtccctgccctctggcctcacttcctccggtgggagtggacgtggtgagaggatggggaaggacagctgttatcagtgctgtgagaagacggcctgagggcagcaacagccccgggggggctctgagtaaagcttcaggaataagtgacttctgagctgacgcttgcagattctgaagttcaacaagcagacaaagatggggatggaggttcccaggggagcgaacagcgtatgcaaaggccagcgcatgcaagagaactgagagccacagagtgagagggtgacctggctctgcgaagttccccaggccctcctgaaaagccattcccaagtgcagtgaagaaaacacaagctctggagtcaggcatgtttcccattccatgaaaggggggcgatgctggaaccgcctaggggaggcagggggataaacgcagcaaggcgcccaatccggtgcatggtctgtggcgcatgcagtgtatcagcccgggcgaggagcctcagcacaagccggccacagtttctacggcaaccgacaacaccgggttgccggggcgaccgccgcgggagagcgcgtcgctattggctgtggggggtgcctgttgctggacggcacattcggttggtcagcgcagccgcagactccgcccacaatcccgggccgcgctctgggcgcggggtcaagctgtctccgactcagtgtctgagactgcgagagggtcgtaaccatgaggggttcctgtgagaggtctggggaggatgaagagcagaaagaagaggctatggtggcctgtgggcgtctttcaggggtccccgaggccgagcagggtcccgaggccaattgggactccgacctggagacggaaggtgctcgggggagggggcaggcccgactcctcccctttgggggtcttctcccgcaggggttgggggaggcgggctggggctaaggccagcagggaacgtacccgcctgcggggcgcctccagccccctgccttcccttcattgctcctggaagcatcaggataaaatgcaaaatcccgccagacagtgcaccaagggctgtcccaccctgaaatgaaatcagagccgggttttcccaatccacaggaaaaactaagctaatggatgtatggaatttagaactatctcggttttttctcccgtaaaatgtttacaaaacatttgtggcctgcaatccaggttaaaagacacagcatgcaatttggcatcagacaggcagaggcctgactctggcaggattagctaccaccactagctgtgggatgctcagcgcaggccagccatgacttctactacaaacaacattgggttgcttgggctcatatttattaataaataaatatataaataaattatttatttattagagccagggtcttgctctgtcacccgggcgtcagtgcagtggcaggataatagctcactgcagccttgaactctgcactctagtgagccttctgcctcagcctcctgagtagctgggactacaggagaccaccacgtctggctaatataaaaattttttggctgggtggggtggctcacgcctgtaatcacagcactttgggaggcccaggcaggcagatcacctgaggtcaggagttcgagaccagcctggccaacatggtgaaaccccgtctctactgaaaatacaaaaaactagcccagtgtggtggtgggcgcctgtaatcccagctactcgggaggctgaggcaggagaattgcttgaacctgggaggcagaggtttcagtgagccgagatcgtgccactgcattccagcctgggtgacagagcaagagtctgtctcgaaaaaaaaaaaaagaaaatttgtctagctatgttgcccaggttgtccagctttcttttgatagccgtatgactttaaggaaaagatttgcgttgcctgaggcttgatgtcctcatctgtcatatgggagcagtggtcccaagaagcacaggaagcagtgcttctagaggcaaaacataggccaggtagtgacacagggcaggggaggacacaggtggctgtagctgtgcagggtccacattcgtccccctgtctcctgccaggcaccgatgggcttggagaactggtcagggacacactgtacctgaggtcttgccgggcccatagtgttgtgcccatctcctgctttctgcgccaagggagcgcccaagagctgaacctccggcaccgtggcctggggccccaggtaccactggagggacactgtatccaggcttacggggagaggcctcgggagacagcagccatgggagtgcccctgtgtctgtcccctacactccccagcttctgcctgtgtcagtcatgccctaccctccacatctgggagacagatgggattgaggctgtgacaggtggcgttaagggttgtggatcctgcaggctcctaacccgctggggggtcagggagagctgggggtggggggagaccttcacagagcctaaaaggagaagcaggtgtcacttaaaacaggtgggaaggggagggctttccagctggaggatgtggagtgggctgagccctggagcatgagccaggatagtggccagtgtgtttgctctgtctgtcccagggcgcccgggctctggcttcctcattgagctccaatccatatgtcaagcggctggaccttcgagacaatgggctctgtggggcaggtgcagaggccctggcaggtgccctgagcaaaagcagcagcatccatggtaggtgctgggtctggggcaggtgggcaggcgtgtcctccttttcctcagggatgtgcctccatcgttgaaagctgggccgtgtcacctggggcctgctggtgttgctggtggatagaagaggggcctcatcacaggagggggcatgtggggtggagttagaccctctgctgtgcagccgatgcctgatagaagtcctttcctcacccaccccacaccatcactcccctcccttgctggccagcatccccctcttcacctagcacatgggagactcccagtacctgaatgcaggatgggagagtccttccacacagagaggtgggagttgggcattgtaagaagcaggtaggcaatgtgggagtttgatggggctggatccaaatgccagttctgccactgaagagctggatacctgggcaagcagcttaacctctctgagcttcagtttctgatctgtgaaatggcccccaaaataccttatgggcttggggctgtggtgagcatgaagtgaaatgcactcctgaagtggtcagaagagtgtgtgacccatgtacgtgctccatgcatggccacttgggctattattgccaatcctggcaacggggctgtgagggcttctgaagtgggtggtgatatcactgccagatgcagccatcgacggtatagctgccccccaccacagcagtctctacagtaccaggaggtaggcggttttaaccacttgacacagaagctggtgggcacacagggagggggaggtcaggggcagaggggacccagccattgggagccagagccaccatgcaaccccaggacagttaacctgtaagtccccttcctcagcctcagacctggaggtttgggggatggcagaagtaggggagtgcctggctttgcatcccactggccgaggagtggttctgtcccccagatgtggacctgtcggagaaccagctgggagtggcaggagcccaggccctctgtgccgccctcacagtgaaccaggccatgcggaagatgcagctgtcagggaatggcctggaggagcaggcggcccagcaccttgccgaactcctgctggcccacacagacctgaagtccctggacctgagctacaaccagctgaatgaccaagcaggtaacgcctgcgcagggcaccatggccatgaaagctcagcttcctggggcagggatgggtgggggttggcaggaccgcgctgcacatcgccagggagcatgtgctctggttcctgctccccacaccccaccttgccccactcctcttccactccagccacacggaactcttcattccttccacaaatatctcattgcgcgctgctgtatgtgctgggcactgacttagccaccagggatccaccttgaacaaaaccaagttcctgacctcaagggacaatgttaacaacatcattctgagtaattattggtgctacaaaagaaacaaatagtttatgattctagagaagaacagggaccccctactttaaagaggtggctggggaggcctctgtgaggtgacatttaagctgaaatgtgcagggtgggaaggagtcagccatggcaagatcagagggagagcattgcaagcagaggaatagtgagcatgcgggcctgtttcccagactggcggacagcagtgtgcctaggctagggagccagggaagcgtggccaggctgtggggtggagagggcagagggggctgcagggctgtaggccgtggcaaaaacggtgaagattttgtttcaagtgaggtagcggatgtgattgggattccttgatctcatcactgtcatgcccctgagcatattcaggagctgtctgctttgccaggaatttgcacttctacctgcctctcctcaaatggtccaataatggtaaggatcacctgagaccctgggttaggcatgcagatgctgaccctggacctgctgaaccaaactcttaggggaatgctggtgaatctgtattttaatggttgccccaggagaatcgtctttttattttttattttttgagacagagtctcgctctgtcacccaggctggagtgcaatggtgtgatctctgctcactgcagcctctgcctcccaggtccaagcaattctcctgcctcagcctcctgagtagctgggattacaggtgcgtgcgacaaggcctggctaatttttctatttttagtagagatggggtttcaccgtgttggtcaggctggtctcgaactcctgaccttgtgatccgcccgccttggcctcccaaagtgctgcgattacaggtgtgggccaccgcgcctggccgagaattgtttttcagaagcactcctctgtctccagctgcttagagcaagtggggtgacatcagccttggcctgtgagaattgcctctggcatataactgccagagaaccagtttgccttctaagaaaattattgcaagaagtcagtgaaattaagtgaggtggccgggcccggtggctcacgcctgtaatcccagcactttgggaggccaaggcaggtggatcatgaggtcaggagatcgagaccatcctggataacacggtgaaatgccgtctctactaaaaatacaaaaaattagccgagtgtggtggcaggcgcctgtagtcccagctacatgggaggctgaggcaggagaatggcatgaacccaggaggcggagcttgcagtgagccgagatagcaccactgcagtccggcctgggcgaaagagcgagactctgtctcaaaaaaaaaaaaaaaaaaaaaaaagtgagacttggcaaggcactgtgcctatctgtaatgccaacaccacttcgggaggctgaggggcgaagattgcttgaggccaggagttagaaaccaaactgggcaacatagggagccccagtggtgacaacaaatgattaaaaaaattagccccgggcaacagagcgagactccgtctcaaaaaaaaaaaaaaaaaaaaaaaaaattagccccaagtggtgacatgtgcctgtagtctcagtcaggaggctgaggtgggagaattgcttgagcccaagatgtcaaggctgcagtgagccgtgattgtcccactgcactccgggttgggcaacagggtgagaccgtgtcttaacaacaacaaaaaatactttctttcctctttagtgcctgtttccctgttatgatgttaaaagcaggtactgtgatgtgcagctggtttctggctcttctgcaggcgctttcttgtgtgtataaatgttcgctttggtgttcctgtgagggttgtaggatgaccgctggagggttctgttcggccatgttgctccgccttcatctctaggtctcgctattttgcccaggctggtcttgaactcctggcgccaagaaatccttctgcctcagcctcctgagtcgctgggaccacaggctcacaccactgcctggctttcaccttcctttctctaccacccccatctcctctctaccacagctgtgccagccctgttgcctcttgcctagcctatggcaccagccttccatctggtcccccagcctcttgcctctgcccccacccagcccagtctatcctggacacctgccacttgctgaaatgctaatccagcctcatcacttcctaaggccctccctgactccttgccacttgtatgtgctgcctaagccccttggcttggcacacaaggcccctcagcatctctcaagtgcccattactccttcctcacctcactggcttccccctccccaggcccagctccaagcctgcgtgcatttccacaggtgcctctgccatttgcagtttcctgtgtctcctccccactgtgcataagcctgtgtgcatttccacaggtgcccctgccatttgcagtttcctgtgtctcctccccactgtgcatgcacacacccctggggaattcctcagtcctgagttatctcctctgtcctctttcctgacttcccccaagacaggctggccaccactctgttctcacgcctcccccttttagtctaaatgaatagctcacatcccatacatttgcatttgtatctcccccatgaaatgtgagttccttaagggcaccgcaggcccacattagtttcatgtctgtgaccctcctgcccagcagaggctcggcacgcagtgggcatcagtgtgatcttttgaaggagtgaagagagtgagtcagaaggtctctcttggtgtttctgaaggggagacacttggaccagccctggcagaaaacacaggactcaccgagcttaacgtgagctggaatcacctccggggcccaggagctgtggcatttgccaggggactggaggtatgaagcccccacctagtcggccctacagcctgtctgctggggcctgtctcccaggggccacctccctgtctctgcagctcctcggaaatgaaccttggatcttttaagcacagcttaaagactgtttctttaggtgattttaattttcctggcttcacttagtgaccacaatacactgtgctcaccgtcacatactttcctgaagggtcactgttgaatatcttgcaccttccccagacaccatagacacccagctgggaagggacatctgtgcagtctggtgacacatgctcactgttgggcatacgcaggtggtttcctgagatgacaccttgcacccttggatgccagcacagcctctcaaacacccacctgttcccttccatgttgtggttcatagggctcgggaatgggtggctcaagctggtgctagggtggtacaaggtgtctgcaatgtccccagtgccagataccctgtggggccctcctcaggccatggcagctgctgtcttgccctgatgcaggggctgaccttggggtcctgccccacaagatggcatgtcacactctgtcttgccagagcacctacccttctccccatcacagtacgctggacaggtttcatccaacagctgttcactggatcttgggatccctgccctctagagccattaagtgggtgtggagtccgatcaatgtttctggggcctgctgctgctctgcacacgcccctcccagtctctctgagggccattcacgtctacaccggtcctttcctgttgtgctctgggccactgggctctgttgaccaccatcatccaagctgcagccaccagggggtctgcatggcactttcctgacccttccttggagcctctccccttctgccctttatctcttatctttgcacctcagggctcctggtctctgaggctgtggcaccctggcttgctccactgtcagatggggtcccatgacttcactctttggtattctaggcaaacatcttccttaaagttctagacatctcatacaatggctttggggatcctggagcctctgcggtgggtgaggctctgaaggccaacaacgtgttggaggaactcaacatgaggtgaggatccccggggggacaccccaggaatcatgggctccatgatcttgctgctgaagcacacagtctacccgtgatggggattcccgtgatggggcttgagccacaatcccagagcagctctgtcatccttatcactggagtttataattttatttatttatttaaaacagcatcttgctttattgcccagggtagagtgcagtgctgtgatcatggcccactgcagccttggccttcccagctcaagcaatcccaccacctcagcctcccaagtagctgggactacaggagtatgtcaccaagcctggctaattttttcttttttgtagagacagtctcctgctggccttgaactcttgggctgaagcagtcttcctgcctcagcctcccaaagtgctggaattacagtcatggggagttcatcgttgttacatagagacctgtgattcctatagcacaggcggatggctgcgaattgcacacggtgtataaagcatctccggcagagcctggtgcatggtgggtgctccatgcaagctttcctcccttgcagaagacgagccagggccaggttctgtggctcacaactgtaatcttagcacctaggaaggctgaggcgggaggatccattaaggacaggattttgagaccaggctaggcaatatagcatgactccatctctatgcgaaatctaaaaattgtccatttccggtggcatacacctatcattcctggtacttgggaggctgaggcaggaagattgcttgagccgaggattcaggatttcaggctgcattgcaacagagcgagtaaaacgagcctagtctgggtggggcaaggcaggaccctgacaagtgggccccagtgcctgttttgctcagcatgtggctactggagcatgccctgtgtgaggggctcctccaggccaggcagcgtcccagcctagccaggaggcacaagcccagagggaagaaaagaggcggatgccagggaggtcacgggccagaggccagggaggtcatgggctgctgtggctgagaccctccccaggggcagctccctgtgggcaagaaggccccactcaatcctgcccagctttcctccccatgggaggagctaagactggaggcagccgcggaggctgaatacggaggtgcagccagagctggggtctgagaagtcagagagaagcgggactgactccggagacaaagtggtccagggcggtgctgaggactggagtttgggaacggcaggaggaggagaggccttgaacataagctaggtgattttctggaacaggcgttgtaatggtgataggcatgaggtgtcagctggggcagaatatgtgggagcacttgcagagctcagaggagcggcagctggtgtccaccaggacagggacgctttaggtgtgtttgccgtgtgattcctctgaacggtgtcatctccaccttttacctgttgatctgtccagggttcctggggtgtgagtggagggaacaagagacccaacctggtggctgcaatggcagctccagtgggcaccctggggcagtgggctctgcaccgctgcttggaaggttgcacaatgcatgtgcctgttgtttttgttgcagtaacaaccgcatctctgcgatgggagccctgagcctgggcctgggcctccgggtcaaccagacgctgaggattcttgtagtgagtgctagcctgatgactgagacaccagcacagacctgccctgtaacagtccacacagatccctcccccacagcccccacccaggggcagcaggcaggtgcacacaggctggctcactcccttgccactcaccctgaatctggggcctggccctcctcttctccccttcatccctcccagcctctctcccacatcttcttgctgcccttcctcctctgtgggctggggtgctgctctgctgaaggtggctgggcaccccttgtgtctccctcatcttctcccctgcctttcctctggccttgctgagacccaggccccacccaggtgttctgttggccactgctcaggcccacctgaggcctggtgttcccagctggggttccttcccctgggtttgcaggtggggagggagtgctgagcaggacagggagcagaagacagacacaggagggaggcaagccgggagcaggtccccaggggaccactgtgcccacagcaggtacgtgctgggggacagtattgccagctgggtatggacatccagctctgtcggccctcagctccccaccctagccttactgggcttctcccatagctctcctcccctgcttcctgcctcacaggaacctggacctctctgaagcatagacctgcgtttcgagtcacctcgtagacagtcctctaaatgtcccaaagacacgtgggaatgtgagagtccaacctgaacgcatacccccctctaagggccacctcctggtggggggctccttcttccttcttcccaagtcaccagctggggcccagagcctgcctgcccctcccttttccacaccctccctcccaccttctgcaggggctcaccctgctgactcctccctcttctgacttcctctcttagcttctgtgaacttgcgggattcctggctgcggttctttcttcccagctgctacccaggaccagaaacatgccctgctttaaaactgttggagttttatcccctctggataaacccaagctttgagtgcatcatgtcatgcggagctaggtgtggtggctcacgccaataatcccagcacttcgggaggctgaggcaggcagatcgcttgaggtcaggagtttgagcccagactgaccaacatggtgaaaccctgtctctactgaaaacaaaaagatgagccagatgtggtgatgcacacctataatcccagctactctggaggctgaggcaggaggatcctttgaacccaggaggtgaaggttgcagtgagctgagatctcaccactgcactccagtctggatgacagagcaagactctgtctcaaaaaaaaaaaaaaagtaacatagcatgtcatgggggatctgggctctgccagcccctctcttccaagttcagtgctctcaccccaagcttggagcacacacacacacacacacacacacacacacacacacacacacacggtactatttttcacccctgcctttgttcctctgctgttcttgctgaagtgtccagctccggccacctcacctgggaagctccgctgagccctgcccagatacacctcccctcccagcctttccctcccaggggagctggtgcacactcactcactgcgctgatcacaccacatttcatgatgcttcctttccctcccctctccccagcaggcaagttcttaaaggcaagggtgtgtcttgtgtgtctatatcaatcggaggcctctcccttcctttcttccctgacccagcagcctcaccagagcattctgtctgactatctgatggagacaccttctgagccgaaacagtgtggccatagtggctgtgtcctcagagatgaggagcccctccttccctttcacattgctctctggccttcccggacctggcttctcgcagctttgtgtgcgtgtttctcaggtgtccaggaatcccatgcgaagtgaaggctgctttggtctcctcaagtctgtccaggacaatccagcctctgccctggaactgctggatttctcagtaagagcattttataaacctcgtttctgatcctcccagcagccctgtgaggtatcataattttagaagaagaaagtgagggttacagaaatcaagagccctgcccagttacacagcgtggcagaagcagagttgcaacgggacttgaatgcaggcatggggccactcagctctgcccgctccagactgctggttccacgggatctcacctggggcacctgcctgggttcttcattggctgagagaggataagtggaggtctgggcatgatgctccctatccactgaggtttcgatctgcaggcgcagcacctgcaaggctgccctctgcccctcccctgactgtctgcaggtggactgtggtgctggaagcttcacttgagtggctgtgagagagattaggatcccttttcattcaattttgccactttttttttgagtcagggtctcactctgtcacccagttgcagtgcagtggtgtgatcgtagctcactgcagtctcaaattccttggctcaagtggttctcctgtctaagctccccaagcagctggaagtacaggtacaggtcaccatacctggctaaagtttttagagatgggggcttgctatgttgcccaggctggttgcaaacttctgacctcaagtgatcctgtgccatggtctctcatgtcttgggtcaattttgattttttttttttttttgagacagagtctcactctgtcgcccaggctggagtgcagtggtgctatattggctctctgcaacttccggctcccagattcaggcaattcttctacctcagcctcctgagtagccaggattacagatgtgtgccaccacgcccggctgattttttttttttttttggtattttttttagtagagatggggtttcaccaggttggccaggctggtctcgaactcctgacctcaggtgatccacccacctcggccttccaagtgctgggattacaggcatgatccattgcgcctggcgaattttgatttttttaatgtagaaaaagtgccaggtgagatggctcacacctataatcttagcatgttgggaggctgaggtgggaggatcccttgaagcctagagttcaagaccatcctgggcaacacagaaaggtccccatctctacaaaaagctttttaaaaaattagccaggcatgtggcacatacccgtagtttcgggtactcagaagactgaagcaggaggatcacctgatcccaggagtttgtggcttcagtgagctatgattgtgccactgcactccaacctggggaacagggccagattctgtctcaaaaaaaaagggaaggaaacaaaaaaaattgagttacaaatcagtgctgattctaaccctgatttttttcaacccagacttgagtcaaagcctttccagaaatgtgtctgtgtagtttcaattcttcaggtttgggacaaccgatgtcaaacgtccttaccatttccttctaatggcctgttcttgccttaaccatgtgcctgctgctctgagaattcctgtcagcactggatctgtcattctaaaagaaatagaatgtcatatggcattatcctgcctgaatatacacttacttgtcacaatgtatggtcattatcagaagcccctagtcttgtgggaatgccatgggctttggaatcagttcagggttgggaccaaatcctgtgtctatcaatgtgagatcctggacaagattctgagtcaaagaatcataaacgatcaatcaataacaagcctgggatgggcatgatggttcacgcctataaccccaggacctcgggaggccaaggcaggtggatcacctgaggtcaggagttcgagaccaccctggccaacatggcaaaacctgtctttactaataatacaaaaatttggccggagttggtagctcatgcctgtaatcccagaactttgggaggccgaggcaggcagatcacctgaggtcaggagttcgagatcagtctggccaacatggtgaaaccctgtctctactaaaaatacaaaaattagccgggcatagtggtatgcacttgtaatcccagctactcaggaggctgaggcaggagaatcacctccaggagaacccagaggcagaggttgcagtgagccgagatcgtgccattgcactccagcctgagcaacaagagtgaaactctgtgttgtaaaagatagaagaaaaattagctggatgtggtggtgctcacctgtaacctcagctactcgggaggctgaggcaggagaatcgcttgaaccagaaagcggaggtttcagtgagccgagaccatgccaatgcattccagcctgggtgacagagcgagactctacctcaaaaaaacccaaaaaacaaaaaaacaaagaaaaacaattagcctgaattgaatattctatcttctattccttaactgttgttatctgttatcactagtataatctgactagcccagattttattctgagctttgagggaaatagttttgaagacttatagttcaaggaaaatctttccctaggctcagacttgtgtttttgtgaaatggggctaacgtctaccccgcaaggccatcatgaacataagctgagatgacagacctaagggaaaggccttgcacagagaaggactccatcagtgccagttctgttcttcacaaccccttggttttttgtttttaattgaggaacaacatctatgctgaaaaatgcacaaagattaagcatagagcttggagaattttcacaaacagcataggtgtctatgtaaccagcccccagatctggaaatacagcatagccgggcatggtggtgggcacctgtagtccctgctattctggaggcttaagcaagaggatagatagcttgagtccaggagctcagggatgaagtgagctatgattgagccactgcactccagcctggtgacacagtacgatcccatttctaaataaataaatacagcaggcctctaaacatcccccattgtccccttctctcctggatcttactagtttgcgggtatgagactgtcatccacaggggagaagctgcccgaaggagcttctctgagaccttgcgtgtgtgagtgaaaaatggtgaagttctcagatagtaacaaagttcatccttgtaatgggtgtctccttaggatatccaggtgaacgcagagtttgatggccttgctagctcagtgaggggaattcttccagaactctgcataaagactggcgcttgcagagtggagtataaaaaggagttgctgccagtcttcagatcagccctgccagcgtctgtccctaagtgaccttggagtgtggcttcctcatctccaatcagctgctttgacctccagggtgaggagctctttgactcacgaggccttgttaccacttgtgtctgcactgagtcctcacgtcagccgtgtgctaagtccacacggtgctcacacacctgtaccctcctctgtgccccacggaccctgcactcatctgggccttcatgtgctctcactcattcctgtcacacaaacccctactaagtactgcacattgaactgggcatggtatccaagatgcccaagcaagtccctgccctccccatgttcatgttctggtgacctcaggaaactattaaaatgtaaggaggggtgcacactctacttttgagaatgcaaacgggcacagcctttttggaaggcagtttatcatcatgcactgagagcctcaaaactgcctgtgccctttgatacaatcatttgactaatgtgctctagagaaataaccagagatgtataaaagattgatgcctaaagatgctcatggggccggacgcggtggctcacacttgtaatcccagcccttttggaggcctaggtgggtggatcccttgaggtcaggagtttgagaccagcttgacaaacatggtgaaaccccagctgtactaaaaatacaaaattagccaggcatgatggcgcacacctgtaatccccgctactcaggaggctgaggcaggagaattgcttgaatcctggaggtggaggctgcagttctcaccattgcactctagcctgggcaacaagagcaaaactctgtctcaaaaaaaaaaaagatgcccatggaaatgctgtttatcataatgaaaattggaagtgtccccaataacgggattggccaattaaaatttggatatgttaaatgttaaaagccacatgctcaaagaacacttaaccattcatgaaaatacacatgattaatgttcagtgagaaaattgggaagaaaaaaatcacatggcagctgggtgcagtggcacgtgcctgtagccccagccattcagaggctgaggtaggaggattgcttgagctcaggagttggagaccagctggggcaatacaataagaccctgtctttaaaaatcaatcagtcaatcacatggcttgtctgacagttcctcaaaagcttaatcatagaattaccgtataacccattatttccattcctaggtatatacttgaaagaaatgaagacatatgtccccacaagaactcgtgcatgaatatccatagcaacattatttataatattctaagagtgaaaatgcccaccagtggataaatgcaatgtggtatatccatacagtggaatattatttggcaataaaaaggaatttgaggtgataccaatgttctaaaatgtattgtggtgatggctacgtaactgtgcatattctaaaggcaattgaattacagatgctttacatgaatgaaccgtatggtatgtgaacggcatctcaataaaactgtttcgaaaagaaggaaaaggacggacacatgctgaaaacgggtgaaactagaaaacatggcgctaagtgaaagaagccagccacaagatcacgtgtcgcatgaccgcatttatgtgaaacatccggagtatgcaaatctatacagacagaaagtagattatacattgcctaggtgcagagaaatggaagtattggaggttgacggctaaaggatgtggatttctttggggggtgataaaagtgttctaaaattgattgtggtgatgtgcgactctatgaatacgctaaaaaccgctcgattgtacattttaaatgggtgatttatgcggtatgtgaaatacatctcaagaaagctgctgcaaaaaatatcatacgggttgagcctagtggtattaaaaaagtataaatatggccaggcgcggtggctcacgcccataatcccagcactttgggaggccgaggcgggcggatcacgaggtcaggagatcgagaccatcctggctaacatggtgaaaccccgtctctaccaaaaatacaaaaattagccgggtgtggtggtgggcggctataatcccagccactcgggaggctgaggcaagagagttacttgaacacagaaggtggaggttgcagtgagccaagctcacttcactgcactccagtctgggtgacagagcaagactcggtctcaaaaaaaaaaaaaaaaaaaaaaaggaagaatcaggctcagcgcactggcacatgcttataatcccagaaatttgggaggccaagatgggaggatcacttgaagccaggagttccagaccagcctgggcagcatcgtgagacccccgtttctacaaaaaacatttaaaaattagctgggcatggtggcatgtgcctgtcgttccagctacctgggatgctgaggtgggaggatcactcaaacctgggagtttgaagctgcagtgagccatgattgcaccactgcactccagtctggttgagagagtgggaacctgtctcgaaaaaaaaaaaaaaagaatggaaggatcaaactgggcatggtgatgcatgcttgcctgtaggcccagcctacaagggacgctgaggcaggaggatcatttgagcctgggaatttgagcccagcttgagcaacatagtgaaatcctgtctaaaaaagaaaaaaaggaagaatcaaataattgttccaaagtctttcaaaaggagtattgagtcccaactcggcactttcctgagcagggatatgtctcctctccttctcactaaggagccagaaactcaccccttctcactaaaaaagtgagaaaaataaaaatagctcagagaactttgagctatgtgaggcacgcagaatttatcaggtccggagacatgaatatgggacttcaggcagggcatgatggctcacgcctgtagactcaggaggccaaggtgagcccaaggtgggaggatcactttagtccaggagttttgagaccagcctgggcaacatcaggagatccttgtctcctcaaaaacttaaaaaaaaaaaaagctgggcatggtggcacacacctgtggtcctgagtcaggaggttgaggctgcagtgagctatgaccataccagtgcattccagcctgggtacacagcgagaccctgtctcaaaataataataacaataatatgctgggtgcagaggctcattcctgtaatcccagctctttgggaggctgaagtgggtgaatcacttgaggtcaggagttcgagactagcctggccaacatggtaaaaccctatcttttctaaaaatacaaaaattagccaggtatggtggtgcatgcctgtaatcccagctacttgggaggctgaggcaggagaatcgctggagcccgagaggtggaggttgcagtgagccgagatcatgccactgcactccagcctggatgacagagcaagactctgtctcaaaacaaaacaaaacaaaacaaaaaaataataattataataatgaaaagaaaaagaaatgaatatgggacttcagtaacatatttcttatccatgcccgggggcaattgtttaaaggcattttgttcctgactagcttaacccattatcttcctgtttctggaatttatgatacaaagaataatgtatagacaaccaatagcttatgtcgttttaatataaattcttgtggccagggaagctgaagtgataggattgtttgaggccaagagttgaagaccagcctcagtgagacccatctcaattttttaaaaaagagcaattcttggtaaaccacttaggaactgcctcttcttttctcttaaaaacagcatctctggccaggtgcaggggttcacacctgtaatcccagcactttgggaggctgaagcaggcaggtcgcctgagcccaggggtttgagaccaaccctgagaacatggtgaaaccctgtatctacaaaaaatacaaaaaattagctgggcaaggtggcacatgcctgtagtcccagctattcgggaggctgaggtgggaggatcacctgagcctgaggaggttcaaggctgcagtgagccatgatctcaccactgcactccagcctgggcaacagaatgagacgttgtctcaaaaaataaaataggctgggcacgacggctcacgcctgtaatcccaacactttgggaggccgaggcggtggatcacgaggtcaggagctcgagaccagcctgaccaacatggtgaaatgccgtctctactaaaaatataaaaattagccaggcatggtggcacgtgcctttcccagctactcaggagcctgaggcaggagaatcgcttgaacctgggaggcggaggttgcagtcagtcgagatcctgccactgcactccagcctgagctacagagcgagactccgtctcaaaaaaaaaaaacaaaaataaaaaaacaaaagaaaaacaaaatgaaaaacaaaataaataaaataaaataaaataaaaacagcattttgtaactgctgctaattaagagtgtatattcaaagcaacttgaatctccgctccagggctgaaggtcttaaatgtggcaataataaactttttttttttttaagagctctgtcactcaggctggaatgcagtggcacaatcacagctcactgtagctttgaactcctgggctccagcaatcctcccaccttggctttccaaaggaaaagggattacaggtgtcagccacctcactcagccttctcccttctatttaccttctcccttctattttagtttgttattctccccttttaagagcttcttccttataggtttaaccctgataggcagacacactttgttctcattctctttttttttttctgtcaccacagaatattttgcatgccatagagtttcaaactgtcttgaaatgaacgggttcacatttatgttctggttcacagagtgagtatctctatccacgtggggcaggcaggtgtccagataggcaacgcccgctgggaactgtactgccttgaacttgcaattcagcctgacggtcaaatgccaagtgacaaaaccatcggtggtggggatgactccttcaacatgttcttcagtgagattggggctggcaagcacgtgcccagagcagtgtttgtggacctggagcccactgtggttgataggtcctcgggcactggatggcagctttcctgggagagtgggagagcattggtaaaaccccacgtgcgctcctgtgaatccccctgcagaatggatgggatagacaagcaaatgcccatggcattgttagggcggaaactgaaagtttcatgtttagtgtatgtgagactcagctcctaatttaggatgtatgggaaaagctgctttgccagcagtaagatgggctgtggagagattcccctgtggctgcctcagccctgcacaggtggccctgcctgcagggtgtggggcattgattccctcctgaatgctgtgcactgtctcatgctggtgcatgaagagtcttgatgtgcatcttaggcgtagaaggtaagtacagaacatccatttccttcatccagattagaagtcccagatagtttccaaagagagctgcaaagagatagtacctttcagtgtcccccaggaggtgacaatgtcacctgaaagcacgtgggacccaggccacacaggttgatgggactgcccttcagaagtcacactgacctggtgactgtccagtttgtaagagatttttaacttacagcctttgatgtagtagctaagggtaggaaagatgtatgtacctgtagaattaccagtgctgggggacgatgcgagagcttatttcccttcactgggaactgtttatgctgacatttatttatgtatttatttatttatttatttatttatttatttatttatttagagaaagattcttgctctgttgcccaggctggagtgcagtggcacgatctcggctcactgcaacctccgcctcctgggttcacgccgtcctcctgcctcagcctcccaagtagctgggactacaggcgcccgccaccacgtccagctaattttgtttttgtatttttagtagagatgggttttcaccgtgttagccaggatggtctcgatctcctgacgtcatgatccgcccgccttggcctcccaaagtgctgggattacaggcgtgagccaccgcgcccggcctgtgctgacatttatacaagaactgactttaacttcctagggccttaaattgcatttgtgattggttatcacagagacattttctaccagacaccgccactgttgacctacaacatgtagctcatgtactttgaacagcatgtactttgtagaagtgaacagtcctggaacgtgttcaccttggtgtacagtaggccttaaagactcacagcacatgtggtctctttgtaggtgaagtgcacacagggacctacaggcagctcttccacccagagcagctgatcagtgggaaggaagatgcagccaataattactccagaggccattataccatcggcaaggagaccttgtcctggaccggatccacaaactggtaagaagagaaggcttcatgtggacgttgtcctgcacaggagaataggccttggatggtgaaaggaaggtcattttcgcagcacttagagcagcatcttgagtccgactaagtctgcaacgtcttactatgaagtatgcgtggtgatttgtgcatagatctgtattgtctgcttttctctgcttcaaagtgtgatgcgtgttcattatggatagtctgaatccgtagcaactctcagaggcaaagagaagtggccccggcttggtggaggttggtggtgtggctcccacgggcattggctcacattgtctggtttctctcaggctgatctgtgcatgggactgcagggcttccccatcttccacagctttgggggcggcaccgtctctgggttcatgtctctgctcatggagcggctctcggtggactacgggaagaagtccaagctggagtttgccatttgcccagccccccatgtctccatggctgtgatggagccctgcaactccatcctgaccacctacacgaccctggaacattctgactgtgccttcatggtcgacatgtcagtgcaacctggacatcgagtgtcccatgtacaccaacctcagtcgtctgattgggcagatcgtgtcctccatcacggcctccctgtgattcgttggggccctgaatgtgtacttgacagaattccaaaccaacctggtgccgtacacccacatccacctccccctggccacctatgccttgatcatctcagccgagaaggcctaccacgagcagctgtccgtggccgagatcgccagtgcccacttcgagccagccaatcagatggtcaagtgtgaccctcaccatggcaagtacatagcctgctgcatgttgtaccgaggggatgtggtcccgaaagatgtcagtggggccatcgccaccatcaagagcaagcgcaccatctagtttgcaggttggtgcccgactggattgaagggaggactgggtgatgtggagtccttgtgccatcaggaagcagcagatctgcagaataatgctgcccccaaaggcccgcatcctttgcggttgcttgtctggaaccgtcaccctgcccctgttccatgggctaggctcatgggcataaatcaatgaaccagagtgataattaattcagtggtgtcttttgaacttcctttgtgagtcatcacactatgtatctgtggtgaggtttttgtgtttttttaagaaaaaggtattttttggaggattttggtgccccttgcttggacagcagaatttgtgtggaaaagataggttgaacttagtagaaattttatgggcattttggggaatcatgtgggtggtgtatatattttaacttgggcattattataaactgctctcactaagtcttgcttcatctaagtatgtccaggttgtgccgacatgtgtcataggtggcttcgttatcacccatgaaggcacagtcagaatgttcatctgtagaaattatacccaatttaaatgtcttttggagtgtttgatttaaagaaagactatcaagaatctttttgtgacgaaaacagcaccatctttatttctcttttgggaagcctagtaatgttggcctgtgtttgcctcagacagaaaatctgtccccaccttccactgacacatgaaagaaaccttgctgtcccctttcagcttttccaggagttggtgactaaatcctgtcgcttctccctctgctggacctctgcgtcctctgctttgctttccctccctcctctggctcagacatccactgcctctggggagaccactgcagtcagctctaagtgggaattcctactctgggcttctccttctctccttcaggggtgagcatggctgctggactagccgcccaattttgtaaataaggttttgtctgaacacagccaccacaccccttcatcgcagatcaattttgctgtccagcctcagagtggggtaggtgtgacagagtccatgtgcctgtaaggcctagaatttgtatgatcttgtcacttatagaacaggcttgctgacccctgctctagttgaccccatgcactactcaggatgtgttattctcaagttctgaaacttggaatgcttcccttttggttcccaccttggaatgtcacttcctactcaagcaagcacatggactactcttgctgctgtggtagctccattcaagtgatctttgacctgtcacctttgcatatttcacagtggcttgtttggtgggacagcagggggtatgaccttccccgtggtatcacagttgtgtactcacaatctatctgggtggaaaaagttgagctacagaatttcattactatcttgtaaaaccctttggagtaaataatctataaagaagacaagtagtgtacattttcagagggaagacagtctttacctgggcacctatcacatgtcacagttgctaggacacagcccttcgggcagcttgggatcctgccagggtggccacctccaaggctcttttctctttattccttggctggaaccgtcaccctgcctggcacagagaagggcttagtgaggtttgtgggggtgaactgagcattctcctcgtcacctacagggggtcttctgtttgaggaaaggtagccaccatttctaggtttgatacaagcttcacggaccgctttcttgcccttctctggcaggtgggcattaactaccagcccctgacggtggtccctgggggaaacctgaccaagttgcaatgggccatgtggatgctaagcaacatcacagccatcaccaaggcctgggcctgcctggaccataagtttgatctcatgtatgccaagcaggcctttgtgcaatggtacatgggggaaggcatggaggagggggagtcctctgaggctcgcaaggacctggcagctctggagaaggattatgaagaggtgggcatggattctgtggaagcggaggctgaagaaggcaaagaatactgaggggagggtgtggtgggctctcctgccgcccccagcatggctgctttcaggttgtttgcaattaaagtttctctataaaaccaagacctctgtgtgtcatgctgcttggctctgcctacaggagcaggtgggaccccagagcctgcatggacagtcagtggggtcccagcctgccctgctggcatgcggttggggtgcagcaggagtgtatgtacttaaggagctgccatggaagtgacttgacccaggagaaacaagccaagcgttgagtggataggtttcctaaattctaggaaagctaagtcagggtttcaactgaatttgcaatttttggggcttttctattgatgggatgtactggctaaaaagaagagcctagaagcagagtgtttaaatctgaggtctatgaatggggcgtgtccatgaaatccctaaagctgtaggtcaaatgtgtaaggtcaggacattttagaagggggaaagtgttactgagttctccacagtatttgtgacccacagaaggtcacaacacacccatcctgaccccccactgctccatggtaacctggaaggcagcatttaccctccacgcacacacacggtcaccttgcccctcagcattgtcaactgtcttggtagaaaaccttgcacctttcacttcaagtgaagtgtgttaacatctgtttgtaaaagacctgggaatccagatatcttttctcagaaccaaagtcagctccaggaagttgactcaaggtgaagtgacctggttagttcagctgtggcacaaccaggacctgcataaaaacctcattctatgtttgtgccataatatcatcaaaaaacagtagagaacatatgacccggaccctctgcatctcagaaagacttattatcaactgaaggagacaacacgtagcctttgctggggacagtggtgtgacaagtctctggcccatcctaggtgctgccccgcacctgctgccttcttccaggcccaccccacttgggcagcctggtagcgctgggctggcggggtgtcctctggctggatcctttgcggccgctgcattccaacagggccggcactctcccgagggaggtgctgtctttgtttctccctgaggagacacaaagcgcagccaataggaacggacgagccccgtaactgcagcacctactgaagtgtgctccttgagcaacatttgtgtctgcacatttccctcaaagccacttcaagctgaaagccctgtatcagtcctgagtcctgaggctcagaactgccaaaggcaggtcatgccccagaagcccttggccacgggtccatttagggaagggtaagggtggctggtccatacttggcctggacaaggaacctggtctgccctgatggcgccaagcagcagcagcagcagggacttgccacttcatcctccaggtgtgttcacgctgaactgtacatctgagctgccttagatggtgacaggcaggaaacactccagtcaccaagtactggaattgggtttctgattttgattttggaagctctcacattgtttcctacctacccgagtattctgcaaacagtggtcaagccttgtagggagacaccctgaaactattgctatggaataaaagatgaaatgctcctgattattgtaaatacaaaattgcatgcaggattgtgtaaagacaatgccagcttggactgccagaacgagccaacagcacgtgatgtccttccacctgcagagagcctatgaatggacgtgcagtcagggaggtttcacatcaccaagattcctatcccagaaaagcagatattcatagctctgggaatggaatgcaacccttgtggagagcctataaacggatgcatggggggcgcctgtccatatggataagatacggctataaacgccctcatcttgccacagctcttctaggcctctttagggtgaaggcatactcccttctgagaatttctggtctaaccagttgtctagcttcacgtcctgtttccatggattgtttgtaaccagcttttgttgcaattgttactgctgattaatatcttgctaatcataggttatggaaagactgtgtttctgttctaagactctgttagaaattactgatgcacacactatattgtaaattcttatctttgtataccgtacttctacatacaaatgtactgtacttctacatacaaatgctatgttaaagaattacttcatccccatgtgaccatctcacctcataatcaaatgaccctaaatccctcactaacctacccccgccctcactaaacttaatagtaaatgctggtatatccagtgcattgttggcaccatgggaccagaaggcagtgaccccctggacccagctttcactatcttgtgtgtgtctattatttctcaacctgccaatccacctaggagcaaagagagagccccattgcattgcgggctgctggccagatccctcaataaagcctctcactctggagtttagctactggattccatgactgggttcctcccgtggtctgaatgcttgagactttccttctgaccaccagagaatcccagatgaagaccactggttcagatttccctcgatttgtaatttgcttactcctttttgtgaagatagaaagatctgcaaccacacttgggccagagctttattttaacgggatggatttccctggacttggtgttgtcagcatcagcaagaccgagaggaccctctagaggacaaatgtgcttgggtagaaggcttgcccatggggtcacagccccccatgtggagtaccttggccagggctctcctttgctctggcctggtagagtctgccccatgggctctaaccagggcatgtgtcccctgcttgactcacagtgttgggtctcccattttgtccccccagctttgtcctgaccaagagtgtgccttgactgctctgtgacctggtcagctgtatgttccccctgcaggctcaaaccctagctggggccttgcttcttaccagacactgataaacatgttgtttgttgcctgaaacagtaaaagatctgacatgttgctaagcatgtggaaactggccccgccccagccaaattccttgcacccttatataaactccacactccaccccctcactgcagcatgcctaggcagaacctccatccttgccgtccctcgtgaggccatactgcagccttgtgtgtatggaagttcccctaacacatgctttggactgaccaccctcacattaagtgcttcttcctttggaattccaactggctctcatcccaactggctctcagtcacccaagtggaaggtctggggcagtcccttgcgggagctctcctgccaccacttttggggtgagaccagatgacggttcagccaacagaacactcagcctcaatcctggttcttccctggcctcttaccaagtttagtcaaatcacctgcaattggaaactgcgctcttgaaaaaaagatgcaaccaggtgttttagggatccatgaggacatttccgtttcaccatttgtcatcttgaacaagtggaggctcctgtgtctgagacgccatggatcttggctactccagaggccactccagctccctttccatgccaatactgaaaagaaaattctccccaaatccctgcagggataggatggccctccttgtgagagtttctggggagttcttcctcagagaatgagatctttgctgctcggtgggtggtgaaggttatggtggtgtcacgcttggaactctgtcagcttggcacactcaactcaagaaagacggagtcagggttgcccagaaccaaggaggggtgcagccagaagcatgtggtgggtgaagtttggccacctcagtctaccagtgactcgtggaaaaggcacaaagcagagaatggccacctcgcatttcctttggtacaaactgccattattttagtctccactgactggtcgggggaaggaccccatctcccatgagcagatgagccccaccaccctgcagcagctcccacaatgggccagcatcctcctctgaggccacagtccctctgcgggccaggccagacagagtcagagcgtctgtagccgcggtgtttaggtgtccccgtgctctcagggtgactaatgtccagctccccacagcacacggcagggcagtctgcagacctgggcctgactcagagctggcttcccttcagcttggcaccatctgagcttcctctcttcccctcagtaatgactcggtcccttctggaaacaaggatgagagggaagcagaaaggaggaagtaagggttttgaaattttttttaaaatttttttggtttttagagactgagtcttgctctgtcacctgagctggagtgcagtgatgcaatcacagctcagtgcagccttgaactcatggcctcaagcaatcctcctgcctcagcctccagagtagtgggactacaagcatgtggccacacctgactaataatgcttacctttaaatctgacagggctgacaaacccttaacataactttgagccataatggatattaagaaaacaattctggaacccttcaggaatcatgtgctcttggggttagtgaggagccctgttcaggcctcctcactttatgaaggacgaggaggcccagaagagaacgacctgcagcatcttgcagtgggaaaaccagcttttttttttagctctgctcccttgggaggggctactgagtcagatgggttggacagtggggttgaaccaagtgttactgcaagttgggggggagggtggggtgactgatgtccccaggcctggtccctggagggtccttctatgcaccaaaaacagtcaatgaccaatgcatgttaaaacagacttcatgctataaccccaggctttgggaggctgaggcaggaggatcccttgaggccaagagttcgagaccagtctgggcaaaaacgtgagaccctatctctaaaaaaaaacaaacccaaaaaacaaacaaaagctgggtgtggtggcctgcacctgtagtcccagctactcaggaggctgaggtgggaggatcacttgagcccaggagtctgaggctgcagtgagccatgattgcaccactgcactccagcttgggtggcagagggaggctacctctaaaaaaaaaaattagattaacaaaacttaaaaatacaaaaataaaacaacaacaaaaccaaaaacagcctggctcattctcttcaaggtcagtgctcctgctactctgaaaccagctggtgaccactcggcattttgtgagcccctaacgaagcaaatctcaaaatgcagcagcctgtcagcctctcatgatctggggaatccctgaagctgcggagtgggccagaccaagctgggacgccctctgccatttacctttggtgtggcctatgtgagcccaactccccaccatttcccatctgggcagagctggttggggaatgaagatgtgtcccttctgctggtccccaagggtggcctttcttgtttcgtagtggcagcgcgaacttgcggcaacatgggctgaccaacatttgtgttaggaaggaaaacgggcagaggtgacgtgagagaactgagagggaaggaaaccaccactggccctgcttgagaagcagccgcagccagggcaggtggcatcagcagtggtgtctcactggcaggggcaggggcagcacagcaggccctttagtctgtggctcgcctaatactcctgtcggacagtgctgctccaacacattcatgacatgccttcagcaaacccaagtcaggggcatgagccacacatgcaattttttttttgagatggagtttcgcttttgttgtccaggctggagtgcaatggtgcaatctctgctcactgcaacctccacctcccgggctcaagcgattctcctacttcaccttcccaagtagctgggactacaggcatgtgccaccatgcccggctaattttgtatttttagtagagatggggtttcgccatgttagtaaggctagtctcgaacttcccatctcaggtgatccacccgcctcagcctcccaaagtgctgggattacaggaatgagccaccacacccagccacaattttaaattttctggtaaccactaaaataaaagaaaatgtggaattagaattcaaataatatattttaattaacccaaaatatccaacatattatcatttcaacatgtaatcagtacataagtttttcatgaaatgttgcaatcactttttttttcctttttatttaaatagagatgggaatctcaccatattgcctaggccagtctcaaactcctggactcaagtgatccacccaccttagcctcccaaagtgctgaaattacaggtatgagccactgtgcctggccctgcattcacttctgttcttttgtttgtagacactggatctcgctatgttgcccaggctggtctcgaactccttgcctcaagtgatcctcctgccctgcctcccagtgttgggattatagccgtgagctaccacgccctgcattcacttttgtgccagtcctttggcacctgctgtgcataacacacgcagtgcagtgaccatgccagccatatatagctcgtggttcccgtatcaggcagcacagctcatgtgagactcatggcttccacataccaaacgtcatcttacatgctctggacaactttaaaaaatgtgtagtttccctaaacttagagaccgcttgactgcatttagttttccctcaatgactccagaccctcaccacaagcattgcccgtctgttctggtgtcttctgtttcccctccctgtgggtatgagtgagcctggtggcggtggtccccgcaggctgtctggatggctgggggacaggcatccagagaggctggggcgcctgctgcagttcacagaggcaggcttgagtgggcctggcccgcggcctggagaactccacacccaagtcctgtgtgaaatctatggcctccatgccctccagctggatcactctgacaaccccctcttatgttctccaccccagattctgccattactggggcagctggagctccgtgtgtttggatgctgcaacacgcgggtctcagagagctctcggtatcccatctgcgggctctgcctctcactccgcagcacactcctggtgtggccccacctctgccccactcccctccaccttctccccaggtttccctctatccccacggggcatccccccagggcctctgtgccctcatatcctggccttctgccacccagcctgcaggacagagcccttgaagagcaaagaccctgaggggcccagcatgccaggccgctccagtcctcgtgttttgggtatcctctcacttctctcggagcccccgttcacccacacggcacccctgatcctcctggcccctttatgcccgtgttcccagcaccacgacccccgcatacatcttttttttttttttttttttttgagatggagtctcactctgtctcccaggctggagtgcagtggcgtgatctcacctcactgcaacctctgcctcccaggttcaagtgattctcatgcctcagcctcccgagtggctgggattataggcatatgccacaacacctggctaatttttttttttttttttttttttttttgtagaaatggggttttgccatgttggccaggctggtctctaattctggatctcaggccatccgctcgccttggtctcccaaattgctgggattacaggcatgagccactgcgtctggcccccgaatacatcttgactatgtcctgccacctccctcctcctgccctgggcccaccagcgcctggacagcactctgcctcgcccaccccctcccaccaccccagctcacaccttcggggctctgctgacccctcctgtcccgccctgtgtaacccttactgctctcctgctcagaagcctcctcctacctccatcattggcggtttttctcgccacctctcattggaacgagtgggaccatctcacttcactgccacaccctctgcactgacagacagccgggcccggcacccagaatccctgggtgaatggcaacatcccttagaatgacaaggactctgttcccagtttcttcctccccgtggaaacctgcccttcaattgctcatctcagcctgcagtccgtgcacccctaccccagcctgtccctcagcccctcctcaccctcccttgggcctgagctctggttggcagtgaggtgggcgctgtggggaggagcgtacaggaggtgcgaccagagccccttgggctctcacaggcccctggctctgggcccctggtttcatcacacctggtgacacctggaaggtggccccaactcaggagtgaggcgggcaaaggggctgagtgctggagtgtggccacgggaccagcacacggcatctgtgtggtgctgcccaggaggctcggagaaggcgggagcctctgtttcagcctccagacttcctgtcggggtaggggacagcttctaagaggcaaggtgtttgtcacgcctggggctgtgctctccagcacagcacaccacccctcagcctgctgtcctcccttggggtgggtggaattctttacagggcacaagtctcactcaccacagttcgcctctggggtgtgggatgttgatcctgtccccagatgccagcccaactgtgggccataccatgtctctaataaacagagccagaaatcgtgccctgtcgctaagccacagggcagcgttggcctacatggtcttgcccttgcagcttacaggttttcctgcctcctggggccgggcactttccatggaaacaagggagagcaccaaccaccagagataagccaataaccacgacctgagaaagaacaggcagcaagagaggcggagggaatggggtggggtaggggctggagagaaaggtgagtgtgtggcagccaggctgtggggcagaaccggagagcccgcaggccaagggcccaaggaaaagaggggttcgcagtggggttattgttcctggcagagaaaaaggaggcctctggaggtcagagagagacgcaaagagagcagacagagcgcggggtcagtgaggcctctgcgcaggtgcctggggcctctcagggcagggggactgggtgcccaggccctgcccccatgggggcagccggctctccgccccttctcaggatgcctgtgtgggtgtcctcatgcttccaggtggggagccagctctgggcctccttccagtggccggggaggttttgctgcatttcagagggagccgtcaggagcagaagcaacatgtggggaggaaagcagagacggaggctccaccatgacacactctcagcctcagcatctgctcagccccagtcaccatgctggagagaggaggcccttcaggccccgcaggcctctgtaccctgggagttctgcctctgactcttgtcctgcaatcctcagagggaagctggccagggctggtcaagcccctgcataggacctgggcccaagtggggtacaggcagggggtggcaggaagacttctgcctgccctgctccctcggcactttcctggaggctgtaatgccacaagacaggatcaaaactgtgctgttgtttttttttcgagaggagtctcactgtcacccaggctggagtgtaatggtgtgatcttagctcactgcaacctccgcctcctggattcaactgattctcttgcctcagcctccagagtagctgggattacaggcgtgtgccaccacacccagctaatttttgtatttttagtaaagatagggttttaccattttggccaggccagtctcaaactcttgacctgaaatgatacgcctgcctcagcctcccaaagtactgggattacaggtgtgagccactgctcctggcccaaaactgtcttttaaaaatatttttgggggtgctgggtgtggtggctcacacctgtaatcccagcactttgggaggccgaggtgagcagatcatgagatcaagatatcgagaccatcctggccaacatgatgaaaccccgtcgctgctaaaagtacaaaaaaattagctgggattggtggcgcatgcctgtagtcccagctacttgggaggctgaggcaggagaatcacttgaacttgggaggcggaggttgcagtgagccgagatagcaccactgcgctccagcctggcgacaaagcgagactccgtttcaaaaaaaaaaaaaatcttttttttttttttttttttttttttacagacagggtctcactctgtcatccagactggtctcaaactcatggcctcaaacgaccttccccccttggcctcccaaagtgcttggattggaggcatgagcccctgcgcctagcccaaagtcgtcttgattcctgactttgtggaatggaggcatgagtgaagaggtggggagaggctgaggaggaggagccctagcccacctggagcaccgtggggcacgcactctgcgtccacctggcctggacatgcctcctaaggataacagcgaagccagggagcagagcccacggatgggccctgcagctgctgggctgagaccgacagacaggcgtggtcactccgggccatgctggcgctgtgctgcccctgcccctctccaccccacctcccgaccactggggcagggacaatgggcccggctctgacttcgggcacgctcgtcgtgtgcagagacacggccgcagagtcctggggctcgctcgccatcctctgcccggcacacatcgacttgagcatctggaagacggccacgggggccacgttcaacttcacctggctctgaagctggccgctgtgggctgcatgagaatggtgtttctataaaacatgggaattgctggtcagacacagtgactcatgcccgcaatcctaccattttgggaggctgaggcgggaggatcgcttgagcctaggagtttgagaccagcctagggaacacagcaacacctcatctctacacacacacacacacacacacacacacacacacacaattagctgggcatgatggcatgcacttgtagtctcagctactaaggaggctgaggtgggaggatcacttcagcccagattgaggctgcagtgagccatgatcatgccattgcattgcagctacttgggaggctgaggcaggaagatcatgtgagcccaggagtttgaggttgcagtgagctgtgcctctaatcccagcactttgggaggctgaggtgggcggatcacaaggtcaggagttcgagaccagcctgaccaacatggtgaaaccccatctctactaaaagtatttaaaaaattaacctggtgtggtggcgggcgcctgtagtcccagttactcaagaggctgaggcaagagaatcgcttgaacccaggaggcggaggttgcagtgagccgagatcatgccattgcactctagcctgggcgacagagcaagactccgtctcaaaaaaaaaagattatgctgaaatttaccactattggtatgaatgatcagtattcaccaagcatatctgaacatgcaaatgtttaagaaataagcataataaggatatagcttgggttaataggattctcatagtttttttcccctatgaaacataagtaataattttagcatatttattatggattatactcatttaaaaaggactttaagaagttgtgctttgggaggcagaggcaggtggatcacaaggtcaggagttcgagactagcctggccaagatggtgaaaccccatttctacaaaaaatacaaaaattagccaggcgcagtggcgggcacctgtaatcctagctactctggaggctgaggcaggagaatcggttgaacccaggaggcggaggttgcagtgaactgagatcgtgccactgcactctagcctgggtgacagagcaagactccatctcaaaaaataaaaaaaagaagttgtggatgtgaataatacatttctctaataaaaatttaaattgtataatagtttaataaagtgtttacattcattgatttttttttttttaagacagagttccgctctgtcacccaggctggatttcaatggcatgcgatcttggcttactgcaacctctccctcctggtttcaagcagtcctcccacctcagactcccaactagctgggaccacaggcgcgtgggttaccatgctgggataatttttgtaatttttttgtagagatagggtttcaccattgttacccaggctctgtgctcaagcaaccagcctgcgtcagcctcccaaagtgctgggattacaggcatgagtcactgcacctggcctcagttatcctttctattacatcctatgatgttttcatagcctacaaggcatcaatttcttcttaataattgtcagtctggccaggcgcagtggctcatgcctgtgatcccagcactttgggaggccagggcaggcacatcacctaaggtcaggggtttgagaccagcctggccaacgtggcaaaaccccctctctgctaaaaatacaaaaattagccaggtgtggtggcgtgtgcctgtgattacatgctacttgggaggctgaggcaggagaatcacttgaacccaggagtcagagattgcagtgagctgagatcgtgccactgcactccagcctgggcaacagagtgagactctgtttcaaaataataataataataataatagtcaatctggttaaagaggtaacaatgatctattaatgctttgggaaaacaatttgggttgcctttgaaggccagggtttttagttcattcaaaaatatttatttaatttatagcatgtgccaagcattttttagcttcacagtatacagttgtgaaccaatcagataaggccctaaccatttttggcattctgtctagttggggtgggatgggggcttaattaagatagagatatagaaaaatgcgcatctatataacataagtatggagttgagaggaagcaactaacagtatgttagagatgttagaagtaatattttgcaggtttgtaacctctatttgacttttaagtttgggtagtgttaatagttgaagatagtgtaaaaaagccttaattttcactttccttgctggtaaaggtatgtttatttagactgttcatttatttatttctcactctgtcacccaggctggagtgcagtgctgcaatctcggctcactgcaagctccacctcctgggttcacgacattctcctgccttagcctcctgagtagctgggaccacaggctcccgccaccacgcccgggcaatttttttttgtttgtttgttttgtatttttagtagagagggggtttcaacgtgttagccaggatggtctccatctcctgacctcgtgatccacccgcctcagcctcccaaagtgctgggattacaggcttgagccaccgcgcctggcctagactacccatttaaagtagtgtttaacatggctgggtgtggtggctccctgtaatcccaggagactgaggtgggcagatcacttgaggtcaggagttcgagaccagcctggccaacatggtgaaactcagtctctgccaaaaatacaaaagttagctgggtgtggtggcaggcacctgtagtcccagctactcaggaggctgaggtaggagaatcacttgaactcaggaggcagaggttgcagtgagccgagatcgtgccactgcactctagcctgggcaacagagtgagactctgtctcaaataaataataaatacatacatacataaataaaaaaagtagcatttaacacaacaatcctgtgaaagcgattctattacatatccacaagctaattagctgcacactctttcctgtattttacaatttagcatgattttaggccccagtcttctcttcaaatcactggtgttttacatttggcaaagaataggaagttacttttgatttatggagtgattatattattactttaaaaatgtgttaatattttaggacagtttggagcctctatctttttttgagttagtatttcaattctcattacttattctaacagcttctaagtgaaaatagtatttaggcaattaaatcggcatatgttttcaggaattttctttcatttttaagttttgtcatcattgaggttaatgttttaacctggtgttcagttatgatatatataaacagtttgtgaagtgaaatagtcttaagtatgatgtgtgatgcacctacaaataaacgaaaatggcgtgcaccatgtctctttactgtgggaactgtactggaagatttatgaaagcatgtgacattgcacctaaagttgtgttattagtgactataagcagcagtgctaaatttttctattgtacttgatgaatgaatgcatttagtctagtcacagttactttggtttaaatgcatttgtctttagggtttgtattagttttcacattgctataaagaccccagactgggtaatttataaagaaaagcaatttaattgactcacagttccacaaggctggggaggccttaggaaacttacagtcatggtggaagaagaggcacatcttacatggtggcagacgagacagaatgaatgagctaagggagaagagccccttataaaatcatcagatcttgtgagcactcactcactattatgagaacagtatgggggaaacacccccataatctaatcacctcccaccaggtcccgctctcaacacatggggattatatggattacaactggagatgagatttgggtgaggacagagccaaaccatatcaggtttttattttttttagtattttattttattttattttttgagacagagtctcgctggagtacagtggtgcaatctcggctcactgcaagctccgcctcctgggttcacaccattctcctgcctcagcctcccaagtagctgggactacaggcacccgccaccaccactggctaattttttatatttttagtggagacggggtttcaccgtgttagccaggatggtcccgatctcctgaccttgtgatcggcccgccttggcctcccaaagtgctgggcccatatcagggttttaaaaaatgtgtttgtaatttgtactctcggcagggtattcttgggctgcaggggttgttgtcaatgtgtgatttgtgtttttattttatagaataatgtgatgtaccgatttttataagtgatagataattcgaataactgtatatttgacaacctattaaaatattttgcattggaacttctttcattaattgtaacatgctaacaaactgatagtggtttaaaaataactcattcattgaacaacaacaacaaaagaaaaaaggttaaaagtaaacatttttatgggaaatctcttatccaaaattctttcaagattttaccttatttagtgactagttctgtatttttgcatgaggaataaatatgtctctggaaggaaaaaaactattgctattaatagttatatgaaccttctagaacctaatctaataccagacaactgaggctaaagaaatgctagattgcagccccagtggccagacatgaatataagaaggaaaacaggctgggtgtagtggctcacgcctgtaatcccaacatatatatgtatatattgtggtggctcacgcctgtaatcccagaactttgggaggccgaggtgggcggatcacgaggtcaggagattgagaccatcctggctaacacggtgaaaccccgtctctactaaaaatacaaaaaaaattagcctggcgtggcagcgggcgcctgtagtcccagttactcaggaggctgaggcaggagaatggcgtgaacccgagaggtggagcttgcagtgagctgagatcgcgccactgccctccagcctgtgcaacagagcaagactccatctcaaaaaataaaaataaaaaataaaaaataagagtttagtcctcacatacctatgttttacatcaatccccaaatagttctttcccacaaagcatactggaccaatagtacagaaatgatttgtcaacttccaactttgtccagctagaaaaacactagaagccagttaaaatgtttgagcaagacaggacaaatgctctgtttcttccacaaacaaattgcaaataggaaaaaaggagggagaaagagcctatagattaaaagagatttatgaagtgtgctatccaaatgccaggtgcagactttgttttggcttctatgaaacaagtcaactttttttttttttttttttttgagacgaagtcttgctctgttgcccaggctggagtgcaatagtgtgacctcggctcactgcaacctctgcctcctgggctcaagcgattctcctccttcatcctcctgggcagctggaattataggcacccaccaccacgcctgggtaatttttgtatttttagtagagatggggttttaccacgttggccaggctggtctcgagctcccgacctcgtgatccacccgcctcggcctcccaaagtgctgggactacaggcatgagccactgcacccacccaaaacaagtcaactttttaaatgaagaaatttaaacaaacactgaatatttgatgattttgaaaaattactgttatttattttttcaatgtcatattactatggctatgtttttaaagaaagcccttatcttcttgaggtatactgaaatatttaaaaatgagataacagatgactggcatttccaaaataatcctttttgggaaaagggataagagtgaaatatgactgattatgagttggtaattgttggaacttggggttcatttttctagactctactttttaatgtatttggaactttattactaattgctatcactttcattaatactgattacagaaataaaaaatcaacaaatgaaaaattcaagacacccccaaaaaggaacaatgacattttcatacatgatatcatctactatttcaataatatctaaatagaggacagttgaggatgtgacatggaatactggggtagaatttttttttgaaacggagtcttgctctgttggccaggctggagtgcagtggtgtgatcttggcttactgcaagctccgcctcccgggctcaagaggctgagacaggcaaattacttggggccaggagttcaagaccagcctggccaacatggcaaaatctcgtctctactaaaaataaaaaaaataagtcaggcatggtggcacatacctgtagtcccagctacttcggaggctgaggcatgaagattgcttgagcctgggaggcagaggctgcagtaagccgagattgtgccactgcactccagcctgggtgacagagcgagactctgtcccgtgccccaaaaaaagtccattgtgattcttgtcgttgtcttactgttgaaatgtttacctaagtctttcgttcaaatgggatgctcgagaacacttcaggaaaaatgagaaacaattaaaattctccaggccaaacttctttatttatttatttggaaggagtttctctcctgttcccaaggctggagtgcaacggcgagatctcggctcactgcaacctccgcctcccaggttcaagcgattctcctacctcagcctcccgagtagctgggattacaggcacccgccaccacacccagccaattcttttttttttgagacggagtctcgctctgtcgccaagctggagtgcagtggtgtgatattggctcactgcaacctccgcctcccgggttccagcgattctcctgcctcagcctcctgagtagctgggattacaggcatacaccaccactcccagctaatttttgtatttttagtagtgacggggtttcaccatgttggccaggcatgcaccgccaggcctggctaattttgtacttttagtagagacggggtttctccatgttggtcaggctggtcgtgaactcccaatgtcaattgatcctcccccctccacctcctacaatgctgggattagaggtgtgagccaccgcacctagtctttttttttttttttttgtatttttaatagacacgggtttcgccatgttggccaggcttgtctcgaactcctgacctcaggtgatcagccgactcagcctcccaaagtgctgggattacaggcgtgagccatcgtgcctggctgccaaactttatttttaaaaacatttaaggctgggcatgttggcttacccctgtaatcccagcaccttgagaggccaaggcaggagaatagtttgagaccaggagttcgagaccagctggggtaacatagtgagaccccatcccaattaaaatatatatatattaaaaatattaaaataggctgggtgcggtggctcacacctataatctcagcactttgggaggccgaggtgggcggaacacctgaggtcaagcgtttgagatcagcctgtacaatatggcgaaacccagtgtctactaaaagtacaaaaattagctgggtgtggtggcatgagtctgtattcacagctactcgggaggctgaggcaggagaattgcttgaaccaggaggtggaggatgcagtgagctgagattacaccactgaactccagcctgggcaacagaatgagactctgtctcaaaaaaataaaaaattaaaaaataaaaattaaaatcatttaaagttcatttctttagaatatttctctcaaattataaatgtaatattttaagcttcagtaagttaaagttacaatacaataaaaaagaattactgtagcaggagaaaaataaaccatgagtgatgtagggggactattaaatggatattaattcataacagcatggatttttaaagttttttccttttttttttttttttttttgtgacaggctcttgctctgtcacccaggctggagtgcagtggcacgatcatggcttactgcagcctcaacctcctgggctcaagtgattctcccacctcaaccccttgagtaactgggaccacaggtgcgtgccaccatgtcaaaatcattttgtgtgtgtgtgtgttttttgtagagatggggttttgctatgttgcccaggctggtctcaaactcctgggctcagtgatcatctgcccttggcctcccaaagtgctgggattataggcgtgagccactgcgcctggccttttccttaatattaaatgaagtattatttatattacaaaccaattatttggagaaaccccgtctctacttaaaatacaaaattagctgagcgtggtggcacatgcctgtaatcccagctactagggaggctgaggcaggagaatcgcttgaccccgggaggcggaggttgcggtgagccgagatcgtgccattgcactccagcctgggcaacaagagcgaaactctgtctcaaagaaaacaaaaaacaaaaaaatacaaacaaaccaattattacgaaaatgctattggagaaagaaactgtaaaatctgatcaactgaggatctagcagtactaaaaaatatcaccattcaatcaggacaactagcaattctatattatatttagggaagttttctaaataatccattgcaaagtgaacaattgaggattaacagtctttgaagaaaaataattaaaaaggcaaagttccaaggtgaatgaagaactgatgcagaggaaacagatacatcagagagcataagaaaactttaaaaaattccagtgagtgtggtcagaaagagggaaaggggtgtttcctcacctcaccagctacacaatcataaagcagtgtagccttcatgagggaaatatttcaacccaagaattccatactcagtcaaatcaactaccagaacactgagggcacaatgagacattgcgagacattcaataacttgaaaacattaccatcctcaatccctatgggggaaaaaagaaatgttacacaatcaagcatgtatgtgtatacataatatgtatgtatgtataatacatctacatacatatagatattcctgctgcccacgaaaagactagcaaatcatcagaagagtaatccaaaaaacctgccgtgaacataaaacagtggcagctgactatgatctagaagcagcaaagaaagttaggaagaaaataggaggagggctaggcgcagtggctcacgcctgtagtagtcccagcactttgggaggccaaggtgggtggatcccctgaggtcaggagtttgagaccagcctggccaacatggtgaaaccccatctctaccaaaaatacaaaaattagctgggtgtggtggcggccgcctgtaatcccagctactcaggaggctgaggcaggagaatcgcttgaacctgggaggtggaggttgcagtgagccaagatcgtgccattgcactccagcctgggcgacagagcaagactccgtctcaaaaaaaaaaaaagtaggaggagctcttcagtacccaagcctgcacagctctctgcaaaagcagcggggcatctatctgccttctctctgggtccagtcacaccacgacttggctttgcagggaataaaatgtgcattaccataattattataaatgctatttactggttttcaattcttatgaccaacttagacaaaacaaagaaaacttcattatagtcacagaacataaacattatacattttgacaacacaaaactgatatactcctaattctcaaatgaaaataaattttaaggtggcagccacagatataaaggaaattaattaaaatacgattccatgttaataagctagaaagtattgataaaattgatggtatttctaagagactataatgacaaaatcagcaaaagaaaatctaaatagaatactaattttggaaaatatttggaaagaagtctaacaatatctcccactgaaaagcactgtatttgcatagttttgtaaatgaatactttgaaacttcattctctgaaatattctttttttgttttcttctttttttttttgagatggagtttcgctctgtcgcccaggctgggtgcagtggcgtgatcttggctcactgcaagctccgcctcctgggctcacgccattctcctgcctcagcctccagagtagctgggacttcaggtgcacgccaccacgcccagctaatttttttgtattttttagcagagatggggtttcactgtgttagccaggttggtctcgatcccctgacctcgtgatccacccgcctcagcctcccaatgtgctgggattacaggtgtgagccaccgtgcctggccctgtaacatattcttgaacacaagactggacgctttatagtttttcctaaaacttgatcataactctgatactacagtattccaagggtaatatacaaaagttaagaccacagactacagactactcctcatttgggaatatcgtttaaaaaaataataaaacatgaatacaaaaggctcaactgtgcaggtagagaataaaatgccatggctaagtgttttattctgggactgcttgaatgattccatagtattaggcatattaatctaaacaagaaaaatagtcaaagacgaaaatcacgatggtcttgaatagccatatttcaatattaatttctcattaaaagtcttagacttttagactaataagagtttttttaatgtttaaaaaaatctgactgggcgcggtggctcacgcctgtaatcccagtactttgggaggccaaggcgggtggatcacgtgaggtcgggagttcgagaccagcctgaccagcatggagaaaccccacctctactaaaaatacaaaatttagctgggcgtggtggcgcatgcctgtaatcccagttactcaggaggctgaggcaggagaatagcttgaacccaggagacgtgagttgtggtgagccgagatcgcgccattgcactccagcctgggcgacaagagtgaaactctatctcaaaaaaaaaaaaaaaaaaaactttcaaattaacattcaattttaatggaaaaagtctagaatataccttaaaataaaaaacaagtaaaatatttatagtaactacgaggaaggaggctttcacttttcatggcataccctcctgtaatgtttcaatttattagttttgagcatcctttttttttttttttgagacaaggtcttgctctgtcacccaggctggagtgcagtggcatgaacgtggctcaccgcagccttgacctcgtgggctgggaacacaggcacaccacagccatgcctggttaattttttagtttctatttttagtagaaatgggctctcattatgttgcccaggctggtcttgaactcctgggctcaagtgatcctcccaccttggccttccaaaatgctgggattacaggtgtgagccacctcacccagcaataactgtcttgtgacacaaacaggtggattggtgctgtcatcaataataattgtgactaattagctcatcaggtcctaggatggctttggggcagcagttggtgcaacttctggtaacttctgtcatcaaactctggttatgtggatgtctctgagtcatatcaatgtagtagcctcttctgagtaggaatggtatttgtgtgtctctgggtctgaatccctcgtgaaactataagctccttgagggcaggtattatttctcattgctcttagcaagtcacctgttgtttggcatacccagctgtcctctggagactgtcctttactttctgcatccacatagctatagtaggagccaccatatttgcgcaacatggccctaccaatggctgctgttgactggactggagatagagcccatcttaagccaagccactgaaagcctcatggccccactcatggatgttgttgattggactgtgggtagggtccaacccaagctggaccaatggagctcttcctcaagattttggaattaagtttaagagaagggatcttactgacccagcttgagtatttagaggagctgttgacaccattatttttcctgtgaacagggaactagttaacgaagagaagtggtgctcatagaggagaaaaaagaatgagggacacagaaaaaatacatcttagatttcctggcatctctcagttcctgtttccaggcctgtagggaaaagaaagagagatcagactgttactgtgtctatgtagaaaaggaagacataagatactccattttgatctgtactaagaaaaattgttttgccttgagatactgttaatctgtaactttagccccaaccctgtgctcacacaaatatgtgctgtatggaatcaagctttaagggatctagggctgtgcaggatgtgcctggttaacaatatgtttgcaggcagtatgcttggtaaaagtcatcgccattctcgattaaccaggggcacaatgcactgtggaaagccacagggacctctgcccaagagagcctgggtattgtccaaggtttccccccactgagacagcctgagatatggcctcgtgggaagggaaagacctgaccgtcccctagccctacatccataaagggtctgtgctgaggaggattagtaaaagaggaaggcctcttgcagttgagataagaggaaggcctctgtctcttgcatatccctgggaatggaatgtctcggtgtaaaacccactagtacatttgttctattctgataggagaaaaccaccctgtgcctggagttgagatatgctggtggcaatgctgctctgttactctttgctacactgagatgtttgggtggagagaagcataaatctggcctacgtgcacatccgggcacaataccttcccttgaacttatttatgacacagattcctttgctcacatgttttcctgctgaccttctccccactatcaccctgttcacctgccgcattccccttgcggagatagtgaaaacagtaatcaataaatactgagggaactcagagaccggggccggtgcgggtcctccatatgctgagcaccggtcccctgggctcactgttctttctctatactttgtctctctgtcttatttcttttctcagtctctcgtcccacctgacgagaaatacccacaggtgtggaggggctggccctcttcacaggcccctcccaaaacctggctgcatcagatctccccccaccccttcactgcttgagtcaatttgagtgagtctgttactttcagccaaaagtatcccaaggaatttagagcctgagagaagtccaatgtcacactgcaggccaatgaagaactatcctctttctgctgactctcaaacgcaaagttctttggggcaagaaagaaacaaggaagaaaaaaatcactcacatctgttgaagacttactatgtgctaggtattttggaatgtcatttatttaatgtttaccatggcagaaggtagattttattctattagcttacagataaggaaactgaggctcagatatgttgaataacttgtctagagaagaaatggggattatatttaattattttaacaaattccatgattgtcagttacctcctgttgcttttttttttgagacagagtctcgcactgttgcccgggctggagtggagtggcacaatcttggctcactgcaacctctgcctcccgggttcaagtgattctcctgacccagcctcctgagtagctgggattacaggcatgggccaccacactctgctaattttctattttaaatagagatggggtttcaccatgttggtcaggctggtctcaaactcctgacctcaggtgatccacccaccttggcccccaaagtgctgggattacaggcatgagccactgcacccggccccatattgcctcttaaaaggtgtgctatcagcatgaggctgttgaaagataataaggtagccagtgagcaccctaggaggaaggtgactagtacgttggcagtcagcctcttgaaatcttgtagagtacagacagaaccaagagttgagacagccatgtctcccccacattttaagaccattctctttctagaactcactcactgccttctggttgctttaggactcccagtacccacccagacagccccagctccagcctctggagacatctccttagtgggttctctgcatgcccttccatccttgggaaaacccagaacaaaaccagatcttccaacagaggctctgcaatggaaaaatcccaggggactgaggtgcatgatctgctttggagcactcagggatatctgtctcctcacactgggctggttgtggtgaagggtgcaccgggctcttttaatgtacacatctggattgaactgagattcccacagcagatttcctaatggtgagtggaggacaacagataaataaatataattaggaacagtatccagactgacgcatgctgaagagtttcagcaggtaccaacagatatattcaggagtcagagaagcttgggaaattcccatagtcataaattgtaatctccgggtcaagttagctgaccatcagaaatcatcctggcaggtcttttaacactgcagtttcctgagcctgacttctgaggattctgattccataggcctgtggtgtatttgtcattttgagaagcctccagggggattctgacaactggccaaacttagagagattcacaaggcacattgtcacattaaaggcactgaaaagtcctgtaataatgacacccacatcatttcactgaaccagtttatcaaagttacttgaacacagatctctccctctatatattttgtacacctgtttttacaaggtctactgctcagggagcttgccaagatttcctcttaataattctatactaatatcataaatccaggtttttttatgtctttcctaccattttgtagtatccactggctgttctctccttgaaggcaggaatagtgtctgttttatttgcaatatcccttatgcagagtctgagtaaatgagtcttttaagataatctctgaacaggggatgtggccctctgcctccccggttcaatgaagtactttgataccagggtggaagagagatttaaagcagcatgtcatagtaggaaaggctgcagagccacttttggttgacagtcatggatgatgagtgccagcagtccagctccttctcctctgagctgtttctccactgctctgagatcaacctcttaacaaacttggtccccaggtaaaagccctcctgagacatttggttaagaagaggagtttcccatttctccccttctcctttcagccaccaggcattgaagggagcagtgctgaggccatttaaatgggcttctccatagaatgggcccttctgttggaaactgggttatgcacaaaccattcacaatggctttttacaccccagaagcactaagatccccctaatcttcagtcaaaacagagcatgaagggtggggtattcatcccaaaggcactgggcatctgaaagttagggaggggtgggaccacccacattcagggctttgattttccagccagaatgacaagaccacaagacccccaggaggactccatccttctcattctttatgtggtggacccttaaaaagtgcaaggtgggaggctgaggcaggcggctcatgagatcagaagatcgagaccatcctggccaacatggtgaaaccccatctctactaaaaacacaaaaattagccgggtgtggtggcacacgcctgtaatcccagctacttgggaggctgaggcagtagaatggcatgaacttgggaggcagagattccagtgagctgagatcgtgccattgcactccagcccaagactcagtctcaaaataaataaataaataaataaataaataaataaataaaataaataataaattaaaagtgcaaggcttttttttttttttttttttttgtgacagagtttcgctcttgttgcccaggctggagtgcaatggtatgatctcggctcactgcaacgactgcctccctggttcaagcgattctcctgcctcagtctcctgagcagctgagattacaggcgttcgccaccacgtctggctaattttgtgtttttagtagagacgaggtttcaccatgtcggccaggctggtcttgaactcctgaccactggtgatccgcccacctcggcttcccaaagtgttgggattacggggtgagccaccgtgctggccacaaggcatcctaacaagagttttgctaccattatctcccgttacagttgaggaaactgaggcatgcagaggttaaatgaagcacccatcagagccaagcagttagatggcaaagttgtattagtctgatttaagaaaagtttaatacaggtaccatttacagaggtgcagacagtgtattgatttttttttcttttctttttttttttttttttttgagacggagtctcaccctgtcgcccaggctggagtgctgtggctcgatctcggctcactgcaatctccagctcccaggttcaagcgatcctcctgcctcagcctcctgagtagctgggattacaggtgcctgccaccacacctggctgatttagtaaagatggggtttcaccatgttggccaggctggtctcgaactcctggcctcaggtgatccgcctgcctcggcctcccaaagtgctgggattataggcatgagccactgcgcccgacagtatattggttttctatttctccataataaataactacaaacttagtgactttaaacaacacccctccattaggtcatagttctgtaagttaacaggccaggtatggcctgattgtctcctcagtgtgtcacaagtttaaagtcaaggtgttgctgaggctgtgatctcatctgaggctcagggttctctttcagactttttccagttgttggcagaattcagttagttgtggttgtaggactgaagcccccacttccttgctggttgttgtccaggaaccacttttatcttttagagaccacactcaaagtccacaggcaattcacagcatggatgtttgctccttcaaggccagcaggtggctgtctctcactcttcaactctctttgacttctaagggtcacctgattaggccaggcccacccaggataatcttccttttgattaactcaaagtcaacctaataacagtgtgaaatgccatcatatttgcaagtccagcccatcctcaaggggagggcattatgcagggggtgttcaccaggggagcaacaatcttggcagccagtttagtattctgcaatgcagagacaggaagcaggaaaccaccaggaatactgcagctccctgggaagagcagtggcgggacttgattacaagccctagtcatgaatagatgaggagctgagagacacagaaggctgtggggagagggccaccaggaagatgctgggtcctttggttgaaggacacagctagtccatagttacttggcaaggagggagctagaaaaataaatagcctgacctcagtttcctttcttttttctttctttccctccttctttctttttttctttttttttttttgagacagagttttgctcttgttgcccaggctggagtgcaacggcgtgatcttggctcactgcaacctccacctcctggtaaaagggattctcctgcctcagcctcccaagttgctgggattacaggtgcccaccgccatgcctggctaatgttttgtatttttggtagagacggttttgccatgttggccaagcttatcttgaactcctgacctcaggtaatctacccgcctcggcctcccaaagtgctgggattacaggcatgagccactgcgcccggccttctcactttcttttttgagatggagtctcactctgccacccaggcttgagtgcaatggcgaggtctcggctcactgtaacctccacctgggttcaagcgattctcctgcctcagcatcctgagtagctgggactacaggtgtgtgccaccacacccagctaatttttgtagttttagtagagacaggggtttcactatgttggccaagctgctctcgaactcctgacctcatgatccgtatgcctcagcctctcaaagagatggcaaagatcccaaagattacaggtgtgagccaccgttcccggccactttctcactttcatcttctgttgttgctctcctttggctgatcttaacatgaagctgagtaagggagccagcttattgatgcagtcagtagaagccagcttcccagggagatccaggttgggggaatatggagtgtggatcaggagaggtaaggagatgatatttggcaaaagtacttcttagagtcacacatcttgtaatgatagacctcagattcaaattcaagtctgtttaaagtcaaattataccatctatgcatccttccatgcatccatccatgcatccatccatctatccatccatccattcttccatttcctgagtgcctactgtgtggcaggcattctgctaacctaacaacccagtgagagacatacttatattcctattttataaaggcccagagaggttaagtaaataatccagagtcacacagccagggagtggcaaagctagaattcttatttaattccaaacttgatttctaccctctccaccaccaaccacccatatatatccactgaccaacctattcattcatcagacttttactgcatgtctcaagtaagctatgcactgtgtttagagctgaatgagacaccattcttatgtctccatgatattcacagtctggtaggagaaacagacctgtatacaggttattgtgcagtggtcggggacaggaactttgagagaggaacgtatggtgcccacttgtgggcatataggagtgagaggtctgctcagctggggaaagacagcatccttttgaggtgggttttgaaggatgcataagattttaaggggacagtgcatcttggaagggcatcatatctttgtagtccagctgcctctcctttgctcgagcttccttccttccttcaggggttaatttggaaggactgagttttgctgttattgagcaaacagagtcctctaaagtgcatagcccaggggctggaatggagctcacgatgtatgtgtgggggagaaaaactactttgatttgaattcctgtctggctatttttgagatgttatatatgaccttatgagggcccttccctatgtggtcatgtctataagagatttcgtatctttacccactggtgtcaggttggctgggtgactttcagccaatgggatatgagtggaggtggtatgtgctaattctgggcagacccattaagggcccttctgtggtcaccctttggtctccctttttgtgatactatggatagtctttatttattattctccaagggttgtgcctcaccttccctttttactgctgccccaagaccatcaggtttccacaagggggttgcttctttagccttaatcctggaatgaagtgatgagggtcagagccagagctgagctgcaagtgtgtgtcacattccagaggaaggaatggttgttactctaagacatggacttttgaggtcatctgttatcatagcatagtgtagcctaagctgaccacagcaaggcatctcacctttcgacatgttagtttgctcatccatagaagtggattaatagttgtagtcgcatggcaaaaacccatccctacaaaaaaaaaaaaaaattagccaggcatggtggtgcacgactgtagttccagctactcagggggctgaggcgggaggatcatctgggcctagggaagttgaggctgcagtgagctgtgatcacaccactgtactccagcctgggtgacagagtgagatcctgtttcaagaaaaaaacatatctgtagtcatgttattgggttttgtgaaaattaggtgaaattgctcagtaaaagcacagtttctagcccaatgtgtgtctgcactttgcagatgttcaagactcttcttccagtccctttctctgtcatacttatttctccccagggcctttgcatgtccatgctcttcctttgcctgaggctttttctcatttccttctttactcaagatcccatatgcagacctagctcccccagggggccagataaggatgggcttagagccccagaaaagtcaggacaggaaagggatgagaaaggttgcacttcagcaaccagaatcaggaaatctagaagagagttcctttaacctcaacatgtgcatatattttgtgctttatggttttgcattcttttaattttgatttacatcgggtatcttggctgggcgtggtgactcatgcctgtaatcccagcactttgggaggccaaggcaggtgaatcacttgaggtcaagaatttgagctcagcctggccaacatggtgaaaccccatctctactaaaaatacaaaacttagccaggcgtagtggtgggcgcctgtaatcccagctacttgggaggctgaggcaccagaatcacttgaacctgggagggcggaggttgcggtgctgagatcatgccactacactccagactgggcgacagagtgagactctgtctcaaaaaaaaaaaaaaaaaagtgacataattaaaagagccatcatctatggcctttaagtgtcatgtgtgtgctcatctttccttgctttactactcaaagattatcttttccatgtgacctgctctttcctgcctctgtcaccaccaaacatcaaagccttaagttttgtttggctgtttgttatctcttgagaattgagcaccagagctattgggtgggcttgatgttgacctacaatgcaggatgtctgtgggcatgactctctcctaggcactcacagacacttgaagctggggactgaggtcctctagtgtgtgtctgtgggggtgaaggagtgcaccctcatcctcctgcactttcgggtcttgtagcagcaactccctgtttctgtcctttctacttactgctggtttcatcacactcccagggttaatttaaagaaccagcctcggtgtgatgcacctacaacaaacagagccacttctgtggggagctctggagctgggatggcccctcagagtctagaggtggtgagagcgctggagcttcatcaccgtgctaactgtgtccctggaagagtgagggagcttgagtgattccttacccaagggccgtcataaaaggtctcagctgatgcctactgccgatcacattcagctatttgggaagagatgttcagtccttaagaggacattattagtggacatcactctttccacaaaagccccagtcttgtgttacttagtcccactagcttctttaaagaaaccccaagagcatttcctccaggaatctgtttgatctcttttcctgggggagatttccaggtgattctcattggaatgaatcctaggtcctgttgctgctgctggtctcacactgtgactgatgctaagtccttctcttccaccaccattctggattttccttgctatagcctaagtgtttatgtctccccaaattgtcagcgttggagcaccaagaagacaggcagcactgacagtagcagaagagtaggaggtggctgtggcaccccacgccgagcaggagcgggaggagttcctgggcgatggggccgcagcctgggccgatgctgaccatgggatgagatcattcttcactctgcaccgtgaccatcagggggcgccccaaccaccttttctgccccacatcgtgctcttgcagtgttctccccgcaggtgctgcatggagtgagtggcggcatccaccgtgaggaggagaggagctctgataccctcaggacccgccaggaggggcatcacggaggcttctggacgacttggagctgtgtcctggggagaaaaccgctcctgtctgggccctgagtgctgaggaggaagctgccatgcacttttccctggcatttttcctgcatggtgagtacagaagctttagttttctggtatgttctgttcattcctctcctgttctccctggttttcctctttctcttgtagtgttttagtatttattttacagtggtattcattctctgaaggcttttgagggtgtcaagtgtagcagactgtggtatttttaggggtttaagactttttctgggtgggggggaggggggagggatagcattaggagatatacctgatgctaaatgacgagttgatgggtgcagcacaccaacatggcacatgtatacatatgtaacaaacctgcatgttgtgcacatgtaccctaaaactttaaagtataataataataaaaaaatcttggtttttattaaaaataaataaataaataaatacatttctagttctgaaaaaaaaaaaaaaaaccaaaccaacaacagaaaaagactttttctgagggaacctcccctgtgtagagggagagagagggaagccccgctcaggttggagtcagggccaggcccagttctggctggctgcctcgtgtccaagcctcagagggaggatttgcattgggccttgctgcatttttaaatcttcgttcctgccatcaggacccaggggtcactcttcttcacttttgggcagcgcgtgtcctctcgtgtccctcccaccgtggccgcctgaccaggggcgagggactcctcggtgtgggttttttgtcctctttgcagaaatgtctgttctgggcctctgcccagtttggggtggattattttttgttgttgttttaaattgctatttagtactgttaatgtgttgtatattttcggtaagaaccccttagcagttatatgattcctcaaaactttcgtccaaacttcgggctcattttttccgttgtggcacagaagcttttcagtttcttgtagcctcacatggttgttcttgctttccttgcttgtgattttggtccccaatttaaaaaaatcattcacaaaccattccattctccatgaggtttttaccccttatgtattcctctttttctttttgaaactctttccaactgatgagcatggattcaagttgtcctgaaagtaagctccccctatcttttcttacaggaatttaataatgttttgtggtttcaggttttgtgttgaaatctttaatccattttgagttgatttttgtgtatcgtgtaacagaagggtcctatttcttttcttttcttttttgcatatggatatcagtttcctcaaaatgatttcatgaagaaactctcctgtccccattgtgtctttctgatctctggtgccgatttcatttgctctggagttatacccagtagtgggattgctagatcttacagtatttgcattttctgtcattttctttgagacggggtttcttctgtcacccaggctggagtgcagtggtgcaatcacagctcactgtggcctctacctccacagcccaagcagccctcccacctcagtctatggtagctgagaccacaggcacacaccaccatgcctggctaagtttttaaattttttgtagagacagggttttgccatgttgcccaggctggtctcgaactcctgagctcaagtaatctgcccacattgaccttctggtaattgtattttcagttttttgaaaatggcaacttccaactttttaccatagaatatgtactaatttatcttcccatcaacagggtataagagttcccttttctccaaatccataccagcattctttttaaaattttgtggccaggaacagtggctcatgcctgtaatcccagcactttgggaggatgaggcatggtggtgtgcacctgtagtcccagatacttgagaggctgaagtgggatgatcacctgagctagggaggtcaaagctgcagtgagctgggatcacgacactgcacttcagcctgggtgacaaagtctgagtccctgtctcaaaaaattaaaaaaaaactttttagtaacatttatttcaataaaagtgaaacggcatctgaatgtggttttgaggtacattttttttctgatgagagacgttgaggaccgtttctcttacatgttggtcaattttgtgtcatctttgcagagatgtctactcaagttctttgtattggtttggatatgtattttgctacattgtattttttttctgtgtatatgtttgataacaaccagtgattgagttatcgcttacatgattccctttctttttttttttttgagacagagtctcattctctcacccaggctggagagcacagtagcacatcacatgaccatatatattggctacctacagctttgcaatgtaatttgctatcaggaattgtgagtctcccaacttagtttgtatttctcaggattccttagaggttcagggccattagtggttctatgtgaatattagcattttatattcatatttcttaaatttttgccatgtataataacatacacaattagaagttatgctgggacatgtttttttctttggggacattttgatacatgtatactttgagtaatgatcaaatcagggtacttatcataactattccctcattgaggtattatttctttgttgtgagtacattcaaattgctcccttctagttttttgaaaaatacaatattttgttaaccagagttacccagctgtggcatagaaaaccaaaatgtgtttcgccaaactcactgtaactttgtttccataaccgatccctcccatccccctcctatccccctccttcccctctcctcaggaaaccgctactgtaccttctgcttgaaggtaaagttttttggattccatataagtgagatcacatagtgtttgcctttctctacctagtcgatttcatttaatgtaatgtcttccaggttcgtctgtgtttttgcaaatgacatgttgtcatgaatttttatgcatgaggcatatttcatcatgtctgtatgctgaagtcccttcatcctttcattggttggtggacaggtaggttgatttcataccttggttactcattgttagtgagtagtaggtcactaaacctcagaaggcagctgttgcttcaacagaccgatctcattttctttaagctcacaaccacggttagaattactagatgaaacagttcttgcatttttaatttctgagggtgctccaagtggttttctcagtgcgtttcatcattgaaatttctcccaatagtgtataagaggatctctatatctaacagcaccctgaacttttatttttaaattatttctgttttggtattattcattttacttagcgttagatagtatctgagtgtggtctttatttacagttttgtgatgaccagtgatgttgagaaacaccttttttaccttttaatcaatatcataccttcttttcagaaatgtctgttattcaggtttttttgcccagtttttttgggggtattgggtcttgtatgttttgtccctctgtagcgttagtttctgctgttgtcagataacactccctttcagatatatgattcctcataatttcctttttttgatgtgtaaaaagataaacctattgtggcaacagccaagaacggtaataatcaaatgcaggaattaggtgccatttatatttccccactcagagtataagacttcctgcctcacagaagtaaatgagatttttctgtgcatatagtaaaattttacttttcatattttaatttttcgtgtcctaaaaagttaacacaatttaattaaaaattaaagccactaaaacatttatgtaacaatttctttttaaattttactttaagtcctgggatacatgtgcagaatgtgcaggtttgttacataggtatacatgtgccatggtggtttgctgcatctatcaacccgtcatctaggtttcaagcctggtatgcattaggtatgtgccctaatgctctccctccccttgcccccaaccccctgacatgccatggtgtgtgatgttcccctctctgtgtccatgtgttctcattgtaacaatttctttaattaccacataaggtactatgttatctgacaaatctatgttttacagagaaattgtagaaaagtcattcacaagtttcttcttgatttcaaactgtaacacaatgttgtaagtaatgcaactagacagaattcggctggatattgaaattcaacataataaaaaatatatatgctggtttatccatactactcacactgttagtatgaatgctctatcctaaagacagaaacaagtgtcttagtgaatctatatcattacaaactagattagcttttctccttttgaattttagaaaaatacaaaaattcaattgcctaattattgtacacagtgtttcaatatatgcatgactaaagcaattataggatttttttttttttttttttttgagacagaatcttgctctgtcacccaggcctgagtgcaggggcgcgatcttgactcactgcaacctccacctcctggctttaagcgattctcctgcctcagcctcccgagtagctgggactacaggcacacacaccacacccagcttattttggtatttttagtagagacagggtttcaccatgttgcccaggctggtctcgaactcctgacctcagatgatccacccacctcggcctcccaaagtgctgggattacaggtgtgagccaccatgcctggccacaattatagtttttatataggagtaagaaaggtcttaaatggaaagattaaaaaggattgcaaatcacatggcagcagaagggagctataattataacatgtcagcaagaaaaccaaaaatcacctttcaaatctagaggattatggaaagatatctgaaaaaattgtacacttctgataaaggcagtttattttacacaaaatgcttaccaataatgtgcatgaggaaaaagtgaactcagaagttgacaagggaattcaaagagggaagaagaatttttgtaccaaatgctgcttgaataacaaaatataaatatttgcatcccattctcactccatacggaaaacaaatgggtacttctttctaaccttggaacaggtagaagtttcttgtaaggacacagaaagctctaaccctacataaagacatttataggttaaacttcagtgaaaattaaaggttatcaaaagacactataaacatgaatatgcaagccacagacttggggaaatatatgtaatacatgcatttgtcaaataattcatctcatataaagaacttttacaagttaacaatacagaggcaaacaggccaattaaaaagtagaaaaacttgaacagacagtttgcaaagcaagacatacaaatagccagtgggtatattaaacaatggtcaacatcactaacagtcaggaagatgcaagttaaaatctcaagatacaatttcatttgatttcacattttagccactgtaatggcaaaatcaaaacgactgataatactaaatgttgatgaaaataagaattaaccaacactctcataaaactggtggaattgtaaaacaactactttggaaatggtgtagcaatttcttgtaatattaaatatacacttaacctatgactcagcacttttactccaagctgttgatccaagaaaaataaaaatgtacattttagtacattttttagtacatttagtacattttttctagtacaagtctatgtgtgtatgtatgtgtatgtatgtgtatgtatacacacgtacacctacgtagacttgtactagaatctaacatagcagtcttatttacgttaacccaaacttggaaatgagccaatgtcctttgacagtgaataaataaataaaccatggtgtatcacacaacagtatatattcagtgattaaaagagaactatagaatcgcacaacagcatgggtgaatctcaaaacagaaaaatgtatttagagaaggaagccagacattgaaaagtgtggatgtgtgattccatttatttgaaatgcagccataagaaaaatttatctttggtgacagagctcagaaggtagttgtttttgacccatgaaggtactgactggaaagagatgtgagaggattttctggaaatgttctatattttgactgggatagtaacatgagggtctataactgtcaaagctcacagaagtgaacatttaaaacttctgcattttacaaagtataaattgttccataatttaaaacaataaacagtctcatatcattcattccttcaacaagtaattatacaggccttgccttttagtagttctgcagccttgtgaagatttgaagatttcttaacctctctgagatcatctagctcaagccaaatgggataatcataaaaaccacctcaccagggtattgaaaaaattagttataaaatgtttaggtcagtgtgaggcacatactagatcctcagtaaacattaactgattctatatttaccattcagcacccagacttgagaaaggggcaaggcaaagaggaagctc

SEQ ID NO: 145 - DNA, 4542 bp, Homo sapiens
ctggggctatgtagactacatctttaggtcagaacatctagattcacagtatcttgtatgttcctgttgtcatctcacatctcttgccaacgcattgttgaaacattcttacttggtcttgttattggacttcaagagaagggtctgggagatacatgaggctttgaaaaggaagtagctgcaagttgctaggcaaatatagtggcatcagttgcaatggagtggaaagtccttaaacgagtgatcaatatttagtggcaagactctagaccaaccctggaaattgcctgatgtttgtgaaattaaaagaaaatggctttgatggcaacttttaatttcataagccacgccagaattcataacagtctctgctcctgaggatcaccaccaggtgaaggtgaatgaataaatgttaaaatggaattcgtttcttttggtggggtacgtcaggtagaacttggagaataccttgtacccctgggccttaatgtccatctccaggcagtgcatgaggtcgctgttgtctaggaccgccttccagggcccaaacttgacaacagacttgaacatcttcttatcctgcagaaaacacaggacctctgaataatatgcatcctgctcctcagtttccaccaggcacacaagcacgctggacttccgtgctgttatggcttctgcacgtgccaggcgcaccatgagctccaggttctcgctgtagcccggcacttgcagcaaaaactgcttccgagacacctgctcaccaaagatctgtggcatgtcctccagcagcttgaccaaaggcttgatttcgtagaactgagcctcacggtacacttcagggatgtgctgtgtgggcacttgcccagtgcgcaggtagtccaggatgggtctgaaataggtgctggggcggtcgatgaagaagcggccctccgcgtccgtggaggccttggctaagctagagaacatctctgccagctttgagcccggaaacttcctcagggtacccagggtggtggtgtggaactcacccccgacgttcagctccacaacagtagacatctgggggcacaagaggcagagtaaaccaacacgccatctcccctgagcgcattacttatttttatccaaaggataactggataaaaaacttaggggagccataatgattggcttcagctagtgaaaggcccatcttactaaagagggttatatttatgctgtgttgctccagggggtgggctttttttttttttttcgacggagtctcgctctgtcacccaggctagggtgcagtggtgcaatctcggctcactgcaacttccacctcgattaaagcaactctcctgcctcagcctccctaatcgctgggactgcaggcgcctgccatcatgcccaactaatttttgtatttttagtaaagacgaggtttcgccatgtttgctagtctggtctcaaactcctgacctcacgtgatccgcctgcctcagcctcccacagtgcccggccgagggtgggcattttaaagaggaagaaagatttctgtttgaaaaaagaatacccattcaagcatcttaattttaggtcatagaatgttatgggaggaggccaggcacggtggctcacgcctgtaatcccagcactttgggaggatgaggcaggcagatcacctgaggtcaggagttcaagacaagcctggccaacttggcaaaaccctgtttctactaaaaatacaaaaattagccaggtgtgatggcacgcgcctgtaatcccagctactcaggaggctgaggcacaagaatcacctgaacctaggaggtggaggctgcagtgagccaagatcaccccactgcactccagcctgggtgacagagtaagactctgtctcaaaaaaccaacaataacaacaacaacaataacagaagaacgttatgggaagaggctgccatggaaggaagtctcagcaatgatacttccaaagtctgtggcctttggcaagcctttttccctcttacagcctcagtttcctcatctataaaatgaggatattggccgggcatagtggctcatgcctgtaatcccaacactttgggaggccaaggcaggaggatcacttgtggccaggagttggagaccagcctaggcaacatagcaagaccccatctctgttgttttttaaatagatttaaggaaaaaaaattttttttttaagtaaaggccgggcatggtgcctcacgcctataatcccagcactttgggagaccgaggtgagtggatcacttgagaccaggagttcgaaaccagcctggccaacatggtgaaaccccatctctactaaaaatacagtaattagccaggcatggtggcacgtgcctatagtcccagctgctcgggaggctgaggcaggagaatcgcttgaacccaggaggcagaggttacaatgagctgagatcatgccaccgcactccagcctgcgcgacagaatgagagtccaactcaaaaaaaaaaataagaagaagaaagtaaaatggggacgtggagttgttatgaagtcaagagtttccaacctgggatgctcaactctgatctaagatataataaaagctgggggtgaagtaggagggacaattccaacatttcagaaagactaaagaaaccatacatgtgttcattcaggaagaatttcttgggtatttactatgtatccacatcctgtgctgggagttggggacaaacattcttatttcatatagattagaagttctggttaacagttcacatgcccttgattgatttaaaaatggaattttttcttttctttttttttttttttgagacagagtctcgctcagtcgcccaggctagagtgcagtgatgtgatcttggttcactacaacttcagcctcccaggctcaagcgattatcgtgcctcagcctcccaagtacagatgtgcaccaccatgcctggctaatttttgtatttttagcacagactgggtttcaccatgttggccaggctggtctcgagctcctgacctcaagtgatctgcccacctcggcctcccaaagtgttgggattacaggcgtgagccacagccccggccagaaatgaatttttttttaagagatgcggtcttgctctgttgttgcccagactgggtgtgcagtggcatgatcataactcactgcagccttgaacttgggctcaagtcatcctcctgcctcagcctcccaagtagatgggactacaggacattcaacactgcatctggttatgtaaaaaaatttttttagagacgggtcttactatgttgcccaggctggtcttgaactcctggcttcaaggcttcctcctgcctgagcctcccaagcaggtgggattacagatgcaagccaccacgcccagcaaaaatgaaatttgtttgatgaatgtttttcaaaatataggcccatgagacttaaataataacgggaacattcttcgtaatgaaaaggccggtaactctacatattgtgggtgtaaaactgcttcacaaactgcgaagtgcagtgcaaatgcaagttaagtttggttgttcaacaaaacttttagaggccacctctctgtgccagaccctgggctgagcactaagactggttattaagtgatgatgtcagaatctgaactcaggtccgttttactccaagcttgagctcttagtcattacataaattaccttcagtcttccaataccttcactcttcattcccttagtgactcattcattcaacaaaatgtatgttgggcctattacatgcaaaccttgtgccaaacagaagaacaggacacagtccctgctttcaaggaactcacagtggagacagcgaaatagacggcttaagcatgtaggtgctgagagggaagactgaaaggtaggaggggtcaggtctttttgtggatgtgggttggaggctgtcagagaaggtttcctaagggatgtgatggccgctgctgctgaggaatagatgcatagtgttagaggaaagatttaaccacaagagtggggatggggacagggctcaggaatgtccctcagtctgatttaggtgtgtcctcattctcaactggtctgtgggctctcctaagattaaagtactggagttaatagagccaaagtcaaccgaactgctggagaaatctgattgccatgacaacatctcctaccaggggacagttctgctgactggaagggagaaggcagaggagaggacgcatcttgacagcagccaaacaatagagctgagaaaaataagcccagaacctctgattctttctcccataaacctcaaggccccttggcagggctgtttggttaaccctgaagtcacctctgtaaagctcgcagttaaatgcaaagctgcagagtttaacccttgaatggaccaatatgttctcattactcctacaccactgaaagctctcaggtcctcctaatgtccccatgttacaggcaaggaaagctcagacagaagtcacacagctaggatgtgatgaagttggagctg

SEQ ID NO: 146 - DNA, 17143 bp, Homo sapiens
accagtaaggaaaaataactgagcaccaaattctatggggtcacagagatagatgatactgggggtctgccctctaaagctgacaatctagctcggcagaaggttgagaggtgggggtaggaacacagaaataagtaatagctatcactgtgcacacccgcccccacgtgtcaggctttctacctacattgacacatttaagctcacaacatctctggaagatccagttattagccccatttatgaatgaagaaagaaaggctcagagtaaagcagattgctctaggtcttcctagcaggaagggctagggccaaggctcaaacctgggtggctcaaggtctaaatccagtgttctaacctgcacagctacgctattcagcctaccccagctggaccgccccctcccactgcaaggaaaccaaccctgacacccagccttctatgccttctatgcaaacctctaggtgcacttcagtcagaaatctttttttttttttttgagacggagtctggctctgtcgcccaggctggatcttggctcactgcaacctccacctcccaggttcaagtgattcttgtgcttcagcctcccaggtagctgggattataggtgcccgccaccacacctggctaatttttttttaagacggtgtttcactcttgtcgtccaggctggagtgcaatggcgtgatcttggctcactgcaacctctgcctcccaggtcaagagattctcctgcctcagcctcccaagcagttgggattacagatgtctgccaccacgtctggctaatttttttttttttttgtatttttagtagagacggggttttaccatgttggccaggctggtctagaactcctgacctcaggtgatccacccgcctcagcctcccaaagtgctgggattacaggtgtgagtcacagcgcctggcctttttttttttttttttttttttgacagagtctcctctgttgcccaggctggagtgcagtagtgcaatcatgtctcactgcaagctctgcctcctgggttcaagcgattctcatgcctcagcttcccaagtagctgggattacaggtgtgtgtcagcacacccagctaatttttgtatttttagtagagacggggttttgtcatgttggccaggctggtctgaaactcctgacctcaggtgatccgcctgccttggcctcccgaagtgctgggattacagtcatgagccactgcacccagcctctctggtggtatcttttggaaagatatctttctggaaaactctttccatcccagcccaaacttgtctctgactcactcatttatttgagggtaggtgacttagatgtcatatcctacaggagggcagactgactgcccctccaaagccaaatgccattttgatcctcttctattgaccctgtaccacctcgatcaagacaattctttgtttttttttcttttatggtcaaaaaatttaagactagttccaacttgaagtagttttgtttcaacagatcaagataattccttgttttttttttttttgagacagagtttcactcttgtcacccaggctggagtgcaatggcacgatctctgctcactgcaacctccacctcccaggttcaagcgattctcctgcctcagccttccaagtagctgggattacaggtgcccaccatcacgcccggctaatttttgtatttttagtagagacagggtttcaccatattggccaggctggtctcgaactcctgacctcaggtgatccacctgcctcggcctcccaaagtgctgggattacaggcatgagccatcgcacctggactagatcaagacaattctaacagttaacaattattgagcactcattttgtgccaggcactgtgctaagagtgcagtatctcagagtggttaaacatggaggctttggggccagacttctagatttaaattctggctctgggtcaggaacagtggccgacacctgtaattccagaactttgagaggctgaggtgggaggatcgcttaaactcaggagtttgagatcagcctgagcaacatagtaagaccccgtctctaaaaaaaaaaaaattagctggatgaggtggtgtgcacttgtagtcctaactactcaggatgcttgttaggtgcagtggctcatgcttgtaatcccagcactttgggaggccgaggcaggtgaatcacttgaggtcaggagtttgagaccagcctggccaacgtggtgaagccccatctctactaaaaaattcacaaattagccgcgtgtggtggcgcacgcctgtaatcccagctactcgggaggctgaggcaggagaattgcttgaacccaggaggtggaggttgcagtgagccaagattgtgccaccacactccagcttgggtgacagagcaagactccatctcaaaaaaaaaatttgttatacaaaggaatgaataaatgcatattacattattacattcctattgtagagaagaggaagcatagctggtggcaaaccagagatttgaacccaggagttcctgatccctgtcttgaacactttctttttcttttttttttagagatggtgtcttgctatgttgcccaagctggacttgaactcctgggcttaacggatcctctggcctcagcctctcaagtagctaggactacaagcaagcccggctagcttagaccctttgtatggccccagtgtggggcctcatataccctttggctgtgtttgaggacgtgtttgacagatttgatgatcttgattgcaccctgaagtataaaaacttaggctactcgagaaagatttcatgctaaatcaggtagtaaagctctagtaatatgatcctaaggttttgtcttcatgaaactgcatgaccttaaggcatcggtttcagctaacctgcccaaggccacacaggctgtaagggaacaagatgtgagcccagccttctcacactagagtccctgtttgttctcctacccggacttttttgttgctgttgttgttttgagaccagagtctcgctgtgtcgcccaggctggagtgcagtggcatgatctcagttcactgcaaactccacctcctaggttcaagagattctcttgcttcagcctcccatgtagctgggactacaggcttgcgccacgacgccgaataatttttgtatttttagtggagacggcgtttcaccatgttggccaggctggtctcgaactcctgacctcaagtgacccacctgtctccgcctcccaaagtgctgggattacaggcgtgagccacagtgccggccttttttttgttttgttttgagatgggagttcaactcttgttgcccagattggagtgcaatggtgcaatctcagctcactgcaacctctgcctcctgggttcaagcgattctcctgcctcagcctcccaagtagctgggattacaggcatgtaccaccatgcccggctcattttgtatttttagtagagatggggtttcactatgttggtcaggctggtctcgaactcctgaactcaggtgatccactcacctcggactcccaaagtgctaggattacaggcatgagccactacatgcagcccccaggagctcttgatctgaggcataaagatgcttagagggtttccaaatatattttatggtcacctattctcccaacaatgtgtgctatactgtgtgtttacacataggtgtgtctttagaggaaagggttcaaagctttcattagattctttttttttctaataaagaaaaaagctttgttgcccaggctggtctcaaactctcaagctcaagcaatctgtccgcctcggcctctcaaagtgttgggattacagccatgagccaccacgctggtcctcattacattctcaaaggggcctattgaaaaaaaaaaaaaaaaaaaaaaaaaaggccgggcacagtggctcacgcctgtaatcccagcactttgggaggccgaggaaggcggatcacaaggtcaggagatggagaccatcctggccaatatggtgaaaccctgtctctaccaaagtacaaaaaaaaaaattagccaggcatggtggtgcgtgcctgtaatcccagctattcaggaggctgaggcagtagaactgcttgaacctgggatgcagaggttgcagtgagccaagattgcaccgctgcactccagcctaagcaacaagagtcaaactccgtctcaaaaaaaaaaaaaaaaaaaaaaaaaaaaaagatgagactgttgagtcaggattaggatccaggtctgctggcaccaatttcagtgctctttatactttctgttgctattcattcattcatccattcattcagcaaatttatatcaagtatctggtatgtgccaggtatgattccaaattacaccattcccagattattctgagaatgctgcagtgccaaactcttggtatcacagactttatattctagtgggggagacagacaaaataataatataacgacgaaggtgcaatgttatgtgctatgagaaaacgcagtcggaggatggcgaggaaggggaacggaattttagatagggcggtctgggatcagaacctccagatgcccgtccatggactccaacgaagggagcgattccaggtaccagggcaccctgcacaaacctctcttgagcttccgcctcgcccaggtggggacggtagggagaccggagggcacacgcatgcgcacgaaggaaacggtaaagcctgaagggaggtgcagagcgcatgctctctcttgcccgagatgccgaggattttgacaaggactccgtcgtcccggatgatagtgctcaggttaatgccagtgggagggcggcgcccaatagtaacttcctttggaggttgtagtaccgcccccagagccaattttccacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcaggtactggggccggggtcgacgggtcgagcctcagccccactcgggcgagacagggagggactgtgaccttggcccgaggccttgcgggagggaaagtgagacccgggcccgccccataccggcgctgaacgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaaggtacgcccttgtacatctcttcaagcgtccgttctcttttcgttatgtgtgccttagtgcaagttcttcattctctgaaggcatgggtgccaggcgtgtacagcttgtttatcctcacaaacagaaaatgtattttcttccattttgtggatggacagctgacacttgggattacgtctcaattctcttcttcaaggtcatacaataagtgctcttcagtttcccttttctccgattcatcctacctcctgccttctgagacagttcttttttttttttttttttttttttttacttctgagacagttctgaaacaggtgtccgttgtgtaaagcctggaggtttgggaaatccaattagagtggcaaagtctgaaggtggttcgcgtaagcgaacccagcagctacatgggaggctgaagcaggagaatcccttgaacctaggaggcggagtttgcagggagctgagatcgtgccactgcactccggcctgggcaacagagcgagactctggtctcaaaacaaaacaaaacagcaacaacaaaacatgggcatctggcagctactagttgcataatgaagagactgacagctttctctattccccaccaataccttttctcgactgttttatcattggttgttgatgtagatatattacaatgttgtgtcctctgttgtttgctgtatctttaacaagggcttattctgattcttcaatactggccatgcgcggtggctcacgcctgtaatcccagcactttgggaggccaaggtgggtggatcgccggaggtcaggagttcaagaccagcctcgtcaacatggcgaaacactatctctactaaaagtacaaaaagtagccgggcgtggtggcgggcgcctgtaatcccagctactcgggaggctgcggtgggagaatctaggaggttgaacccaggaggaggaggttgcagtgagccaagatccagccattgcactgcagcctgggcaacaggagtgaaactccgtctcaaaaaaaaatagtaataatatacttgatcttagccaaaaggccgagaagtgatgaaaaaagttattattattattattattattacatcacctagcccatataggactggccttgtagaaacttaacctagactcttgaatttgttgagtctttgagcggcactcccatccttgtacaatgcaattagaagccaaacagtaaaggtttctcagcctcagcactgttgacatttggggctgggtaattcttgttggggggctatcttgtgcattgtgaaatgtttagccatatccttggcctgtacccactaggtggcagtagtacctgcgcaaccccactcccgcttccccctcccccgcccccatcacagtgtctcccgatactacccagtgtgccctgaaggggcaaaatcaccctgggttggagaccgttgccctaaagtaatgcttttcaaaggtaataggcaagataattcagggtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttagattggtcatgagctgagagttactttctttggttgtgttttttcgcagaaattagcatttgagcttcaagtcagtgtccaagttgaaaagaaattggcattagttatttctgtttccacagtgaaggtctaggctgctgtttagtgttacaggtccaattcagcccattgaataagtgtttataacagcccctcttggtttattgtgcctgatgtggataaagggaccaagtggagtggtgctaattaagcatcaagattagtccttggtcaggtgcggtggctcatgcctgtaatcccagcactttgggaggctgaggctggcagatcacctgaggtcaggagttggagatcagccgggccaacatgatgaaatcctgtctctactaaaaatacaaaaattagttgggtgtggtggcgcactcctatagctgggtgtagaggcttgaacccgggaggtggaggttgcagtgagccaagatcgtgccactgcactccagcctgggcaacagagtgagactctgtctcaaaaaacaaaagattggtccttgacgggcctgagatatcaaagacattgaatggctagcagaatgcctgcaatttacacctgaaagaggtatctgtatttctcaagaggaagtgcttgatctgggtctcatctttttcctgtcccattccactagcatttactgcagaatcttccctgtagtcataattttcttgaacatgtcaagttcttttttttctttttttttgagacggagtctctctctgttgcccaggctagagtgcagtggcacgatctccactcactgcaagctctgcctcccaggttcaagccattctcctgcctcagcctcccgagtagctgggactataggcacccgccaccacacccagctaattttttgtattttcagtagacacagggtttcaccatgttagccaggatggtctcgatctcctgacctcgtgatccacccgcctcagcctcccaaagtgctgggattacaggcgtgagccaccgtgcctggcctcgaatgtgtcaagttcttactttgaggtaatctccttcagggctggtagggtcagaaatcttaagagaaacaaagggagcgtgacacatttctgcttattggcttttctgtggaattaaaactatcctgctttaatggatagtaaatggtagtagtagtagttacaaaaccactctgagagggcaattattattattattattattattatttttttttttttttttttttttttgagatggagtctcgctctgtcgcccaggctggagtgcagtggcgggacctcggctcactgcaagctccacctcccgggttcacgccattctcctgcctcagcctcccaagtagctgggactacaggcgcccgccactacgcccggctacttttttgtatttttagtagagacaaggtttcacatgttggccaggctggtcttgaactcctaacctcaggtgatctgcccacctcagcctcccaaagtgctaggattacaggtctgagccactgtgcctggccagagctggtttattttattttattttattttttgagacagagtttcgcttttgttgcccaggctggagtgcaatggcatgatcttggctcaccacaacctccacctcccaggttcaagcaattctcctgcctcaccctcctgagtagctgtgattacaggcatgtgccaccacacctggctaattttttgtattttaagtagagatggggtttctccatgttggtcaggctagtctcaaactcccaacctcaggtgatctgcccacctcagtctcccaaagtgctgggattactggcgtgagccaccgcgcccagccagctggtttattcttaaggctcaaaggaacactttcgtggtaaggttcaagaggcaacaaggtatttcatattatattacattaaactggtaacgcaaaagtaaggcatatacagtacggaatagagaatctcattgtctttgccattttgtaataattaacggaatagagaatctcattgtctttgccattttgtaatattacagcctgcacttctgagtccctatagagctgttttggttgtggccagtctgagtttaggacagatgcattatacttcagcttgctgcctggcctcccttggctgggttccaaacatcttttataatccttggataatggaccctagccagtcataaaatataaatgaagaatgttttgaaatgacattaaggacaagtcacattaaatatgatgtagcaattggtaaagtggagaaaagacaatagaattagggccttctataaatcaagtttcttggtttatttttcagacagggtcttgctgtgtcacccagcctggagtgcagtggtacaatcacagctcactgcagtctccacctctcaggctcaggtaattctcccacctcagcctttagagtagctgggactacaggcacacaccaccatacccagctaatttttttgtagagacagggtttcgctatgttgcccaggctggtctcaaattcctgagctcaagtgatccgcccatcccagcttcccaaagtgttaagactacaggcatgagccaccatacccggcctgtaattcaagtttcatactactttgggtatctaataaaaccaaattactcaattaattgtggggattacgtgacattctgaggtaagtaagtgctctcctgatccttttttggtaccgtagtgtatttgtatagcctattgtggaaattttagaaatcagtgaggttttggctgggtgcggtggctcatgcctgtaatcccagcacttcgggaggtcaagagttcaagaccagccaacatggtgaaaccccatctctactaaaaatacaaaaactagctgggcatggtgatgcatgcctgtaatcccagctacttgggagactgaggcaggagaatcattggaacccaggaggtggagtttgcagtaagacaagattgcgccactgcactccagcctgggtgacagaaccagactgtctcaaaaaaaaaaaatgtgaggtttctgattgccatactgtaccacctagcttaagacaagtcactttttcttcacctttaagttacaaaacacaaaactctccccactgtatatatgaggtttgtagggtaacagggtaatagttccataaaatgcactgagttccagaggcaaataatgatagaaactaaatgttacaatttattccatcttcaggattacagacattacagggcaggatgagtaaacaaggcaaatgaagcgagcaccttcagcttcccccctaccccgacatttaaccagatgcagcattttgacatttttaggatatgcaggttgacaattcactgacttgggttgagagctggcaatagcagatctttgcaatttaggttcttcctccacagctattccaagtatcttaattcctgaactgcacactgagagctctgaaatggtgttcactgcaacattcttgcagctttcacatcttaatctgacacctcttgtgaaggcagggaactgtgttaaaagctgtcttcctctttgctaatccaggccaccatcaatcttaaccattagttactatataaaaataaaagtgtgctcaaaagcactcactgaaactgttgtgcccagatcccttttcagagcattagttccctgagaggaaaaaaagaggtcctaaccaattgctttcataaatagtgaccccagtacagtgtatatgtcttttgcagcagaaatcaagaggtcaggcagctctgctcatcctgactagtttatcatcgtttgcatacaaggtatatttatgtaaagctgattccacgccaagtattgcaaccataatctcaaaaaaattgttcaattttagcacacagttcctgcaagataccacagcaggtgagaaatcatctcaaagagttcatcttttacaactgagaggaaaacatcgaaggaggaaataaaactcctctctcctaagttcctcatcaaatctgatggctatgttcacagagttagttgacaaaaatccagagtcctcaatttctggacttgcgaaatccttcaaggtgactgtcaaggtcaagaagaattttcaggcttttctttgccatggcccatgaactccagtccttcaataggaatctctttctcctttattgctttctggtaggaggagaaaacacattataaagacctacatgaagcttaagttgcaagctttgtaaataaaatatgacagtacaaaagtaaaatcaagctgattataaagacttataaccatgattcaaaccacatactttttaaaaaacaagtaccggtcaggtgtggtggctcacgcctataatcgcagcattttgggagaccaaggcaggtggatcacttgaggccagaagttagagaccaacctggccaacatggcgagaccctgtttatactaaaaatacaaaaattagctgggcatggtggcgcatgcctgtaagcccagctactcgggtggctgaggcatgagaatagcttgaacctgggaggcggaggttgcagtgagctgagattgtgccattgcactccaggctgggagacagagtgagactctgcctcaaaaataaataaaaaccagaagtaccataatgaataaatcaagtgtaagacctgagggagactggaaaaggagttgtgagggaaccgttaaaattaagtgaaatttgaaaaataatcatcactttgtgttagtgaaagacttaggttcaaatctgggttccaggacttactggctatgtgactaactgtaaatgggatgaagacagcaactacctcggggaattgctgtgaggatgtgttgggttaacttattggaagtgctttgcccggtgctgttcttaacaattcaaagcagttccacatccattgggccagaataaacatttcctggctgcagttgcggggactggtcaagagagagaaacaggctaacgaagggtttataacaacaaaaaaatgtgaccctccagtctgaattctgaagtataatcccgcccagaccccagcagtaatagtggaaaagtgcaccacctgcgaaagaaccaaggaaacctgatgctagtgaactcggattaatcacttcctatttctgggtgttagttttttatgtataaaatatgagtaactatgcccaccttgcgagtttagggtgaacaccaaatgaaccaaaggatgtgactgtgcttcttgaaaagcactgccccaatatttgtcattcggagagacacccaagtggcctcggtggtgatggtaggggagcgagctcctgccactggcctcactgcgacttttctccacccttccagtccagtcccaatccccgtaaaatacgatgagtgtggtgggacacagcgccgagaatgcagggcctgggaacagaggcgggagggctcacctgaacacactgctggtagcgcttgaagaggtcggtgcacgggtccccggagctgtcccccttgagaaatttctcggcgaaccagcgattgaagcactggtcgtactcgcgcttcatgtccgtgcatgcctcccccacactgttcatggcgacagtggtggcggcggcgacgacggcgcactctgatgtcatcactctcaggcgcgtcgctcggcgttacgcgcgggcgcactgcgggggccaaggaaggaagaaatgtggtcgcggttggtgtggctgggccttcgggcccctctgggcgggcgccagggcttcacctccaaggcggatcctcaggtaaaggccagggccatctaggcgggtggcggagcaagccgggaggcacttcggagcgccggtgacccacactccccgcctcatccctcctccagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacaggtaaactcgcggctgcagccccgaagccttgaccgtggcccgttcgcagccgtttaatgtgacgattagcgaacagttttccagggggttaaagagtgttagcaagattcaggaacttgcccacagtcacctcgcgagtcagtggcttcactcttccccttgttcattactgatgctctcgctagtgtaagtggaaacaaaacccgaactgctaatcactgcctttgtttttttttttgtttgtttgttttgtttttttttttttgagacggagtctcgctgtgttgcctaggctggagtgcagtggctcgatctcggctcactgcaacctccgcctcccgtgttcaagcaattctctgcctcagcctcccgagtagctgggattacaggcgactgccaccaggcccggcttattttttttgtatttttagtagagacgtggtttcaccatcttggccaggttggtcttgaactcctgaccgtgatccacccgcctcggcctcccaaagtgctgggattacaggtgtgagccaccgcgcctggcctaatcatcgcctttaaggccctactccatagagtccctacctactcactccaacgtactcttctcagtactctccttggctaccttgactgcttctccagcaagacaagttcttttcctctctagatctctgcactggcccttcgtttttttccttcctctcagtatttgcatggctgcctccctcttggcacaggtctcagcttatcttctcagaaagggctctcctaaccactccaaatcccttctccccttctagttagtaactcatcctattgggttttttccctaacattttaatggacttttgttcatttgttatatctcttttattaaaatgtgagctcattatgtagttactgttttattcctgccttgaatttttattttatttgtttttgagatggagtctcactctatcacccaggttagagtgcagtggcatgatctcagctcattgtaatgtccacctcccagactcaagagagcctcccatctcagcctcccaagtacaggaccacaggcgcgtgccacttggcctggctaattttttgtatttttgatagagacgggattttgccatgttccccaggcttgtctggactcctgagcaaaggtgatccacccatctcagcctcctaaagtactgggattacaggcatgagccacagcacctggccgtgtttgattctttcaaatgtcttctctactttgcaattttctttttcctttgggacggggtctcactatgttgcccaggctggtcgcaaacttctagactcaagagatcctcctgcctcagcctcccaaatagctgggactataggtgtgcaccaccacacctggctaatacttaaaatttttgtagaaacggggtcttgccatgttgccccatatggtctcaaactcctggtctcaagcaatcctcctgcctcagcctcccacttcctcaagaaagtttttttttttttttgaggtggagtcctgccccatcacccaggctggagtgcagtggcatgatcttggctcactgcaacctccaccctccaggttcaagtgatttttgtgcctcagcctccggagtagctgggattacaggcacccgccaccacactcagctagtttttgcatttttagtagagacagggtttcaccatgttgaccaggctggtctcgaacccctggcctcaagtgatccgcccatcttcgcctcccaaagtgctgggattacaggtatgagtcactgcactggccaaaaaagtccattcctttttttttttttttttttttgagacggagtttcactcttccacccaggctggagtacagtggtgcaatctcagctcactgcaacctccaccttccggtttcaagtgattctcttgcctcagcctcccgagtagctgggactacaggcgcccgccaccacgcccagctaatttttgtatttttaatagagacggggtttcaccatgttggccaggctggtctcgaactcatgacctcacagtccacccgcctcggcctcccaaagtgctgggattataggcgtgagccacaagtcttcattcttttatacttaggttctttttttttttttttaattgagacaagagtctcgctctgtcgctgaggctggagtgcagtggcgtgatcttggctcactgcaagttccgcctcctgggttcatgccattctcctgcctcagcctcccaagtagctgggtctacaagtgcccactaccacgcctggctaattttttgtatttttagtagagatgaggtttcaccgtagccaagatggtctcgatctcctgacctcgtgatctgcccacctcagcctcccaaaggtgctgattacaggcgtgagccactgtgcctggctatacttaggttctctacctgtggctctcgtgatatccaaaagggctgatttatacatgcgtttatacatctatttaagggatgtgttgagtctctgcccctctcctgctcacccaccttccacagcatgtctgtttttccttatcatgttctcagtggttggcactgagtattcagtaaatgtgttttgttttgttttgttttgtttttttgagatggagtctcactctgttgcccacgctggaggcagtggcgtgatctcggctcactgcaacctctgcctcctgggtttgagattctcttgcctcagcttcccgagcacccgggattacaggcatgcaccaccatgcctggttaatttttgtatttttagtagagaggggtttcaccatgttggcaaggctcgtcttgaactcctgacctcaggtgatctgcctgcctcagcctcccaaagtgctgggaatacagccttgagctgccgtgcccggccacagtaaatgtttaatgaatttttttttttttagagacagagttttgctcacgttgcccaggctggagtgcaatggcgcgatctcagctcaccacaacctctgcctcccaggttcaagcgattctcctgcctcagcctcccaagtagctgggattacaggtgcacgccaccacgcccagctaattttgtatttttagtagagacagggtttctccatgttggtcaggctggtctcaaactcccgacctcaggtgatctgcccaccttggcctcccaaagtgctgggattacaggcatgagccaccatgcccggtcccagtgttctttattaatatctctaggaaaggagggactagaagcacagagtcatcagaatttccccaagttatctagagggtaaatacaaagaaatataaccatcattaataagggaaaaggtcgtgaaaaaagatgaggaatttggatccagtagctagcatctcaacctcgtattcagtgatctgtactgtttttcataaatttggaaaccagtttgggttaataattcccattaatcatttta
